United States Patent 9,238,822 (COMPOSITIONS AND METHODS FOR CONTROL OF INSECT INFESTATIONS IN PLANTS) - sequence listing, part 6

SEQ ID NO: 17434 - DNA, 472 bp, Diabrotica virgifera
  misc_feature (3)..(34): n is a, c, g, or t
ccnnnnnnnnnnnnnnnnnnnnnnnnnnnnnnnncaatatattcacagtgaacatagtcttttacttttaagattaataaatatgcactctcctccattgcgtggatacgtcgaaatgatacgataatgtacatatgtaaatatatgtttgccaaaatatctcgtctacttctaacatattaatgcgggacaagtggttcttgaattatttttgtccgaaactgattgtgtggtttttatgaccgacaaaattttgaacgaagaacatatatctgttacgactctgtagatttgacaaggagacctttcatatactactccagagaaactgttcttaggcgtagaactaaatcaatagattttctcttgagataaattatccatgaaacgcaacgataaaagatcccaggcatacgtattgggcaataggatgggcttatagtcattagtgtttattaatattacacttcct

SEQ ID NO: 17435 - DNA, 541 bp, Diabrotica virgifera
  misc_feature (15)..(15): n is a, c, g, or t
cggacgcgtgggggncatgattgccccccttttaaggccgactaacctgtgatctgcgccaaccagatgtgtctaccactaatggatattatactcaacaaccctctgcagaaataccatcttttgtatgtacgaatattgcagaatcacgctgctgcttaatgtgatagatgttattttgtttcagtacatactctttgatctatgtgcactagttcatatcctcttatgggtatatcactcccacagttgttgtactacttgatttaatagaaagtctattcacgtagatcatgcaacatacaatattgtattgaatggtctttaatgtaaccctcgccgaagtcgttacaatgggtttaattaatgattgatccttcttcttctttagctatcatagctcaagttgctagaaaattccctatgattacattttctataaagcgtgtggtgctaagattgacgattatatgactacctctacagagcttggttcgtcgtatcaacttcaatctctgctgaattcttagcttatattgcc

SEQ ID NO: 17436 - DNA, 892 bp, Diabrotica virgifera
  misc_feature (620)..(643): n is a, c, g, or t
  misc_feature (798)..(798): n is a, c, g, or t
ctctacgcgtccggcagcgataagataaagtgaatttgttttttggctgtaaattggtacacaaatcaaatttgataacatggaagtaaaacaagaaacttgtaaaatagaaatagataataaagagtttgatggtgatggtaccttggatgacttcaaaattgaaattaaggaagaacccaagagagaacccgcctacaacgcgtttaactatttagactttcctgaaaacgctaaattagaacaagatgaacataaatttaatgtatgtgaagaaacccaaacaacaaaggaagaaaggttacgtcaaaacgagattaaagcgaattctgaaagggctttactaacacacactggaaaaaaacattacaagtgcgaaatttgttttaagcaatttggaggagcagggcatttgaaagagcatttaaggatacatgctggagaaaggccttacaactgcgaagtttgctttaaacaatttactaaagcaggaactttaaaaaatcatttcagattgcacacaggagaaaagccttataagtgcgaaatttgtgctaagcaatttagtcaagatggaaatttgaaaaagcatttgagaatacacactggagaaaagtcgnnnnnnnnnnnnnnnnnnnnnnnnctatttagtctagataaaaatttgaaaaggcatataaggatacacaccagagagaagccttacaagtgcgacatttgttttaagcaatttggaggagcaggaaatttgaaaaggcatttaaagatacacactggagaaaaaccttataagtgtgnaatttgttctaagcactttagtcaagatggacatttaaaactcatttgagggttcacaatggagaaaagccttataagtgtgaattttgttcca

SEQ ID NO: 17437 - DNA, 225 bp, Diabrotica virgifera
  misc_feature (146)..(168): n is a, c, g, or t
gtattattgtatgcttatatacatatttaatatcttctaagtgtgagctcctacataaaaatttatatatagttaatcttgaaataacaattatgagtatgaattttcatattctaataatatgccattatttacctttatatacnnnnnnnnnnnnnnnnnnnnnnnctctctagttaatgtatcatgtttcatatgtatttattgtttaggtatgcgatagat

SEQ ID NO: 17438 - DNA, 899 bp, Diabrotica virgifera
  misc_feature (674)..(689): n is a, c, g, or t
  misc_feature (720)..(757): n is a, c, g, or t
  misc_feature (795)..(795): n is a, c, g, or t
  misc_feature (822)..(822): n is a, c, g, or t
  misc_feature (872)..(886): n is a, c, g, or t
cgcgggtttgacctcaaacgcgcgttagcacgtgaacggtcttcagtaaaacgtacgcccgccacgagtggggggcctcggctcatccgcccatcatcttccgcgattttcgaaaaaacacactcttttttctcgtaaaatttcgaagttttcagcacggagttggaattcgagatcgtggtaaaatttcggaaaaacttctagaaaactaattccgcgacaaatgtttctcggggattttttcgtccggaatttttggtggggattttttcgtccggggatattttcgtccagggattatttgtccggaccgactctcgttgttttgcttgctcgttacgttattgttactgttacaaaatgcaacagatacgaaataagattctttacgactacaactaaagcacaatattcaagaattgctactgttattatatttatgatagttggagatgtccaaagagtggatcatttcatatttgatccagaaagaggttttgccaaatttaacataatttcaaacttcaaatactctcgaaacagggaggagaatttaaaattgaatttttattatcgattcttgattttaaacaaatcttaatcttctacttaagattttaaggatgaacatacattattaataacaaatctataaaaaaaaataaacctgaacnnnnnnnnnnnnnnnnaaggcttttgaaccatctaatgaaaaaatgnnnnnnnnnnnnnnnnnnnnnnnnnnnnnnnnnnnnnncatttgtgaaaaatgtacttaaatccttagccgattanatttattcgaccgatatatgattttgngaaactctgttgggctttatttaacggatatacttagcaattcctaatgnnnnnnnnnnnnnnnagacatttttgaa

SEQ ID NO: 17439 - DNA, 601 bp, Diabrotica virgifera
  misc_feature (548)..(566): n is a, c, g, or t
ggagaaaaaatatttatgtatagatgggggattatacacagcagataaagggattttgtatttcgaacaataatatttttaaaagatgtgtaacctcatgtactaacccaaattagcctaacctaaaacactaaacaatcgtgtaagattgatggataataattttaatatgtacacattatttgtttattttataaggtattacactgtttgcaacattgctttctctttaaaattcttatcgactatataaaattgatttttcttcccaaataaactttgtaaggtcacgcaactctgaagtacacctaaaaccggcaacaaaatgtaagatatagttgtgagtaaaatgactttaaatgtaccaaatctttctatgctaaatgatttaatagcaccaaatatattactataacagcaagcagcgagtatgaaagcattcaaaagatttacaatggggttcattggtatgggataaagtgctgatagtaaataataaactattgaaaaaggagatgttaaaacagaataatattgaaaagaatagnnnnnnnnnnnnnnnnnnngggatcttctgaagaatcactagaatatgtactcc

SEQ ID NO: 17440 - DNA, 684 bp, Diabrotica virgifera
  misc_feature (67)..(86): n is a, c, g, or t
  misc_feature (246)..(258): n is a, c, g, or t
  misc_feature (260)..(288): n is a, c, g, or t
tgcttatataataacttttatctgagtagggtaatatatttatatagtaggatatcgttactaatcnnnnnnnnnnnnnnnnnnnngcaaaccttcactaccggcagctgctagattttaaggtaattttaatcaaaatcatttttaaaatgattgggaaaacacttatttgcatcccagttaatctcttcacaatgttaactattacaaatttagggaatattatgagaactaacgttttgtgtnnnnnnnnnnnnncnnnnnnnnnnnnnnnnnnnnnnnnnnnnnatacatatacacttttccaagaaattaacacaccaccttaaaaaatggtcattttttatgtctcaaatttcctaaacctgttgtccgatttaagtgattttttcaatatgttatagccttattctttaacaatatcgctgtaataatattgatgctagacagttaaattgtcattgaataccgtgtgtaccaattaaactgtttttttcttaaagttcgcaacaccctgtggaatattccatcatttataaaatactgaaatcgaaacctaactatagcctcacgttttcttaacattttgttttttgattcattcgctttatgtggataataaaaaagttaggtactttacccactagccaagtttttcatcaatatgtcctcattttctgctca

SEQ ID NO: 17441 - DNA, 130 bp, Diabrotica virgifera
  misc_feature (34)..(78): n is a, c, g, or t
  misc_feature (80)..(124): n is a, c, g, or t
atttcattttaaaataatcaaaatatcttttccnnnnnnnnnnnnnnnnnnnnnnnnnnnnnnnnnnnnnnnnnnnnncnnnnnnnnnnnnnnnnnnnnnnnnnnnnnnnnnnnnnnnnnnnnntacctc

SEQ ID NO: 17442 - DNA, 117 bp, Diabrotica virgifera
  misc_feature (14)..(59): n is a, c, g, or t
  misc_feature (70)..(101): n is a, c, g, or t
tggtgattaaaacnnnnnnnnnnnnnnnnnnnnnnnnnnnnnnnnnnnnnnnnnnnnnngatccaagtgnnnnnnnnnnnnnnnnnnnnnnnnnnnnnnnntaacagcgtaatttta

SEQ ID NO: 17443 - DNA, 639 bp, Diabrotica virgifera
  misc_feature (93)..(107): n is a, c, g, or t
  misc_feature (351)..(365): n is a, c, g, or t
cctcctagcgtccgcaaagatcagaggttttcgatggtcctcctctctttcagtacttgcggaaaatatctgccggctatggaagaaacactnnnnnnnnnnnnnnngaaccttctagaaccacactataggaactctctccttgctagcgatgccgacttcgtaacatattctgatctaattacttgtcatttataaattttttgacaaatataactatcccttgcaaactcattggttcaagaatgattttggttatatacttctaatgcggctgttatgacgaggccaattgtaacgacacgattacatctaagatacaacaccggatcttcttatgcatgttcttcnnnnnnnnnnnnnnnaatatgctcatcatggaccataataaatcaatagcattgctgctagtacatgacagacatgacgcgtgcgtaggaaatatccgatgaactacttgttcgagaatgcatgagactatgtaatctgatactgatgaagattattatgtctaacagcatcatacgatcgaaattatctacaattctggccacaaagattgactatatcgtcaagaagactgatcagctagtaatattttatatagtgacattaccagacttctctccaattttttgc

SEQ ID NO: 17444 - DNA, 266 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(192): n is a, c, g, or t
  misc_feature (202)..(265): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagttttaaccggtgtgagccaggttggttnnnnnnnnnnnnnnnnnnnnnnnnnnnnnnngaaaggaccnnnnnnnnnnnnnnnnnnnnnnnnnnnnnnnnnnnnnnnnnnnnnnnnnnnnnnnnnnnnnnnnt

SEQ ID NO: 17445 - DNA, 859 bp, Diabrotica virgifera
  misc_feature (655)..(655): n is a, c, g, or t
  misc_feature (836)..(854): n is a, c, g, or t
cagtgatacgtgtccttttcgttaggtcttggttccttattttgtctttttttgtcacgccgagaatcgatctttccatgcgtctttgtgccactcgcatttttagtgctgttgtttttgtgagcgtgagagtttctgctccgtgtgtcataataggaagaacacattggtcaaatgccttccgtttcatagctatcgggctgttgctcttaaagatgtctcttagtgaaccatacaccgcccaagcaagtgttatttgtcgttagaattcacagggtctgattatccttgcttattctgatttcatgaccgacatatatgtacttttctgtcaattctaccacttgattttggatggttaggtgttcgctggaaactagatttgccataaatttggtcttactgatgtttatttttagacctattgttgaagatacgttttcttgtagcatttgttgtgcttcacccagattttcggtaataagtactatatcgtcggcaaatcccagatgattgaacatttctccatctatttttattcctcaatgttcccactttagcattttaaaatcgtattcgaggatcgttataaataatttaggcgagagagggtcgccctgtctcacacctcgcttgatatgaatttctctggtgntatcatgtagttttacacgcattgtggcgttttggtataatttttgtattaactttgtaaaccggtagtctattctactacctattgtttagagcagttataatgctgtctaattccacagtgtcgaaggctttgtgaaagtctaccaaagtaagtaccagtgatctgttatattctatcnnnnnnnnnnnnnnnnnnntactg

SEQ ID NO: 17446 - DNA, 180 bp, Diabrotica virgifera
  misc_feature (2)..(178): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngc

SEQ ID NO: 17447 - DNA, 830 bp, Diabrotica virgifera
  misc_feature (40)..(59): n is a, c, g, or t
  misc_feature (118)..(142): n is a, c, g, or t
  misc_feature (150)..(796): n is a, c, g, or t
  misc_feature (798)..(829): n is a, c, g, or t
tttttctcttctctcttaaaatcataaaatctttctcccnnnnnnnnnnnnnnnnnnnntctcatctctaacggatagttaatctagtatcgtgagagaatatctctctcatttctcnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnng

SEQ ID NO: 17448 - DNA, 89 bp, Diabrotica virgifera
  misc_feature (2)..(25): n is a, c, g, or t
  misc_feature (36)..(59): n is a, c, g, or t
annnnnnnnnnnnnnnnnnnnnnnngagcataaatnnnnnnnnnnnnnnnnnnnnnnnntaatggagggttggatgaaaaagaactgtc

SEQ ID NO: 17449 - DNA, 786 bp, Diabrotica virgifera
  misc_feature (2)..(44): n is a, c, g, or t
  misc_feature (52)..(730): n is a, c, g, or t
  misc_feature (732)..(745): n is a, c, g, or t
  misc_feature (756)..(785): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnagacgagaagnnnnnnnnnnnnnnnnnnnnnnnnnnnnnng

SEQ ID NO: 17450 - DNA, 809 bp, Diabrotica virgifera
  misc_feature (231)..(248): n is a, c, g, or t
  misc_feature (793)..(793): n is a, c, g, or t
gttaaataccttggcataattttaaatcaaaagctctcttggaaagaacatattcatcatttgtcaaaaaaatgtgaaaacgcaataaatgtactaagagcttttagccacataaagtggggagccgatccaaatatatcactaatcttctatagagcactaatacgttcagtgattgactatggttgtattttatatggaaatgcaaatttaactcaattggagatattnnnnnnnnnnnnnnnnnngtgtttatgactttgtcttggatgtatacaaagcacaccaacacatattttagaaattgaagcagcagagcctcctttgcatcttagacgcaatttttgtgtgatgtttttatgtcaaaactcctagcacagaaaagatctgagaaaatacaaaaccttaattcaaaaatagatagtcccttctggctacgtaaaattcatcccaaagtaataagcagttatcagctattaatccaatttaatagcgaggcttacatccttcccttttataattgtgattataacctattagaactacaaattccttattattgtcttaatattgaaccacatgttaaccaatttaacataaatacgtttgttgagaaaacaattctgaaaagatagccggagtccgattgtatttatacagatggatccaaattcgctgagtcaactggatgcgccttttaccattcaaatgaaaatctatccaaaaaatttaaactttcaaatcaaatgtctagttatactgctgagctcatcgcaattcttttcagcttgangtatattaatatccat

SEQ ID NO: 17451 - DNA, 896 bp, Diabrotica virgifera
  misc_feature (177)..(189): n is a, c, g, or t
  misc_feature (191)..(204): n is a, c, g, or t
  misc_feature (342)..(359): n is a, c, g, or t
  misc_feature (880)..(894): n is a, c, g, or t
accaaactcctcgaatatttgtgtttaaggtgataagtaaacagtaaatttgaggctcaatttaatactattcatcaattatcgtcgctaaaaagttcctatcagatatctttgaatataatgttgatgtgaattcactctctttcccactgtgaacgaccctttatcatgtctcannnnnnnnnnnnncnnnnnnnnnnnnnnatttgtgtgacctttattctatataaaggtcacactatacagggtgtccctgaaaatagtgcgttcctttaaggtatggatatattacacaatttggaataaaggggtcctataacatttttttctgaggttaaccgnnnnnnnnnnnnnnnnnnattgttctttataaaagcgaacttttattttcataaaatttaaaaatttggcatcactgtacaagaactgttagtgatttagattattgacaccagaaaaatgtaggtcagacaggtagacctgcaaaataattataccaccccatgtttgaaaataacaaaacaagaatttgtttgtttgtttaggatgaagacagggtttaatgtaaatactaaaggctaatgctgcaaatatttttgaattgtgattgtctatgtttagatttttgtatacatagttgtcagatttcaatttgcacaccaaaatgtattttggttttttggccaaacggttgaatttagaaaggggtgttataagacttttttgctctacatggtactatccgacaagccagtgctggcgcgtgaccttgaccgaaaatacacagcgtcaaatgcagaatacgagaaggtcagccgccacctttcgcttgtcgctctataccttctacctatacccttgggaagcgcgctattttcannnnnnnnnnnnnnnta

SEQ ID NO: 17452 - DNA, 934 bp, Diabrotica virgifera
  misc_feature (212)..(235): n is a, c, g, or t
  misc_feature (848)..(870): n is a, c, g, or t
  misc_feature (896)..(896): n is a, c, g, or t
ggacaagagtcggaaaacaatgcgccagatcacgcgtcttcatctactgccaaccagcaaatggccgacactgcgtcgactcccatccaagcagcggcggcgtccagtatagcttagatgggtgacaccgtcatcaagtgctgttttgatgtttgttgtaatgcatagataaactaaatcagcaatacactaagccaggcgtctagtagtgnnnnnnnnnnnnnnnnnnnnnnnngttagataatcttcagaaagctaacattcgtgtcgatctttttattattggtgtcttattagggggataaacattttatcgtaaggctacttgaggtgaacataaataaatgatgtaagtgcgttacgttgataaataaatgtactaaatttaactataaggataatttatgtcggctttagtgtagtttttgaagtaactcaattttgaaacaagttgttttcttcggcggaaacacggcgagatcaaaaattgaatgggtgaaaggaaaaaatcattacattccagagaggattagttcatacttaatttgatacataaacactatatttaggcctattctgtaactacagatcgaatagaaatgagtcaaatcgaatagagatcagcaagtcggatcggaatttgcaggaattggtattgtgtaactcatctcgatctctactatcgcaacgttgggtagaaattgatttcgactacacaagccctgtcgagatcacatttcgacatcgtaattggtcttgactctcgtgtattggcattattattgttgttttgacgtttatttgttaaatgaattagcgattttagtctgtgttgttatttatttagnnnnnnnnnnnnnnnnnnnnnnngaccaataattatacaacatcaaggntaatagaaatcattaaacattttaagaatcgctactct

SEQ ID NO: 17453 - DNA, 883 bp, Diabrotica virgifera
  misc_feature (435)..(456): n is a, c, g, or t
aagattctggctgtttcttttggctcgcctcttaatactaatacgtgtttgtgccatttgttgtttcttcatttgttcttttattttgattttttagttccttcggatactttcttatttcaaaactataataggatttctatgcatgttgacatattatctctgtgatcgttccaatattattatgacaagatattgcgtggctttctattatgtttgttgattgtttcctctacgtattcgcgttcattctgaacgctgaagtaatattttcaccctgcagtggtgaagatatgtgtcgtcgaatttgggggatttacataacacaattaaaaatctggacctcggaggtaaactacactatgtcgacatggtgttgttttgaataagtttttttaatgcacttattttattagatggattaaacaaattggnnnnnnnnnnnnnnnnnnnnnnggtcatatggtctttcaaccgattgtgggatatatcagatttttattaacatcctaaaggtccggtttcaccaacaacaaataaatcaatgaatcgctattcgtcgaataagatttattagacgtttatatttatattttgtttcaatataattttcataatttaaagttaaactggcgaatttactatcttctaaatattcacagccagattaacttaccaatttgtttgaagagcaagtatttatttgataaatacataaaataagtctcatttgacgttagtaaaatggagaaatgtcagtttattggtcgaataactttattcatagaataaactactatttgtcgttggtgaaaccggctctattataagtgctctaaattttgtgcaaacacacgctaaacacacttacttcgaatgacat

SEQ ID NO: 17454 - DNA, 784 bp, Diabrotica virgifera
  misc_feature (2)..(15): n is a, c, g, or t
  misc_feature (20)..(583): n is a, c, g, or t
  misc_feature (590)..(627): n is a, c, g, or t
  misc_feature (644)..(644): n is a, c, g, or t
  misc_feature (647)..(660): n is a, c, g, or t
  misc_feature (663)..(685): n is a, c, g, or t
  misc_feature (693)..(715): n is a, c, g, or t
  misc_feature (745)..(776): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttgnatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggac

SEQ ID NO: 17455 - DNA, 411 bp, Diabrotica virgifera
  misc_feature (3)..(3): n is a, c, g, or t
atntctgtatgattttggtggagctcctctttaaagggccaaagtttttcattatttgacaggcatataagatagtcagacaatattcaattgttgtacatgctttttttacgttctgcaccttgagtaccatgcttcattaaataacaataatatagatgtcattttcgaagttggaccacctcagaaactataggtgttctaacaaaatagatattttaaattaatgtattggaatagaaatgccttccacttttaaacaaacctaagtgcctacaaaaaaaagtcagtacaatcatttgcaacacaggtgagatcatacattcttatattataaacattatagtatcagaagcgctcatacgtacccacacgatttaatctcctgtgatgccttcaaagaacagcaca

SEQ ID NO: 17456 - DNA, 935 bp, Diabrotica virgifera
  misc_feature (540)..(554): n is a, c, g, or t
ccgagccaatcgaagaagccaaatcagacatgtcgctagataatatagtgaagctggcagcagctgatataacagaagaggacttgaagaacgagcctcaggaagaacccatggacattgaagtgcaccatctggttcaagcaccagaacctgtgaaaattattaagactgaacctcagattgtacctgaaagaagattccccaccgctgcttctacgaaacaagtagttaaaatgcctgttacctctcgcaaggtaatagcaaacccgacttccatactaaacaaggccctgacaggtcctcaggtcataagaagggcggtaaccggatctgcagaaaaacaacaaagagtcctgaaccattcgatggcacggcccattgtaaatcccgtagtgagacaaacaaaaactttcgtcaggacaaaaccggtggcccccaaaccaaggtttaacattgccagcgatatgtcagagaagttcatccaaccggaccataatacatcgcctaaaaacgtatattccttcactagacaagtcgttnnnnnnnnnnnnnnncgaaaaattggaaacaccaccatcaggagttctcccgcgggtgtgtctgcagccaacaatcagcataaagttcaaacaacaaaatacgtcagaaccagttcgggattggtgcaaaaggtggtacagacgcaggtgagaagggagcccatgcaagttagaggccagccggagagagtagaacgaaagatacaacaaaaacccaaaacagttatcaatatgccttctttgataagtgacgacgacctccttctgacaaccaaacctgcacaaccgagaccaaaacaagcccccgttcagcccgtgcaaacgatagccgccctcgaagcacacgaacctgaagaagcacataaaatggcggtggtttcggaaccgtcgattacc

SEQ ID NO: 17457 - DNA, 812 bp, Diabrotica virgifera
  misc_feature (41)..(84): n is a, c, g, or t
  misc_feature (86)..(128): n is a, c, g, or t
  misc_feature (136)..(809): n is a, c, g, or t
attttcatctcatctttcaaataataaaatatctctctccnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngta

SEQ ID NO: 17458 - DNA, 581 bp, Diabrotica virgifera
gaattaagttgtcttttcgaacaattaacttttttgctagaaacccatggtttcctcctccacaagtggaactgcagttcttcagaatttctgtctcaacacaatttaaatcccgtctctgaagtcagtcttaacttcacgggatctgataaagtcttaggcatattctgggattcagaacgcgaccacttttcgtttaaaactcctatcttcaaattggctaatgttgttactaaacgtactattctctcctacattgctactttgtatgacccgctaggatggttatcccctgtccttgtgaacgctaagctcttgatacaggaaatatgatcccagaaattgaactgggatcaacccattgactcacccatcattatgaaaaattggcaaaacctcttatcgacattcaaaactatagaagaggtcaaggtacctcgatgcttacttttacaaaagaaagttgttgatgttcaattaattattatcaccgactcatcgtaaaatatatacagtaattgtgggtatctcaaagagacatactcagactgttctgtatcgaaagagtattatcgcttact

SEQ ID NO: 17459 - DNA, 82 bp, Diabrotica virgifera
  misc_feature (8)..(63): n is a, c, g, or t
  misc_feature (65)..(81): n is a, c, g, or t
ttttatcnnnnnnnnnnnnnnnnnnnnnnnnnnnnnnnnnnnnnnnnnnnnnnnnnnnnnnnncnnnnnnnnnnnnnnnnnc

SEQ ID NO: 17460 - DNA, 306 bp, Diabrotica virgifera
  misc_feature (56)..(97): n is a, c, g, or t
  misc_feature (128)..(149): n is a, c, g, or t
  misc_feature (242)..(278): n is a, c, g, or t
  misc_feature (280)..(300): n is a, c, g, or t
agggagagaagagtaaagaagagaaaaacccggaagaggggaagaggaaggagagnnnnnnnnnnnnnnnnnnnnnnnnnnnnnnnnnnnnnnnnnngaagatgaatgagaaatgaaatgaaatgttnnnnnnnnnnnnnnnnnnnnnngataaatgtgatggtaagaaatgataatgaattttaaagaattgttatagttgagaaattaaattgtttgatgattttttgtaatttaggtgnnnnnnnnnnnnnnnnnnnnnnnnnnnnnnnnnnnnngnnnnnnnnnnnnnnnnnnnnngtattt

SEQ ID NO: 17461 - DNA, 918 bp, Diabrotica virgifera
  misc_feature (295)..(310): n is a, c, g, or t
  misc_feature (869)..(897): n is a, c, g, or t
aatcaacgataaaatggtttgcaaaaaccgcttattaaactcgatgataaataatatatcgttggggttctactcgtaatatatttgcagttttaagaataaaatggcagatagtggccaagcaaaaacctttccccagtacattgcggcattgtccgtatgtctgggagctgtagcagctggtgctgtattgggctggacatcaaacatttcgaaagacctacagaaaggaggattaaatgaccttgtcataagcgatgaccaattaggatggattggttcctttgtgactctnnnnnnnnnnnnnnnntgttttccaatcggctacatttgcgatttaatcggaagaaaatggggatgtcttctaacactcataccatttacagttggctggcttttagtgatattttcttccagtgtcagtgtaatttacgtcggaagatttttgacaggtttagcaggaggatctttctgtgtagctgctcccatatacactgcggaaattgcacaagccagtataagaggagccctaggaagctatttccagttactcttgacagttggaattctcatagtttatgttggtggagcttggatgcatccaaaggaccttgctatactctctgccgtgataccaatcgtttttgcagtagtcttcttctttcaacctgaaacacctatctatttaatgaagaaaaatcgaccagaggaagccaaaaaggcgttgcaacgattacgtggaaacgcatacgattgcgatgcggaactaaaagaaatacaactgagctttgaacagggctcatcagaaaaatctttcatgacagttctaaaaactaaagctgccattaaggcttgcttgattacgtttnnnnnnnnnnnnnnnnnnnnnnnnnnnnntatcaacgctggtatttttta

SEQ ID NO: 17462 - DNA, 818 bp, Diabrotica virgifera
caaaacatcactagattaaaccaaagctaaaaatggcagcaaagttggccttcttctttacgttcttcctcgtagctgtatatattactgaagctgttaatgttcgcaacaaaactgaagctgcagttaaggaagccactgaaactgtagataattaatattatatttctagacagcatgtctatatcatatttcttgaaaatctcatttcattttacttttgtcttccttttctaagcgtacacttgtaaaatctttaattttacagagtagaagagacattacattattggataaataaagctaatcacatagttaaatttatgttaaaatatcataaaaggagaaaaccggaatacttcagccatatgactagagcacctaaataccatcgacttcgccttataatagaagaaaaagtggagggaaggaaacggattggtcgaaagaaactttcatggttggtgcttacgggcacggcacctgaaggacaagaataattacataacatatagccataagcaagcataaagccatgaaaacaaagacaaagtatcttcagtatgtgaaaatacttttataagtatacttcactgtggcgagctttcgacatcatctcagatgtcttcctcagggcttctgggatctcagtttcccgggtctccagacactacactatttacaactcactgcactactgtcagaagtagtttgagaccgaatttaaaacgaagaaaaacatcatagaacaaaaacaacagacgttatcgcgtcacaaatccaataaccagattgtcaaacaactgatgaacaaaagg

SEQ ID NO: 17463 - DNA, 245 bp, Diabrotica virgifera
  misc_feature (93)..(113): n is a, c, g, or t
  misc_feature (179)..(197): n is a, c, g, or t
  misc_feature (208)..(232): n is a, c, g, or t
gatattctcaacatggcatatctatataaaaataaagaataaacagctctgaaaaatgatattaatgataagaataatatttttcagagctgnnnnnnnnnnnnnnnnnnnnngatattctcaacatggcatatttttttctggtgcttattctttttataatggattaattcgtgagnnnnnnnnnnnnnnnnnnnattgattaccnnnnnnnnnnnnnnnnnnnnnnnnngaaatttttatat

SEQ ID NO: 17464 - DNA, 628 bp, Diabrotica virgifera
  misc_feature (26)..(46): n is a, c, g, or t
  misc_feature (66)..(265): n is a, c, g, or t
  misc_feature (269)..(291): n is a, c, g, or t
  misc_feature (293)..(356): n is a, c, g, or t
  misc_feature (477)..(499): n is a, c, g, or t
  misc_feature (529)..(554): n is a, c, g, or t
  misc_feature (580)..(601): n is a, c, g, or t
ttttgatccaatccttcattccagcnnnnnnnnnnnnnnnnnnnnnttatgctaccttagcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcnnnnnnnnnnnnnnnnnnnnnnncnnnnnnnnnnnnnnnnnnnnnnnnnnnnnnnnnnnnnnnnnnnnnnnnnnnnnnnnnnnnnnnnaccttaggcataacagcgtaattttattgaaaaggtcacatcgataataaagattgcgacctcgtatgttgcattaaagtttataattgacgtattatctatattattaagtctggtcgannnnnnnnnnnnnnnnnnnnnnnaatttaaaccgctgtgagccagatcgtctnnnnnnnnnnnnnnnnnnnnnnnnnncactacaaaagaaccagatatatagnnnnnnnnnnnnnnnnnnnnnnctattaaacatgaatagtaagagcgtg

SEQ ID NO: 17465 - DNA, 732 bp, Diabrotica virgifera
atgtacaactcgtactccattgaatgaattatgtagtattctttctcagaagtcaatgcaaaaaaatgtccatctagttcaaaaatgtcgccatgaaacgaaatgagctgctgaacaacgtatagtgaaaggccgcttttggataatttgtaattttatcggttgattttgtcaaatcatacaattatacgattgatatgtagcgaatttccatctacgaatctcaatttcttttcgataacatttttgctactaagtagtagtttatgaaaaaatgaaagtttaaaatttataatgattcacacgccagtgtattaacagtatttttttctttttactatgatttggacgatctataaatacctacattgctataatgatcgctttattttaatcaacatggatttgtctacataatgagactataaatttacattatgtaacatccacacgattcaaagatgattatcgaactagaaatataactatacactccgcaactgacttttttttgaataaacccaccattgctatctgaaaaacaagatatatgcacccatacattcacaactgattgattcatttaaccatttgtacaaaaaaacctatattttatagcactatcagataaatcatgatttttaacctaacataatctagaatacacattcttatactttctttacatgtctatatactcctatgtacaatgatcgacttttctcatcttgt

SEQ ID NO: 17466 - DNA, 605 bp, Diabrotica virgifera
  misc_feature (587)..(603): n is a, c, g, or t
agagttatgtcctgtatgacactatatccttatccactatcactatctcacctcccccctcatacgatttcttctatatgaaattgtgtttcattattaggaatatgccttactagattcaaatgattacaggcctatttttacgtatacattactgcccatgtggaaaactagtactcttaatacaggtgctcatagttgcctggatgaaaattaggtctgattactacaaacattagcatgcaaatgtagaatcgatttgtttttattggcttatacatccatattgacctaggaatatattatacatcgtataatatgattgatacttgatgaattgtggaaaccattttttttcttaccataaaatctaaatttctatgcgatgtgtattacgcatgagcgacacctatccttttgacaaggaacagcaattactaccttatcattccctatctatatatctagtgaaatatattaataccttgaattacagaattatttgcagtatataatgcatctttagctccattctttacattacattttatattaccttttattatttttgcatatataataattcnnnnnnnnnnnnnnnnnca

SEQ ID NO: 17467 - DNA, 811 bp, Diabrotica virgifera
  misc_feature (34)..(56): n is a, c, g, or t
  misc_feature (64)..(79): n is a, c, g, or t
  misc_feature (82)..(98): n is a, c, g, or t
  misc_feature (103)..(127): n is a, c, g, or t
  misc_feature (135)..(808): n is a, c, g, or t
tttctcttaaaataataaaatatctttctctacnnnnnnnnnnnnnnnnnnnnnnnctctaacnnnnnnnnnnnnnnnnccnnnnnnnnnnnnnnnnnctttnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtt

SEQ ID NO: 17468 - DNA, 583 bp, Diabrotica virgifera
  misc_feature (45)..(72): n is a, c, g, or t
  misc_feature (131)..(150): n is a, c, g, or t
  misc_feature (325)..(349): n is a, c, g, or t
  misc_feature (352)..(382): n is a, c, g, or t
gctaagacaacatgtgtgacgacgatgttctttttcttgtcgttnnnnnnnnnnnnnnnnnnnnnnnnnnnntatgaaaatatgattcaaaataaaggaaaaatgcatattgtgtaaaatgtgtagaagannnnnnnnnnnnnnnnnnnnctcgtcaatgaggttaataaataataaagagatgtgttaaaagcagtatggtaaaaaaaatagtataattaacatcaatcgcaggagatagaagtgagattcatactgaaatcaattctttgaacatccaaaatgaacgaggtataaattatagtattgtagaatgatatatgannnnnnnnnnnnnnnnnnnnnnnnnttnnnnnnnnnnnnnnnnnnnnnnnnnnnnnnnaatgtgtattaccatgaccaaaaataacaaaaatgacaagtatcataaattacaatcttatcaattcaccaatataaatttatgaaatatatataagatcatgaattagataaggatttataatagataaagcaaactgatgatgcgaatataaacatgaaatcagatattacgtaataacagatttgcatctataagaat

SEQ ID NO: 17469 - DNA, 951 bp, Diabrotica virgifera
  misc_feature (840)..(840): n is a, c, g, or t
  misc_feature (884)..(884): n is a, c, g, or t
  misc_feature (890)..(891): n is a, c, g, or t
tcacaattcaatcaaaaagtctcagcatctttaacttaattatgtagcacgattatcaggtaattgttgtttaacctattcagcggtgccgtatggctttgaacatgcttttaaggggtttcaaagaagaagactgatatttttagggtgagtctgataaattgagcagggactgtagtttattgcatgtattatagtatattataatgccatattagaaggtattctactttcccgcacgccgtgcgggaaagtgcaactttcggaaacgaaatgcgtgctagaaagtggctgtttaagcacggccgtagaaaaatgcattttccatgttcaatgatgcaatttttatttcgtcatcatcatttttgttcgcaacatttcctaaggtttttgcgagtcgaatgcgggaagtttcattgattcatccggctgcaataatttggtaggttttgggctttttactgcctcactgcctcgcctgttagtatgcaatggaaaaattcacgaaaagtacatttacacataaatattttgtaatattaaggcccaaacaaagaaaggttttatcattcagttaatttcaaataaattctttattgctatttaagcttctcatctgaagctgatacccaaattggctaaataagagcttaaaaacaacacatcgagttttaagagaacaattggcattcaatgaatttctatttttcatcaagcgataagcgtaagcgactttttggcaacttggcgaatttttcagaggttccatgataatgggagcgcttgcggaaataaataacaccaaacattgcattaaaatcgacttttttcctattaggnctgttattttgaagctattgagaccagacccgatttcgccgtgncctggnnagcatctggatgcgttttcaacgctcaaggagaaatctggttggccattcatcactttga

SEQ ID NO: 17470 - DNA, 1012 bp, Diabrotica virgifera
  misc_feature (211)..(265): n is a, c, g, or t
  misc_feature (282)..(994): n is a, c, g, or t
aataacccaagtgtaatcttagactcgttttatcgtaactcaaattaaatctgtaattgatgtgctagaggaatcgagttgttaagacatatatatgtatgagtatctgtatagatacacgaagaatttattttttgccccctctgcgtggcaagcggattatgaagtaataattatgtatttattattttccaattgaaaagatgtagannnnnnnnnnnnnnnnnnnnnnnnnnnnnnnnnnnnnnnnnnnnnnnnnnnnnnnggctattcggttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatccattttttttgatt

SEQ ID NO: 17471 - DNA, 152 bp, Diabrotica virgifera
  misc_feature (7)..(44): n is a, c, g, or t
  misc_feature (104)..(104): n is a, c, g, or t
  misc_feature (110)..(132): n is a, c, g, or t
taacagnnnnnnnnnnnnnnnnnnnnnnnnnnnnnnnnnnnnnntgcgacctcgatgtcggattacagttcataattgatgtagcagctatattatcaagtctngtcgannnnnnnnnnnnnnnnnnnnnnnagtttaaaccggtgtgagcc

SEQ ID NO: 17472 - DNA, 948 bp, Diabrotica virgifera
  misc_feature (887)..(887): n is a, c, g, or t
ctaggctgtaagatttaatataattgcatgtttgtccaaagactcctgatccagtaccattgtcagttttagatccatcagtgaaccatactaagtccccattaatatttgggacgttttgtcctctagatggtataattgtgttaatcttctcagtaaagattggttctggtgccatccatcatatctgagttcgtcatacagacggatgcctcaagtatagtccagtaagtagtgtttgtgtggctattcagtacataattcggcttccaagtatagtttgtcttgaatctcaggatggtcatacaggctgcggccgaaatatataatttcagcggagggagacctgtgatagcatctaatgatgccgttcctgtactattcaaggctcctgttatatttacaagcctttgtctttgtattgtggtgagataggtcgcacaaggatgcaaagcctttttctatcaaagtgctgaaccaaaagtaactgtcggtcgtatcactgatgtgtataatggcggtacgtatcgtgtcccaatatgtggagtagatattcaaaatttctttgtttaattgtgctaagatttctttttcttttgcaattctgtggattacttctatgttggtgacatattcggtccaagatatacgaagaatgtcgtatttaaatattaaatactcaaatatatctattctttgttgaattacctcaaaatcgtttcccaaaaagtgttatgttcttggtaaaaattttattaagagtcggtatttctgttttgaaaaaatacgaaccttaaatgcctaaatctgtactttgcctgaaatgagagctaaaaataagggaacatattgataatgtttgtaaaaactatttatattttgtatanttgaaatattgtaaaaattacttaatgtattatacaagttttaagtgttgatttttataat

SEQ ID NO: 17473 - DNA, 410 bp, Diabrotica virgifera
  misc_feature (319)..(338): n is a, c, g, or t
  misc_feature (383)..(406): n is a, c, g, or t
ggggaggttctgggtcctgttcttggaggatccctcatggagcattacgaattttcaaatgcctgtgcgacgttcgcagcgctcaacttcttcgtaggagcgttaactacagtgtttttaatgaacagaaaagagttgtcattaaaaggaaacttactaagtgtttttataaaaccagaaatataccaaaacggtaccatcgatattattgtggagaaagagcagcaaaagatgattgagaatattaaaactaaataggcaactagttttttaatttcgatttgttgagatgtaatttatatatataccatgtacttgnnnnnnnnnnnnnnnnnnnncctcgacctttgattaggatatgttgaaagtattaagccatgtcnnnnnnnnnnnnnnnnnnnnnnnnctgt

SEQ ID NO: 17474 - DNA, 940 bp, Diabrotica virgifera
  misc_feature (790)..(812): n is a, c, g, or t
  misc_feature (910)..(932): n is a, c, g, or t
atcgaaaatctttgccagtttaaatacatatacacctgttttaacatactttagacctagaaaataatattattagtcattacactaactcaactaactgtcaaccgattattgtctgctcgtgctcgtgcgctgttgacaagcagtgcgaccaacttaactaggtgctgcgcagaatgaaatttcccatttttttccattttccaagttttttccatttttttttcgcaaaggaaaaaatccgcacatttgtcatatccggacatgtctttcaaatccggactgtccggacgtatgttaaccctatcgataggccaagagccggtgtaacagtattttgtatttgagttttgtgtaacaactaaaattttcgatgcctgtgttgtaatctcttgggtgaaaataataacagatggtcgaatattgaatggggttcaggtttttccctcccgattcctgagctttttgttttaagttcgatattgcggttttttaactaatgatttagtgtcgcttgtgacgtcaatgggctggccttgttgacgcaagctcttgcttaatgtttttacatccttttcatatatgttattatatatgtactattttacgcactagtttttaatagcattaagcaaatatgttgttttttcagtgtacacaagaaaaacaccagatttttaaaatagttcatacactacggggaagtgtgatataatatatttactaattcagagtaaatgattgaataggtttaacattgtagttactggtaaagaaaagaactagaccnnnnnnnnnnnnnnnnnnnnnnncaattaatcaaaaagtacatacttttatagatgaaattagacttccataatgttgtaccttatcttgtatatttttttctaaataaatgattgtgacnnnnnnnnnnnnnnnnnnnnnnncccgctct

SEQ ID NO: 17475 - DNA, 922 bp, Diabrotica virgifera
  misc_feature (252)..(273): n is a, c, g, or t
  misc_feature (439)..(456): n is a, c, g, or t
  misc_feature (727)..(765): n is a, c, g, or t
aggatccgatagagaagtttatgatatagataaaattaatagacttttccgttgattacggggtgttccgataggctcgttccaagaaaccgtccattccacttttgttggagtaacctgttccttgtttaattaaacatcaagtgttatatcagatataatatactagaaacaaaattctagttttataaggaatgtatatgggtcattccatttcaaatcactgtaaaatcgcataaagtgatattttgnnnnnnnnnnnnnnnnnnnnnntttgaccttaaatatcttatttttacgtctcgcagaggctatatgccaattttcggacaggtcggagatccaaaattttttgcctgagtgatttgacatggaatgtaccatattcattataaaactagaatttaacatactaccaataagcgtaccaatttcttcnnnnnnnnnnnnnnnnnnaccatttaccattttgactgacaacattattcttattgcttattttgtatggagtccgatgttttttgtttaattttattttagattaactctttaggcgtaatttcgttcagacagatgtcaaacttccttgttttatatttttttcgtctcactaattttcaaacagttgtctagcaacttcttattttttgcgttaataatttcctaaaaagaagtattttcgtttgtaatatgcattcttaagcttctttttttcagccaggttagnnnnnnnnnnnnnnnnnnnnnnnnnnnnnnnnnnnnnnnttgtgtctccagtaagttatcgttttatcgttttcgtggtctttccactgatcgtcaaaggaaccatctcttgccatctttactactctatatcttatgccggttatatgatcgtttcattgtactctttctcgtcttaccccagcccttggtttgc

SEQ ID NO: 17476 - DNA, 853 bp, Diabrotica virgifera
  misc_feature (21)..(43): n is a, c, g, or t
  misc_feature (234)..(307): n is a, c, g, or t
  misc_feature (312)..(377): n is a, c, g, or t
  misc_feature (395)..(413): n is a, c, g, or t
  misc_feature (422)..(436): n is a, c, g, or t
  misc_feature (438)..(454): n is a, c, g, or t
  misc_feature (457)..(475): n is a, c, g, or t
  misc_feature (490)..(510): n is a, c, g, or t
  misc_feature (637)..(659): n is a, c, g, or t
  misc_feature (675)..(687): n is a, c, g, or t
  misc_feature (690)..(713): n is a, c, g, or t
  misc_feature (745)..(775): n is a, c, g, or t
  misc_feature (801)..(814): n is a, c, g, or t
  misc_feature (816)..(828): n is a, c, g, or t
atatatttggtcctttcgtannnnnnnnnnnnnnnnnnnnnnngatagaaaccaacctggctcacacgggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnaccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcnnnnnnnnnnnnnnnnnnnnnnntcccttgaggatttannnnnnnnnnnnntcnnnnnnnnnnnnnnnnnnnnnnnnggaaagaaagtagctgcagctcctcttgcagnnnnnnnnnnnnnnnnnnnnnnnnnnnnnnncccactttttgaaaagaggcctagannnnnnnnnnnnnntnnnnnnnnnnnnnctccccgtgatttatctcgatttgt

SEQ ID NO: 17477 - DNA, 202 bp, Diabrotica virgifera
  misc_feature (2)..(131): n is a, c, g, or t
  misc_feature (160)..(187): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccttggggataacagcgtaaattttannnnnnnnnnnnnnnnnnnnnnnnnnnntgcgacctcgatgtt

SEQ ID NO: 17478 - DNA, 67 bp, Diabrotica virgifera
  misc_feature (2)..(61): n is a, c, g, or t
gnnnnnnnnnnnnnnnnnnnnnnnnnnnnnnnnnnnnnnnnnnnnnnnnnnnnnnnnnnnntttttt

SEQ ID NO: 17479 - DNA, 699 bp, Diabrotica virgifera
  misc_feature (26)..(47): n is a, c, g, or t
  misc_feature (56)..(147): n is a, c, g, or t
  misc_feature (162)..(184): n is a, c, g, or t
  misc_feature (214)..(246): n is a, c, g, or t
  misc_feature (249)..(282): n is a, c, g, or t
  misc_feature (284)..(309): n is a, c, g, or t
  misc_feature (311)..(378): n is a, c, g, or t
  misc_feature (381)..(397): n is a, c, g, or t
  misc_feature (455)..(648): n is a, c, g, or t
  misc_feature (650)..(697): n is a, c, g, or t
ccccccccccaccaacaaaaaaaacnnnnnnnnnnnnnnnnnnnnnncctctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatcccctgtgcnnnnnnnnnnnnnnnnnnnnnnnggacctttttttttcttaagagagaaaccnnnnnnnnnnnnnnnnnnnnnnnnnnnnnnnnnggnnnnnnnnnnnnnnnnnnnnnnnnnnnnnnnnnngnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnncannnnnnnnnnnnnnnnntgttgggtgggtggtggtgttttttttcttttccccccccgcggcgcggcggggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnngt

SEQ ID NO: 17480 - DNA, 823 bp, Diabrotica virgifera
  misc_feature (698)..(714): n is a, c, g, or t
acaaatacctataactaattacaataatattttactatccgacaagaaagatacagatacccaacagtcaaaaattttctttttattcagtgacataataaagagaatatttacagggagtgggatgttctggtctataattcttttaattaggtgattgattaggtgtttatgcttcttgcattcaaaaaatatgtggtttgtcacttttaacctcacattcttgacaaatattcaaatctaatatgtttattttaaataaatgtgcaggataacatgcatgtccaaatctaattctactgatggtggatatctatttgcgagggagggtgaaattattataccaaggtttttccggaataatcggtcgtatcaaactgtattgtgttgttgatatgctacagtacctttcccagtgtgttttcatccaagaaactttcaaaatcttctatagcaccacatttcgaaagcctcaaggcgatttacacttttttcacgttccaggactcgacaccataaagtaaaatcaagaacacatagcagcgaagtaggcggatcctcaatgccaattttagatctgtgtatcagaaatccttctaagagcggctcgggcctgctcaattctacatctaatttcacctgactctctgtgttacaatttaattactatccaaggtgtaaacaatttgattaacttnnnnnnnnnnnnnnnnntttacatacatagacggttttatactctgttgtttacttattacgggtatttgggtttcccgtatgttcagatccagaccggctttattgcagttctcactaaactatc

SEQ ID NO: 17481 - DNA, 867 bp, Diabrotica virgifera
  misc_feature (165)..(204): n is a, c, g, or t
  misc_feature (206)..(269): n is a, c, g, or t
  misc_feature (274)..(531): n is a, c, g, or t
  misc_feature (533)..(547): n is a, c, g, or t
  misc_feature (549)..(588): n is a, c, g, or t
  misc_feature (645)..(678): n is a, c, g, or t
  misc_feature (680)..(703): n is a, c, g, or t
  misc_feature (772)..(817): n is a, c, g, or t
  misc_feature (826)..(856): n is a, c, g, or t
cccttctaagtccgcgagaaatagacaatttaggcccagaagtcctttaaatgaagtgaatatagttatatttaatattatggataataatatagtaaagaatattagaagagttatttccaaacaaagcaaatggatctatctgtaaggagaggtgtgatggannnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnngtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnngnnnnnnnnnnnnnnnnnnnnnnnnnnnnnnnnnnnnnnnncaaatatataggattgataaaggaattcggctacatttttttctcctggttattacnnnnnnnnnnnnnnnnnnnnnnnnnnnnnnnnnnannnnnnnnnnnnnnnnnnnnnnnntcgtgttattttgaccgtgtgaatgtactaaatcttttagttctttattgaagctggtatgtaggttgnnnnnnnnnnnnnnnnnnnnnnnnnnnnnnnnnnnnnnnnnnnnnngttctaagnnnnnnnnnnnnnnnnnnnnnnnnnnnnnnntagagtttatt

SEQ ID NO: 17482 - DNA, 776 bp, Diabrotica virgifera
cgaacgcgagatctaacgtgtaacgataaaatatatataaaactgaaagtatttttactacgtcattgtgagttagttacagtttcagcacatagatacttgaatactattgttttattatctctttcgcgtttttaccaaagatacaaacgaacgcaaaacactgtcgagatataatttgccctaaaagttatcaaaaactgtgtttcgaaataattttacaaatgacattgaacttgtaagtgatctgtggaaagaggtgtgtcaggaaagagtggtcagctgtttccctacttattttatgttaaagtacaaaagagataatggaataagttaaaaaaaatcgaatacaaaagaaaccgcatccattgaaaagaactaatttattttcacacatatttttttgctggttaccaggatttctctctataggattaaggaaagatttagacgagaatgatatgtacctaactagacattcccaacaatccagatatttagcagatcaattagtagtagcatggaaaaacgaacttaaaaaatcgaagccgtcttttttatgggccctttttgtagtatttaggctagaaatattttattatgccttttttaatatgcttttcagattttatagaaattgcacaaccattgatgatctcctgactagtgtcatatttcccgccaggtgccacaaccaaccaaacagaaatctacttcaacgcattttttaataatcgtaccaagtctcatcctagacacgccccgtcaataaccta

SEQ ID NO: 17483 - DNA, 624 bp, Diabrotica virgifera
  misc_feature (496)..(513): n is a, c, g, or t
cggacgcgtggatgttccgaccggctgcccctttactagcaaagtatacttaagttcagttaagggtttttcgatcatgcattgagagtgaataccttattatcacaaattcaccatatatacgtcgtacctcgcgcatcatggatcagtaaataataaccatatatttacgaacttcgaatatgtaagacctcaaaaaccgccgtttacattgaatattgaacattttaaatagcttctctgcaatgatagcgatgttcgtttctagatatatctaatcttttaagacctaaattgtaattatttattaacaacatattaagaactacatattcttcgatcataaatatttagcacttttagccgtgagcttcaaactaacgatttattaatgtattaagttttaaacaaaaaataggacctacaatattcgcaaattataacgaagttataatatatattgatatataataagttttactttctataaatttannnnnnnnnnnnnnnnnnggacaatttaacttacaatgatggtgatatctatgacaatacagaaattatgcatataggaatagagtacaggactggtattggcactccgctacattctcttctcctggc

SEQ ID NO: 17484 - DNA, 894 bp, Diabrotica virgifera
  misc_feature (417)..(436): n is a, c, g, or t
  misc_feature (723)..(748): n is a, c, g, or t
gcgagttcaacttgacggtctccttcgcaaagagtaacgattctaatacagtcggacactctctgacattcacacagtctgacgattctaacactctctgacaaatttcgattttcttgctgcttgtggttccttgcaaaggaaaaaaacatttaataaacttgaaaaacgcctttgaatgttcagcacaacgtattccaactcaactaaatttggatttgaatgaagcacgactagcatgcttttaatttgtttgcaaaaaattataaaaacagcgttttttaccgttctttagatacattttaaaaaataccggaggtaacaacaatatattttcacaaaaatcgaagcattaaaattatttgatttaccaggatttttaaaatcatgcgttaattttggcgcgcagtatatacnnnnnnnnnnnnnnnnnnnnttatttccagtatgtcattctgttattattaaataagacacatacctcattgcattatagttggacgatgttttgtatttagataaattcttgttgaaatttactgttaaaaatttatctggattattgcagtgttttgtgtacaaattacgctaatagcgtaaacctaatgtaaataatatgaagttgtagtcagtgtaagaaatcgataataacatcaaccaatccccagagatccattttaaaattatttagaatattttacacagtttaaaatgagtttgtgnnnnnnnnnnnnnnnnnnnnnnnnnnatgtagcttgtccgtttcgaacgttagcaaataatatgactattctgacttttacggcatatctgaatagttcggcagataacaatccgaaccattgccgcaagttttgaagtcacgagggtctcctccttacctgaaccccttct

SEQ ID NO: 17485 - DNA, 1019 bp, Diabrotica virgifera
  misc_feature (492)..(525): n is a, c, g, or t
  misc_feature (530)..(563): n is a, c, g, or t
  misc_feature (574)..(602): n is a, c, g, or t
  misc_feature (604)..(654): n is a, c, g, or t
  misc_feature (656)..(705): n is a, c, g, or t
  misc_feature (708)..(731): n is a, c, g, or t
  misc_feature (735)..(763): n is a, c, g, or t
  misc_feature (765)..(811): n is a, c, g, or t
  misc_feature (813)..(826): n is a, c, g, or t
  misc_feature (835)..(854): n is a, c, g, or t
  misc_feature (902)..(925): n is a, c, g, or t
  misc_feature (941)..(998): n is a, c, g, or t
gggaatttaattctctttttaataatattactccgaaacgtatgcatttttatttttgtgactatttgagtctagcgttttgcggagagttttcagaccacttgtgacgtcgtcacctatttcaacatcagttactccagtgacctttagtcactaaataatatcacacagtcatgaagttcattaacatccacacgttaaacacaacttgtagaaatcgttaaaatcagacaaaacgactgagaacgcagacgcgctggtaggtaaggacacgcgcatcgaagccgatttaacatttctcccaccaaataagagtaatttgtaaatgacactgcaatggttggatattttctatatcatatattcagaccatacggttcgtctggaaattacagaaaagatattagtagagaatactatttatgtacatataatttctgagaaacagatcatattatagaaaatggtatgatttatatatatatactattnnnnnnnnnnnnnnnnnnnnnnnnnnnnnnnnnngaagnnnnnnnnnnnnnnnnnnnnnnnnnnnnnnnnnntagaattaagnnnnnnnnnnnnnnnnnnnnnnnnnnnnnannnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnncannnnnnnnnnnnnnnnnnnnnnnngagnnnnnnnnnnnnnnnnnnnnnnnnnnnnncnnnnnnnnnnnnnnnnnnnnnnnnnnnnnnnnnnnnnnnnnnnnnnncnnnnnnnnnnnnnnataaaaagnnnnnnnnnnnnnnnnnnnngaagaccccatagaggtttataaaacaattaacaaggtttttttaggnnnnnnnnnnnnnnnnnnnnnnnnctatttaaatgggggnnnnnnnnnnnnnnnnnnnnnnnnnnnnnnnnnnnnnnnnnnnnnnnnnnnnnnnnnnctcccacccctttttgtcgtt

SEQ ID NO: 17486 - DNA, 823 bp, Diabrotica virgifera
  misc_feature (2)..(42): n is a, c, g, or t
  misc_feature (49)..(144): n is a, c, g, or t
  misc_feature (146)..(486): n is a, c, g, or t
  misc_feature (488)..(504): n is a, c, g, or t
  misc_feature (506)..(648): n is a, c, g, or t
  misc_feature (662)..(818): n is a, c, g, or t
cnnnnnnnnnnnnnnnnnnnnnnnnnnnnnnnnnnnnnnnnncgagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattttgaccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatta

SEQ ID NO: 17487 - DNA, 595 bp, Diabrotica virgifera
accaatacctgtaactacttacaacaatattttactatccggcccgaaagatacagatacccaacaggcaataatttgctttgtattcggcggcataataaagagaatatttacggggagaggtgaggctctgcgctataattgttttagttacgagagtgatgaggagtttgtgcttcttgcattctgaaaatatgtgtgtcgccactgttgccctcacattcatgacaaaaatacatatctaacatgcttatttcaaacacatgagacgaataacatgcatgcccaaatcctgagtctactgagggaggatatctagtgtgcatgcttggtggaaatcattagaccaaggctgttccgctataaccgctcgtatcaactcgcattgagatggtgaaatgctacgggacctttcccagcgagtgtccatccatcattcttactcttacttgtatcgcaccacatttcgacaagactcatacggaagatttacacattagtttcatcgttcccgcactccactccatacagtatgatcatgaacacatactatcgaagcatatggatcctcattgcgagttttatatgtgagaat

SEQ ID NO: 17488 - DNA, 707 bp, Diabrotica virgifera
  misc_feature (208)..(222): n is a, c, g, or t
  misc_feature (346)..(368): n is a, c, g, or t
  misc_feature (446)..(560): n is a, c, g, or t
  misc_feature (563)..(583): n is a, c, g, or t
agattggctgatttcactactgaagagcactggatgggcgaatggaatccagacatcagaaattctaatctgatagaaaaccccacaattaaacctgactgcttttctcttcctcgtcatgaatggtgcaacctaaatagaatacaagttggtcatggaatttgtaacaaatcgctgaatcaatgggatataaatgccagtccaggannnnnnnnnnnnnnngctgttgaacatacaattaaccacatcgtcttcaagttggcagttctttgtaagtcttcaagaaatccaccaactcactcccaagtcaagagactggcttcgaggatgtaaccttcgacattcnnnnnnnnnnnnnnnnnnnnnnngttctatgtttgtgttttcttatttatttattattgtttctatatgttactgtttcttgacttgacattgtttgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaannnnnnnnnnnnnnnnnnnnnatatgaaataatgaactttgttcaaactcacgattttagggttaatagaatgagttcgccgaaaaacattgtaaggtgcgcctttgtttatatgttcacaaattgaagacggcgtgtgtggatt

SEQ ID NO: 17489 - DNA, 258 bp, Diabrotica virgifera
  misc_feature (7)..(33): n is a, c, g, or t
  misc_feature (37)..(61): n is a, c, g, or t
  misc_feature (65)..(80): n is a, c, g, or t
  misc_feature (82)..(95): n is a, c, g, or t
  misc_feature (102)..(126): n is a, c, g, or t
  misc_feature (134)..(165): n is a, c, g, or t
  misc_feature (167)..(247): n is a, c, g, or t
tttatcnnnnnnnnnnnnnnnnnnnnnnnnnnnctcnnnnnnnnnnnnnnnnnnnnnnnnncacnnnnnnnnnnnnnnnncnnnnnnnnnnnnnncattttnnnnnnnnnnnnnnnnnnnnnnnnngtacctcnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnntaatgaagtgt

SEQ ID NO: 17490 - DNA, 922 bp, Diabrotica virgifera
  misc_feature (584)..(603): n is a, c, g, or t
  misc_feature (816)..(816): n is a, c, g, or t
  misc_feature (842)..(842): n is a, c, g, or t
gattcgcaaaaagttttcgatctgatctaaatcgagggcattttgcgaatccttttggatgactttttactagtttttcagtgaactttttgtaccattgtacaaacgaggtttttacttgttctgtatgatttaaaatataattctttattatatggtttttgatctaaagttgtaactaatcttatagactttttgaataacctagactcattgttttcgtgacgaaattttcgtattgaattccttagctttgatattgatttgatattataatatatcgtttgtatattgttatccgctactgggactgcgtcatttacataataatatgtctttattacttgttctcactttggcatatttttctttttagacgttttaacaactcgtccaatataagatcgaatatattagtaggtataggtatatagatctagcgatctcaccacatggactaataggttctgtataacaatgagatgaaaatttgtgataagctttattgctttgcattttatgattgccattttcttattgtgtaaaatgtattgattgtatgattctaatacccaaaccttacnnnnnnnnnnnnnnnnnnnngtataaaaagtaaaatatcctaccagaagaattattgagttatgtctataagttaaaaaaagtacaaaatattgttaaaaaattgtttaccattagagtctaagaatataagaagttgtttttagatattagtattttatagacttcctactcgtgttatatcagacatctcgaaacgcgacagttcgtggcgggacagatggtaacggacgngtcgtagcagcgacagttcgtagcgntgacgcttcgtggcggcgacggttcgtaactgtgcaaattcgtaacggacagttcgtagcttcaaaaatgaaattattct

SEQ ID NO: 17491 - DNA, 932 bp, Diabrotica virgifera
  misc_feature (788)..(788): n is a, c, g, or t
  misc_feature (859)..(859): n is a, c, g, or t
cggacgcgtgggcgcgcattcagtagttccgactagagcggtaccatagacttaattggtgtaatcatgtgtgttttgtcaatatgattatcctcatttggtgtttgtgtttgtttaaatttatttttggtgctactgtctttgactgcccctctacggacttgaagttcgaaaaagtgctaggtctgcgtccgtccaactccacccaagcaaagctcctttaccagttggagaaaaacactccttggaaaccgataacagctgagtgtatatccctgtgtcaatcgaacaatgactgtgctagtttcgtattatattacagtacctccaaatgttactggtatcgaaataacgtgaatattgtagatatacagaatgtcatcgacgaaaatgtgtcttggttcgtcaaaaaatgtttgaaaacaaaccttcatgtgacaagctatggatatttgatagaatacctggtgccactctaataggcaacgataccaaaaggctgcccggtgttaagtcaaggactgaatgtgaacagtattgtttaaatgagaaagaattttcctgtaggtctgccaaatttagtattacacaaacgacggaaaaacctgtaacaactaatatcactacaggcatcactggctatcgatatggccctaatacgggacaaactgactttacaggaatttgtacactgagtaatgccgacaggcaccaactgccgagctcctttagagtgtccagttatgtagatgaatattttgaaaaccaatgtgcaccagttgacatanataagaacgaattttgtgcttacgaagaatacgaaaatatgacgctggcacacgtcgacattgccttccanaaagaagataaagaagaatgccaaaagatgtgtgacgagtttcatccattcaactgtcgagctttcacaattg

SEQ ID NO: 17492 - DNA, 858 bp, Diabrotica virgifera
  misc_feature (13)..(228): n is a, c, g, or t
  misc_feature (232)..(254): n is a, c, g, or t
  misc_feature (281)..(703): n is a, c, g, or t
  misc_feature (735)..(752): n is a, c, g, or t
  misc_feature (769)..(820): n is a, c, g, or t
  misc_feature (829)..(851): n is a, c, g, or t
ccttctgcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgnnnnnnnnnnnnnnnnnnnnnnngtaattgaagtgttattcgtttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttgtccgtgctaaaggattataatcannnnnnnnnnnnnnnnnngctggaatgtcgggttnnnnnnnnnnnnnnnnnnnnnnnnnnnnnnnnnnnnnnnnnnnnnnnnnnnnctaaaaaannnnnnnnnnnnnnnnnnnnnnnttagaac

SEQ ID NO: 17493 - DNA, 764 bp, Diabrotica virgifera
  misc_feature (2)..(43): n is a, c, g, or t
  misc_feature (51)..(499): n is a, c, g, or t
  misc_feature (501)..(558): n is a, c, g, or t
  misc_feature (560)..(601): n is a, c, g, or t
  misc_feature (603)..(661): n is a, c, g, or t
  misc_feature (679)..(712): n is a, c, g, or t
  misc_feature (714)..(726): n is a, c, g, or t
cnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnncaacagggttgcatgagnnnnnnnnnnnnnnnnnnnnnnnnnnnnnnnnnncnnnnnnnnnnnnnggaagcttatatttttttaagagacgagagaccctata

SEQ ID NO: 17494 - DNA, 739 bp, Diabrotica virgifera
  misc_feature (211)..(229): n is a, c, g, or t
  misc_feature (394)..(415): n is a, c, g, or t
ctccgaaaaagttctaaattttatatgaggtatgtcaaaaaagatgaatttcgatcaagaataaagtacctctttatagttcagagtatttcaataagaaggatgaaattacatattgaaacgtggtttttggttctaggcaactttgcataatcacaattttcaatattgtgaaaaataacagtattttatttaagtactcttgagcgannnnnnnnnnnnnnnnnnncctcatataaaattgacaaaattatatgtaagatgattgtattttgggttttggaccatgcagaacattttataaggaataactgtgtttcataaaattaataataaaagagttatcataattgaaataactgaaaataatgttggctatccataattagaaaannnnnnnnnnnnnnnnnnnnnnggaaggatgaaattgcatattagaatgtagctccaaacaacttttcgatataacaattttcaatattgtggagaatagggctactttgctctttaataaaatctgcatattttttgacatacctcgtgtacgtgttaaaaacattgatgagatggatgtattttaggtttagaccatgcacaactttttataatgaacaactttttttatctatctgagaataaaagggattcccatatgatgacgacttatttgaacagactgcatatattgcaacagcgtgaatgaccgactaacgatccccaggctcatgccaatttttag

SEQ ID NO: 17495 - DNA, 847 bp, Diabrotica virgifera
  misc_feature (8)..(31): n is a, c, g, or t
  misc_feature (37)..(51): n is a, c, g, or t
  misc_feature (53)..(95): n is a, c, g, or t
  misc_feature (103)..(845): n is a, c, g, or t
ttttctcnnnnnnnnnnnnnnnnnnnnnnnntcaacnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnta

SEQ ID NO: 17496 - DNA, 899 bp, Diabrotica virgifera
  misc_feature (9)..(101): n is a, c, g, or t
  misc_feature (105)..(518): n is a, c, g, or t
  misc_feature (527)..(610): n is a, c, g, or t
  misc_feature (617)..(736): n is a, c, g, or t
  misc_feature (741)..(836): n is a, c, g, or t
  misc_feature (856)..(876): n is a, c, g, or t
  misc_feature (878)..(892): n is a, c, g, or t
agtattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattcgggnnnnnnnnnnnnnnnnnnnnnnnnnnnnnnnnnnnnnnnnnnnnnnnnnnnnnnnnnnnnnnnnnnnnnnnnnnnnnnnnnnnngcgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaattgtggtgatataagnnnnnnnnnnnnnnnnnnnnncnnnnnnnnnnnnnnngtaattt

SEQ ID NO: 17497 - DNA, 716 bp, Diabrotica virgifera
  misc_feature (37)..(110): n is a, c, g, or t
  misc_feature (114)..(146): n is a, c, g, or t
  misc_feature (161)..(183): n is a, c, g, or t
  misc_feature (199)..(227): n is a, c, g, or t
  misc_feature (246)..(327): n is a, c, g, or t
  misc_feature (329)..(367): n is a, c, g, or t
  misc_feature (369)..(384): n is a, c, g, or t
  misc_feature (415)..(446): n is a, c, g, or t
  misc_feature (561)..(588): n is a, c, g, or t
  misc_feature (607)..(625): n is a, c, g, or t
  misc_feature (627)..(642): n is a, c, g, or t
  misc_feature (644)..(661): n is a, c, g, or t
tttagcacaagtaaggaaaaattttatttaatcgacnnnnnnnnnnnnnnnnnnnnnnnnnnnnnnnnnnnnnnnnnnnnnnnnnnnnnnnnnnnnnnnnnnnnnnnnnnaagnnnnnnnnnnnnnnnnnnnnnnnnnnnnnnnnncatttaacagagctnnnnnnnnnnnnnnnnnnnnnnnaaataaacatcttacnnnnnnnnnnnnnnnnnnnnnnnnnnnnntctcctaaatatatctagnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnngnnnnnnnnnnnnnnnnccattattaattttcatatttccacacatgnnnnnnnnnnnnnnnnnnnnnnnnnnnnnnnntcctttataaatcttctagtcaaaacatacctctaaattatttacatccagccacgatgatgatattcgtcttacataactgaatatttagtaaagatatataggtgttaatacnnnnnnnnnnnnnnnnnnnnnnnnnnnnattattcaaaacatgtccnnnnnnnnnnnnnnnnnnncnnnnnnnnnnnnnnnncnnnnnnnnnnnnnnnnnncattctgaccgtgctatagtagcataatcattatgttttttcttgaaagctggaa

SEQ ID NO: 17498 - DNA, 276 bp, Diabrotica virgifera
  misc_feature (5)..(57): n is a, c, g, or t
  misc_feature (99)..(123): n is a, c, g, or t
  misc_feature (133)..(209): n is a, c, g, or t
  misc_feature (216)..(240): n is a, c, g, or t
tttcnnnnnnnnnnnnnnnnnnnnnnnnnnnnnnnnnnnnnnnnnnnnnnnnnnnnntaacggtagttaattagtatcgggagagaatattttcttttnnnnnnnnnnnnnnnnnnnnnnnnntaccttcggnnnnnnnnnnnnnnnnnnnnnnnnnnnnnnnnnnnnnnnnnnnnnnnnnnnnnnnnnnnnnnnnnnnnnnnnnnnnnatcggtnnnnnnnnnnnnnnnnnnnnnnnnntcggtatggaatggtattcgtttttcaatattatct

SEQ ID NO: 17499 - DNA, 882 bp, Diabrotica virgifera
cccacgcgtccgtacgagtgcgaaattcgagaaaaaagttgaaaagtgagcatggcatccttgatcacagtgcacctcaacaagggaggctcccccaacctcggctttaggttgcaagggggcaaggactttggtactcctctcctcatacaaaaagtaaatgtcggttctccagctgaaagagcaggactggttgccggagatgctgtgatcaaaatcaataacacagatgtctataatttaagacacaaagacgcccaagatgtcgtagttagagcgggaccatcttttgaaatttcagtccaaagaggtggttcaacgtggataccttcagttatacctactggtcccttatcggctccatctccgtatgttaacagttctggtccagttacaaggacttctttggcagctaacaaaagcgaaaatatcggatctatcggaacaggacataatttgtctgctaagccatttagcccacagctgaatggttctgtaaacggtggaccaaaattagtaaataaacaatataatacacctctaaaactatattcagaggaaagcatagcagagacactttcagcacaaactgaagttttatctacaggagccttaggtgtaaacttcaagaaaaacgaaagaaactacgactcatctaatagtgaagtcctgagagcactaaaagaagcagaaaacgaacccagctatccagatcacgtaatccgcaccgattactattcgacacaaagccacgcgatcggtggtcgaaaatccacgaccccaaatccaatcgctagcgaacagtatcgatcacttaacgaacatccagaccagttgctgtaggcagtacacaaacacaaccagaattttcaaaacctactc

SEQ ID NO: 17500 - DNA, 198 bp, Diabrotica virgifera
  misc_feature (2)..(15): n is a, c, g, or t
  misc_feature (17)..(70): n is a, c, g, or t
  misc_feature (105)..(188): n is a, c, g, or t
cnnnnnnnnnnnnnncnnnnnnnnnnnnnnnnnnnnnnnnnnnnnnnnnnnnnnnnnnnnnnnnnnnnnncataaagttttttagtatcaaattcatttatatcnnnnnnnnnnnnnnnnnnnnnnnnnnnnnnnnnnnnnnnnnnnnnnnnnnnnnnnnnnnnnnnnnnnnnnnnnnnnnnnnnnnncaattttttt

SEQ ID NO: 17501 - DNA, 828 bp, Diabrotica virgifera
  misc_feature (2)..(44): n is a, c, g, or t
  misc_feature (52)..(162): n is a, c, g, or t
  misc_feature (174)..(665): n is a, c, g, or t
  misc_feature (669)..(713): n is a, c, g, or t
  misc_feature (715)..(728): n is a, c, g, or t
  misc_feature (748)..(816): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagnnnnnnnnnnnnnnnnnnnnnnnnnnnnnnnnnnnnnnnnnnnnncnnnnnnnnnnnnnncaagcttacatttttttacnnnnnnnnnnnnnnnnnnnnnnnnnnnnnnnnnnnnnnnnnnnnnnnnnnnnnnnnnnnnnnnnnnnnntataatttattt

SEQ ID NO: 17502 - DNA, 779 bp, Diabrotica virgifera
  misc_feature (246)..(260): n is a, c, g, or t
  misc_feature (403)..(417): n is a, c, g, or t
  misc_feature (419)..(442): n is a, c, g, or t
  misc_feature (446)..(593): n is a, c, g, or t
  misc_feature (617)..(630): n is a, c, g, or t
  misc_feature (632)..(648): n is a, c, g, or t
  misc_feature (754)..(775): n is a, c, g, or t
atcagttctttttgtaacatacaaattcacaatgaagtttctcgtactttttgccttagtactctactgctctacacaagttttaggaggtccttgtgatggtgtacagtgcagtcctccaaattgtggacttggtgctcgtccagtagtgaaaccaggtgattgttgcgccacttgccaaggattcggtaacccaaaatgtgaaggtatacaatgcggtgtaccaaactgccctcctggatctannnnnnnnnnnnnnnatggtgcttgttgtccctcatgtgagccattcggtaatccactgtcacattaaggatagagattgttgtgcaacctaccaaccacttggtaactaataataaatcaaggacgtattgcaactattggaaaaaatgacctatgnnnnnnnnnnnnnnncnnnnnnnnnnnnnnnnnnnnnnnncagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaaaaaccaatttttaaaannnnnnnnnnnnnngnnnnnnnnnnnnnnnnngggccccaaaattaatttcctgggccgggtttttaaaacgggggggtgggaaaaacccggggtttccccaatttaatccctttggaaaaatcccccttttcccccnnnnnnnnnnnnnnnnnnnnnncccc

SEQ ID NO: 17503 - DNA, 594 bp, Diabrotica virgifera
  misc_feature (263)..(288): n is a, c, g, or t
aataacctcaaaatttgaatttttgtataaaataaaaaatagcctaactagagaaaaatgaaaataagttcattgaaacagagtaaaacgttgaatttaattattttgtcatttaaagaacaccacaacccataatactcatcgcacaatttagaagtgcaattataaatactattttagtagttgttaactacttttttttgcatattatgagaaggatatattgatgacacttatttgcaatgtaagattaggccaattgnnnnnnnnnnnnnnnnnnnnnnnnnntaaactaaatttatttcttcacaatagctgccaagttatacatgtttacaatatcattataaaatatttttagtgtggcatctacgaataataatgttattaaaatatgatttagatagtgatagtactgatgaagaacctcattatatcaaagtaagtaatcatttattcttatatataattacttctatattttacacactttaaaataagaatataaacttatactacatgaattttgtcaacgatacaagtattagtatgaataaccttttatatagaataagaagatcatactgagtattc

SEQ ID NO: 17504 - DNA, 220 bp, Diabrotica virgifera
caagacggccctttgatcgcttcatttctcaaatggcaattattcttgccatgaaaatatggatgatgcattatcatacatacaagatcattatacaacctacatattcctcacaacacaccatgacccccgtataaccgcatattgaaacgatgagcatccgtcgtatcgatataaagaaccatgaaacgtaaaagatccatccaaaacaacgctcgtg

SEQ ID NO: 17505 - DNA, 817 bp, Diabrotica virgifera
  misc_feature (10)..(373): n is a, c, g, or t
  misc_feature (375)..(470): n is a, c, g, or t
  misc_feature (512)..(564): n is a, c, g, or t
  misc_feature (569)..(570): n is a, c, g, or t
  misc_feature (578)..(578): n is a, c, g, or t
  misc_feature (590)..(590): n is a, c, g, or t
  misc_feature (621)..(621): n is a, c, g, or t
  misc_feature (624)..(673): n is a, c, g, or t
  misc_feature (679)..(766): n is a, c, g, or t
  misc_feature (769)..(769): n is a, c, g, or t
  misc_feature (804)..(804): n is a, c, g, or t
  misc_feature (806)..(807): n is a, c, g, or t
tgaaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcattaagttttttattggaagctggaatggagagttggnnnnnnnnnnnnnnnnnnnnnnnnnnnnnnnnnnnnnnnnnnnnnnnnnnnnngtaannaagttaanattttttttaanagacgagaaagaccctatagtggtttataanaannnnnnnnnnnnnnnnnnnnnnnnnnnnnnnnnnnnnnnnnnnnnnnnnntaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnntanattacctttaggataacagcgtaatttttattggnanngagtcaatcg

SEQ ID NO: 17506 - DNA, 951 bp, Diabrotica virgifera
ggaatcgttggctgagagtactgaggtgaagaccactatttacaaagctacagttgccaagaatggattaattgttaaggattcttatttaaacaacttggctggtcccagtggtatggtagaacccgaaaagaaccaccacaatcgtcccaacgagatcctcttgagcaactgcagcctaaactccagctctagcggctccagcagtcacagcttagagaacaagaacgcctccgagcaatgggaaaacaagcagtggttaaacagctcaggcagcagcttgaacgttactctgacaccttctgaaagtaccagtgagttgtctgtgatgagtatcgggaagaaaggcgttgctggtagaggtctgaaaccgtccgtttcgactggcgccatacctaagagcatcagcttcgacatgagcgctgataagggattggacgacgacggtagatctaaacgcggcggattcttcgggaagttgagaatgggcttcaaaaataggcgaggaaagagcctgcgaaatcaagaagagtttcgtttggacaacgacggatacgtaggtaaaagtacgacaaaattaggaaataatacagaagtatcggatgatattttagccaaatatcgaacaaaacccttcgtcgagaatgagactattaaagaaaactgtgattcgaataaatctctaaaaggaaaaagtgtgtacagaagcaatagtaatagtgaagaagttaatagttttaatgacattaagaacaaattacgtttagtattaagtaacacttgggaaattccacattaccttaagaacaaccccctttagtattaagaataaaattgaaacgatgctacgtctggaactgggcaaagcgagaagactgagagaatggtctgaagtggcgaagatatcggaggcaatacggtgcgtcaatctgttaaacgatgaacagctgt

SEQ ID NO: 17507 - DNA, 69 bp, Diabrotica virgifera
actgtcctttcgcaccgtatactctacagctgagtagctgacacatagatatgattcgtacctcatata

SEQ ID NO: 17508 - DNA, 879 bp, Diabrotica virgifera
  misc_feature (514)..(531): n is a, c, g, or t
  misc_feature (830)..(830): n is a, c, g, or t
  misc_feature (852)..(853): n is a, c, g, or t
accatagatatatcaatgatagcaggcattccaggtctggctggacttattggaacgcttgtattaccaaaattttcgaacattttgggacgaaagttaattttacaagttatggtatgttttactctattgggatcgctactgttgacttttagtagatctgtgactgtgataattgtttcaagatgcattattagtatatttttacatggtgctgttgctattgtacctatttatattacagaaatttgcgaggatcataatagggctaaatttggttgctttttaggactatttcatcaaattggtcacttttatacgtttgtagtaggacctttgtttagctataaaatgtttaatttttttatttcacttccagctattccgtttcttgcactatttatatttttcccagaaagtcctgcttatttgctttccaaaggtaagaggacaagctgtgtgaaagcattgaagaaactgagacgtaataaaaccgacaaggaaatagaggaannnnnnnnnnnnnnnnnngaaactgtcaaatccaaagaacgtactaagcaaaactccagtattttatcgttattccaaactaaagaatctcgaacaggccttatgctagcaatgctaccattaatggtgaatcatctttcaggggttgctgtaatcatgtcattcttggcaccattctttaattcagctggtactggcatctctggtcataaagtaggtgtaatggcatctattgcaaaaattgtatgttttggcattacttccagtgtagtagagagggtaggaaggaggagaatgctgtttttgtcttctctggncacaggagtaccacttttttgnnataggctgctatttctactttgaaca

SEQ ID NO: 17509 - DNA, 906 bp, Diabrotica virgifera
  misc_feature (45)..(65): n is a, c, g, or t
  misc_feature (844)..(844): n is a, c, g, or t
ggatattttgaactacacaagtacacactacgaaatgtaactgcnnnnnnnnnnnnnnnnnnnnngtaggtacctacttattaataaaaatgaagaacaactatttatcaaaaaatttgatatcaaaatttattaagaaacacagggaacgcttttgtaaggttccttgctcatttacctgcttgccgaagtccttgtttaaagactaaccaccggtgcctgcctacacgtgctaactcaaacacttgtattttttatattagcacgatccatgaataagttgtaggtaaactacaaagttgcaaaaattcggaaactaagatattcaatgcaagttttatacggtgggtcataaaaataatcccaatataataggctagatgctcgatactcatgttatacaatgtgagtttttattgggaggatggacccgcatctcaactggaaccatggctcgcttatatatcggtacgccactgtgtgtatgtatcacggacgtacctttttttccgtcacttgtgtcgcactgaaaaaagcctctgagaagcaccatacatttgctaacaatggaataaataagtgttaagaaatcggccaagaaactgttagcatgaggtttttggaatgcaaaaggaattttttgctcgtagattaccttgaaactggtaaaacaatgaagtaggattattattgtaaccttttagatcagttggatgaaaaaatccgtggaaaaaggttggtttaaaacagaaaacatccctcttcatcacaatagattctctcacacggctcaaaaatacgcgacgtacgtattgctacaaaatttactcattagtacacttgncatatatgaataacgatatttgataggattggtgcaaacattttgacacaaaggatctttta

SEQ ID NO: 17510 - DNA, 945 bp, Diabrotica virgifera
  misc_feature (662)..(680): n is a, c, g, or t
  misc_feature (805)..(805): n is a, c, g, or t
  misc_feature (902)..(919): n is a, c, g, or t
atggaaataatattggcagaaaatgaagtattagagtgtgtaaaaggcgaaacaatcacaacaggtctaagcgagaacgagatgaaaaaaattccaaaaatgcaacaataaagccaaatcaataattgttcaatgtgtttccgatgcacagttagagatattgcgggacaaacaacaggcctaccatatgtggaaaagtttagaagaaaaatatgagaaaaaggggctaccaggacgcgaatttacagggcctataccgtttgtcatgccagcgactgagttcgaatggggtttgtatgcagaatgttggttgcatgtcctataccatttcggtcatggcagcgactgggttcgagtggggtttgtatgcggaatattggttacatatcctgtactatttcggtctagaaattaactgtagtggtgcaggatttgcaaacgaaatttttgattattattgagcaaatatctgtgctgtttcagtcatgtacgtgggactgatcaaatgtttgctgggtggatttatttatcataaagtttggatatgttttggaagttgaggtggatggtatatatttggataatattggggattggaaacaaatgagtgattactaatgtgtgaatatatacagtgtgtccctgtgggttggaaccatatnnnnnnnnnnnnnnnnnnngattttacgcaaaaaagatattcttcataaaaagttctgcatggtctaaaaccgaagatgcaatcatctgatattgagttttattaatagtatatgagagatgtcaaaaaatatgaatttctgtncagagtaaagtatctttatacagagaggggctaagttatggaataaattcattttatctaaaatggacgacttgggaaaaaatcccgaaccaggtcnnnnnnnnnnnnnnnnnncgattttttggcatatgtttcatact

SEQ ID NO: 17511 - DNA, 901 bp, Diabrotica virgifera
  misc_feature (460)..(474): n is a, c, g, or t
  misc_feature (664)..(684): n is a, c, g, or t
cttcctcgcgtccggttttcactcttatttctccctctctttttacattgaggcccagcattgttctcattatttttctttcaaatttcagagggctactcctttttcttgttaatcgtcgttgtttccatcccatatgtaacaacaggtcttatataggttcatctttgttctctacttagagtcttgcttctcagcagatttctattcattccatatgttttttgcctttcaaaattctttcctctgttccctctttttcggttttccctattgttactcccaactaggtaaaggtggatacaatttcaaatttatggttttgtgttaatagatatttctgagttgttctgtcgtccttccctatcgtcatgtactttgctttgtgctggtttatctctagtcttcttctctatctaattttccaaccgcttttataagtgtcatcttcgtgttcacnnnnnnnnnnnnnnnatctgcatatgctactagttgaagttgatttctaataatgtttttgtttgcaaagtttttccttcttttgattatttccagtatcaggttaaatagtgtcgggtagatagactcaccttatttcacgtctttctttatattgatctccttagaagttgttccgtagaagttgtgtagttttttagactcnnnnnnnnnnnnnnnnnnnnnatttttctgggattccaacattctctagttcctccatgattttcgtccgatttattgtatcaaaagcgtttttgaagtctatgaatattaggcgcatttctctgttctattctctcgattttttaattatttgctccactgtatatatggattaatcatcaacctccacggtctgaatccgttctggtattcttttaatattcgttcagcgcatgac

SEQ ID NO: 17512 - DNA, 412 bp, Diabrotica virgifera
  misc_feature (172)..(197): n is a, c, g, or t
tttttgattgaagtgcaaaacagaccggctatatgggataaaagaacccgagggcatatttatagggcattaaaaggaaaagcgtgggacgtcatctttgaattatttgttcctgattttacagaaggtagccctatcgaaaagaataaatcccttaagcaatgttttctcnnnnnnnnnnnnnnnnnnnnnnnnnntttgatgtatttgaactgagcaaaacaaatactcacaattttgtttgtttatttatgttaagtagtggggtcccatcctaggtcaaaaaaggttttattgtttgttgttgaaaacaaatcgataagatatcagttaaaagggggttgcaagctaagatgtttcagtatattcaatttcattatctccttatctttcactcagagtgtcagtgagg

SEQ ID NO: 17513 - DNA, 1012 bp, Diabrotica virgifera
  misc_feature (174)..(197): n is a, c, g, or t
  misc_feature (210)..(227): n is a, c, g, or t
  misc_feature (261)..(283): n is a, c, g, or t
  misc_feature (509)..(529): n is a, c, g, or t
  misc_feature (608)..(627): n is a, c, g, or t
  misc_feature (692)..(740): n is a, c, g, or t
  misc_feature (833)..(833): n is a, c, g, or t
  misc_feature (890)..(890): n is a, c, g, or t
  misc_feature (898)..(898): n is a, c, g, or t
  misc_feature (952)..(952): n is a, c, g, or t
aataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatganatattgtatcttctattggatcactaatttctttaattggggtattattcttaattntttatatntgagaagctttttcttttcacgaaaagataagacctttaagataacttctcaanttgatgactacaatttaaccctcagctgacacagatattctgaattgccaatttatcatc

SEQ ID NO: 17514 - DNA, 600 bp, Diabrotica virgifera
gattaatctacaatggggtcgtgtaattcgtgcacaacgtaaaggtgcggaatctgcgttcaaatcccacacgaaagacagtcaaggatttaccccaactacgttatttttttatatcttgcttattatatgaaaacataccgaatcgatttttttagtatctatcacgttacaaagatctgagtaaataacgtttttattattaacgagagattgttacataataacatacggatgatgtattttcatgagtttctggtgctgatattagtgtagatagattaaatgtttgtgttaatcatctaagataaaaaaggctctctggtgtcatctctttcactcgtttgtaagaaacatcttgatgatgaagatagttgttagagtatcgcctgtacattgagatattgatacgtaagatccattttggacgtggtaaggtgtgaatattcttatattattaattgtaagttgtagcgaaggtttgtgagacaaaagtgctgactgtatttagtttattaaggatgttaattttaagttaaaaagattagatatttataaaggatgtgaagatcctatagaggtatatggaaacagtatttt

SEQ ID NO: 17515 - DNA, 699 bp, Diabrotica virgifera
  misc_feature (6)..(282): n is a, c, g, or t
  misc_feature (284)..(301): n is a, c, g, or t
cttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnngatatatttcaaaacgaataacatttaaaaagccttaaacaaaaaataatcattgcgctctaaagtacccaagctataaaacgcatgtatgggactacagatcttttctatagcgctcctgactattaattctgtgtgaccctgttttaatgatgatgtactcgtaaacatatgtcgttactcgaagataccacagataaaatgaataaccctactgtccacagctgaaacagaacacttgtcgtgcctggatttcaactaacagctacagcgtagctcgaagtatttagataggaaacgtaaaaagtattctgttgccctgtttacatcagcggtagaacagtcagttctttgtgaaaaacggctatgccaggtacaacagaacacgagagcattgc

SEQ ID NO: 17516 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17517 - DNA, 306 bp, Diabrotica virgifera
aagaattaaattattgtattatgacaacagccacataaaaaaacctcatttataaatccagagttaatgtatcactttcctctctagagaaggcatggctggactcaaaaataaataatgagaccgagggactttaaggtaattagtcaaccatgctgagaggagctgaacgtcagcgcgagcagactgagacggagctaaaataggacgctgccatagttgccgatctggggactgggattgaaggaatggatggaacaaaatgccgagtacaatcaaacgacaaatcatgtgatcgttgtaaaa

SEQ ID NO: 17518 - DNA, 267 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (202)..(266): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaagttgggtnnnnnnnnnnnnnnnnnnnnnnnnnnnnnnnngaaaggacnnnnnnnnnnnnnnnnnnnnnnnnnnnnnnnnnnnnnnnnnnnnnnnnnnnnnnnnnnnnnnnnnt

SEQ ID NO: 17519 - DNA, 743 bp, Diabrotica virgifera
  misc_feature (741)..(742): n is a, c, g, or t
gatagttcatggccctctttgccatcaagaagattatttccctatacattggagtcagaactccccaactacaacttgcaggaaacacttccattgaggcctatatagcatcagaattggcatatgatagttcatggccctctttgccatcaagaagattatttccctatacattggattatcaatcaacagaacaatgtcttttgggcgcagaatgtcctaacgaagctttcccaggttattggattctgccaataaacgatttaacttcaccaaatggtacagaatgcaattcactggctacttgtggaatagaaggtagtgttgatgaaatcgccaaatatttggatgatcaaattgaaggaatttgaagtaaatctagaactcccataaatttgatgatcaactcatactggtttgaacaaactgacaccagcttcgatgggcttcgaaaattcttggaaaacacagttgcacgtgaagcaaaagataccttcttcgtctcacaaaaacaggtcctagattttataaaaaatcccgttaaaattagcgattttaaaactgctgacgcgcccgatggagccagttgtgagccttacacctgcagacttaaaaaaggaacagaggatagaaacatggacgcgtgtgttccttgtccagacgaatacccatggattaataacgttaatgtataaataatcgtattttgaatctaaataaataaaagtttgatagatttanna

SEQ ID NO: 17520 - DNA, 984 bp, Diabrotica virgifera
  misc_feature (268)..(286): n is a, c, g, or t
  misc_feature (360)..(392): n is a, c, g, or t
  misc_feature (478)..(495): n is a, c, g, or t
  misc_feature (907)..(907): n is a, c, g, or t
  misc_feature (917)..(917): n is a, c, g, or t
cagaatcgacgcatggattcaggtccactgcgggtcaacgttcacaagcgacaaaccaagctaagaccggctccgaaacaaccctaccagacatcctactggaaccaaccttaaggatatgggtacacactataaaaatgcctgctcactaatcatcccaccccccgcctcctctcacatacaagaaatctataggtggttcagattcgttactacagttattagccgtaaatgtatctacttttaatgagaaaatgtgaacagtccnnnnnnnnnnnnnnnnnnncttaaaaggcttttcttataatttgactcgatgtgactttttataaaataaatagaagcctgtatgatacttcnnnnnnnnnnnnnnnnnnnnnnnnnnnnnnnnnatgacttttttgtatctagggtaatttaaacgaagaatgaatttaggttattaaatttggtaagcgtcgtatcgcaatgttgtgcnnnnnnnnnnnnnnnnnnaggtttctgttatgatacaactttgaccaattagcaacttgttttttattagtaagaatggtcaagaggagttatttttaattttaaagagaggtagggcttataggattcaactgagcagacggaagtcaattcggagtaattcttttttatgttttggcagaataaggtggatttcttcaagttaacgaatattctgcttatgaaactcaatgtttgtctgtatcgttattttgttacctagtattagaaaaaattgtaaatacatttagatcattttatacaataaatgttgcttgacgattgcgtatacaaataaaataataaatagatatatatgaatgttaagtcagatgtatgctgtataggagaaattgttataagaatacgagagacagtcgtatgtgataancttttttaangtcatgttgagtattatcgattgagtacacattcatagtcaagagtatcaataatcactaaaaggaa

SEQ ID NO: 17521 - DNA, 889 bp, Diabrotica virgifera
  misc_feature (398)..(419): n is a, c, g, or t
  misc_feature (770)..(771): n is a, c, g, or t
  misc_feature (840)..(840): n is a, c, g, or t
  misc_feature (846)..(846): n is a, c, g, or t
  misc_feature (849)..(850): n is a, c, g, or t
ccctatacagtggaaccccgataagtcggcccccgataacccggaactccggctaacccggactgatttttatcagacaaacatttcaacaataaaaatgtattgctgttacaaaatctcgtgaacctaattcattcatttggtgacgtcaatatacgaacgaaacaattgaatccgacattactgaaaatatcagggtgcagatgggaccctgtcgtgcaattcgcagcaaataaaatcatatttaaaattatttcccccctccctcccacatatgctgcgcaatttgtactggaagatacattttataaaagtatattgcaaataaaccagaaattattagtgcctataacttgtgaataattaaacttaaatgtaatattgtcactgtaatgggnnnnnnnnnnnnnnnnnnnnnngaatagtaacagtaggtaacctgaatatacttcttgtgttgatggcttaaaaaaggcgcacattcacagaacaagaaactaaatcaacataatactttgaaaccgtttaaatcaaacaaagatagccaaccgactagagaaagaatagctgattgtgacaactaaagtttgaactattgaaaaagccctcaatatttaaaaaatcaattataaagtcatatatcttgtgagatatattgggcaaaagagggttaagaatatagcggagtagtgattcttctctagtgcacaactaaatcccaaccatgcgaagtaacaggcagtggtacataataagtaaatgacttccgnngattccccaagcactgtggctatcgatggtgcattatgcgtctccctcacagtatatagaatttccatncagtanttnnacagtgaactatttggataaacctcaaaatgcattttct

SEQ ID NO: 17522 - DNA, 938 bp, Diabrotica virgifera
  misc_feature (858)..(858): n is a, c, g, or t
catatattttaacaccaagatttaaataaaatttcttaaaatgtcagcagataatcacagtaaatgtagaatttgtttaaatatggacaacgaattaaatatgaatccttgttttgatgtaaatgtagatcaaatttgtctggcatcagtttttacaaatatcacagggataaagatagaagactgtgaatattttcctaagaaattatgtcaatcgtgcacgacaagtataatcagctttaaaaaatttctggcagtctttcatgaaactaatgcaaggctgaaaaatcaaatatgcaagatagaagatggttttgaaatatctgatgatggtaacagcaattttggtaattttgaaatatataagaacgatggcgattgtgagatatcagagagcgaaatccgtgatgtgaaaaaatgttataatggtaatagtgataaagatgaaaaacaaaatgtggcttccaatattaaagaagaaataaagtcatctattgaagttccacatcagaaaaacaaactgctgcccaaacagcatgagccactaagtgaagaatataaaacaatactgtcttttaaatatacctgtcattgtggggactgttttttatataaacctgggtttcgtcaacatatgctatctagacatgacatattattagatgaaacagactttgatagatattccgaagaaattgaagttaaaatccctattggttttccagaatttgttgaatctaaagttatagtgaagaaaaagaaaatgcagtgtcgtatctgtaatatcagattcttaaccaaagcagatgtaaaggcacacgaagatattcacaagacgttcgtctgtgaccagtgtgnagcagcttttttgtataaaaactacctcgctgatcatttacgtgtccatttctgaagaagacgctacacatgtcatatct

SEQ ID NO: 17523 - DNA, 935 bp, Diabrotica virgifera
  misc_feature (399)..(418): n is a, c, g, or t
  misc_feature (744)..(759): n is a, c, g, or t
  misc_feature (815)..(815): n is a, c, g, or t
  misc_feature (837)..(837): n is a, c, g, or t
  misc_feature (900)..(900): n is a, c, g, or t
cctacttgtattaagtgttccaatgtaataatgaaattaatagcaaaaaggtcggaaaataatcctataggccaatttctaacatcactttcggttttcgtcttagttttcagaactaaatttaaggttatgtagctgctaagaaaataaatgtatatctttcgttttaaccttaagagaatatccgtatggatactaatattatgccaattgttcctaataataatttacttctattcacaattgagacctaactcgaaaacccccgaaaatggcgtaagattcctaaaaagtgaggatgatttaggagacactcaaatgacatatcatgtactgaaaagcaatatcatattaaaaaccgttaataccagacaaagttatattgattttaactctagnnnnnnnnnnnnnnnnnnnncagacttggaatccatgaagatatcccaaggagtaaattggaaatgcacttgtcttcccggatggcatggaaacgattgtggtatacctgaggtgatgtggagagccgtcatagcaagtaaaaagccttacaaaattaaaggaccgagaacatttgaacggagattgatatatctgttcaaagtcaataaattttcagaatatttggcagatatgagaattaatgatttaggagaagtagtagacctttttattctatatgaagacgaagagtcaaattttcttcaaaacaaattagacagcaatttttgtaaggaataccaaaannnnnnnnnnnnnnnncaagatgatggtgaaaatttatggaagaaggtgaaaaactatttaaagaacataangaatgatgatataattctttcnagtgatataaatgaactgcctaacaaagatgctctagttttcttaaaatccacgatcatcggncacagcctataaatttagatatcgatggtctgttt

SEQ ID NO: 17524 - DNA, 498 bp, Diabrotica virgifera
  misc_feature (14)..(41): n is a, c, g, or t
  misc_feature (43)..(368): n is a, c, g, or t
  misc_feature (370)..(406): n is a, c, g, or t
  misc_feature (408)..(436): n is a, c, g, or t
cctctcgcgtccgnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnntnnnnnnnnnnnnnnnnnnnnnnnnnnnnntagtattatattaattacgaagtaatttgatccagttaatacatgagctataatctaacatt

SEQ ID NO: 17525 - DNA, 868 bp, Diabrotica virgifera
  misc_feature (835)..(835): n is a, c, g, or t
gaaaaaaatcactcaaatccgacagcaggttttagaacaaaggctacggaaccgcaccacgtgatgtacagaatgggtttactcgccgtgctcagggcaaggtacaaaaaagctcgtagtaggtgtaatgatcactcgcttctcacaaccccgaggcagataatggagtgaaaataattgaccctcacggtgaaatgcttgaagaaacgtgggagacttgggctacgaagttcgcaaatgttgttgacgaaaaattggaagacacgatcaatgaagttatcaaactcttcaacatcgacaacatgggcgacagggtggaggtagttataggaaaagacacgcggcccagcagtcccacattggcgaaagccgtccaagatggagtactagcattgtcggggaaaccagtagattatggtattgtcacaacgcctcaggtccattattttgtagtttgtaaaaatactaatagagcttatggtcaacccacagaagaagggtactacagaaaactgataaacgcttttctaaggataagaggtgataagtataataaagacaattacgataatagagtgatatatgatggtgctaatggtgtaggtgctaagaaagtaaaatattttaagagaggttttgaaagatagtcttcttgtcgaaatggacaatgatgaaataattggatcagggaaactaaaccatttgtgtggcgcagaccacgtcaagtctcagcaaaaatttcctcatggtcttcccaaagagaaaatacttcgttgctgttctgtagatggcgacgccgatagaattgtctactattaccttgacgataacgaanaattccatctccctagacggtgacagaatagct

SEQ ID NO: 17526 - DNA, 144 bp, Diabrotica virgifera
  misc_feature (18)..(45): n is a, c, g, or t
  misc_feature (66)..(79): n is a, c, g, or t
  misc_feature (82)..(95): n is a, c, g, or t
  misc_feature (117)..(117): n is a, c, g, or t
taacagcgtaattttatnnnnnnnnnnnnnnnnnnnnnnnnnnnntgcggacctcgatgttggatnnnnnnnnnnnnnnggnnnnnnnnnnnnnnatattaagtctggtcgactttnaaaattttacatgatctgagtttaaac

SEQ ID NO: 17527 - DNA, 904 bp, Diabrotica virgifera
  misc_feature (226)..(262): n is a, c, g, or t
  misc_feature (264)..(279): n is a, c, g, or t
ggtgtcccatttgaaaaacgaagttataaagagatgaaaatattttcatttaatagatcatccttcaaaacccctacattccaattttcatgattctgttgcctttctcgagatatttctaatgggccagttatctgtctcaccctatatacttttggatataatgtcaggtaattagaagcaataaaaatatcagattttagataaaatggcggacaagatacannnnnnnnnnnnnnnnnnnnnnnnnnnnnnnnnnnnncnnnnnnnnnnnnnnnntctaatattaaaatacttaatatgagtataaatttgttggtcgaactgttaaagttgtctttatgtctttgttagaaaactataaaaatataaattacaaacgataaatatacaaatttcataaaactatatttgtccattcttttcacaaaagattaccgtcctctcctctacatatattaagccgagattcaacggaaggtgaagcgacggtcttcatcgttataacagttggagaaaataggtaatagaaaaagacaaaatttaaagacgggaatcgacgaaacgtggaataccgttcctccccttaatatttgtggtttacgacctgtggaataggacagacctgtcggatttatggtcagcgcgtgcggtcccgtcatttgtcacgtgtatcaacacagttcaaaggaagcgcaggtttacccctctaacccttctgacaaggctaggcgcaggtattgtcaggttcatggtaattttactatggagtggtctaacgacgttgtgttggaatttttttcattttatgagttaaccaatttactaaaattccgatcgccaacagtggtggcgtacaacagcctaaactaaactttcgaaattcgagggaacacgctccatc

SEQ ID NO: 17528 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17529 - DNA, 897 bp, Diabrotica virgifera
  misc_feature (27)..(44): n is a, c, g, or t
  misc_feature (56)..(75): n is a, c, g, or t
  misc_feature (153)..(166): n is a, c, g, or t
  misc_feature (168)..(184): n is a, c, g, or t
  misc_feature (195)..(232): n is a, c, g, or t
  misc_feature (236)..(265): n is a, c, g, or t
  misc_feature (277)..(686): n is a, c, g, or t
  misc_feature (695)..(879): n is a, c, g, or t
  misc_feature (881)..(894): n is a, c, g, or t
caggacgcgtggggtttttctcttatnnnnnnnnnnnnnnnnnnatctttctctcnnnnnnnnnnnnnnnnnnnnctctctcacatagttaattcgtatcctgagagaatcttttcttttctctaaaagaaaaatttcatttttcgtacctcnnnnnnnnnnnnnncnnnnnnnnnnnnnnnnntcatttattcnnnnnnnnnnnnnnnnnnnnnnnnnnnnnnnnnnnnnntccnnnnnnnnnnnnnnnnnnnnnnnnnnnnnntaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnaat

SEQ ID NO: 17530 - DNA, 818 bp, Diabrotica virgifera
  misc_feature (2)..(46): n is a, c, g, or t
  misc_feature (53)..(750): n is a, c, g, or t
  misc_feature (764)..(806): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgagagacccnnnnnnnnnnnnnnnnnnnnnnnnnnnnnnnnnnnnnnnnnnnatttattatata

SEQ ID NO: 17531 - DNA, 495 bp, Diabrotica virgifera
cacctctgagtataagaagaatgcagagataataatggatcgtccatcataggacgtttgagtataggtgtgagactcagtacggaaaattgaaaaaggttgatgacgaagaatcggcttaacctctataagaagatatcactctcgtatgaatagactagatgtgacaatgatcgatattttacaagataggtgatatcctcatctacagacgacgtacgaggaagttaaacttaaagcagacgaaatttgcaactaccccttatacattacgatgacgtcaccgaaatctcagtgtattatctagtgtattgttaacgtcctaatagagtttatggtctttctatgcaaatagatagaacagcacaaggttataggatattgaagatctatagagtggatgaattaaacagagaaaattaccccctcacacgggaatatgatgctgcaattgaggaagccgagaacaatagtttacaatccatgagaacaagc

SEQ ID NO: 17532 - DNA, 997 bp, Diabrotica virgifera
catccaacccttcattccagctttcaataaaacaaactaaccgaggaagcaacatattagacagagataaagccacgagtaacatttgtacagctcaagcactcttggccaacatgtctgctatgtttgctgtatatcacggtcctcaaggtcttaaagatattgctaccaagatacataatttgactttggttttgcaccatggtctccaccaagatggaaacacattatcaaacaaactcttctttgatacattgaagatctatccaaaactagacgtagaagaagtcaagacgagagcccaggaaaaaaagattaactacagatattacgatgacggtgctgttggtgtagccttagatgaaactgttacttttaatgacgtaaacgatatcttttacaccttcggatgtccacagaaagtagaaaatattgttaacagtccaatgatccgtgaaagggcaatctatagaagtgaatacaaaagaacatcacctttcctgacacacccagttttcaactcccaccattctgaaacaagaatagtgcgatatatgaagatactagagaacaaagatatttctttagtgcacagtatgatacctttgggatcttgtactatgaaacttaactcgacaacagaaatgatgccttgttctttcaaacattttactgacatacatccctttgcccctacagaacaatgccaaggctaccatcagttattcgaagaactagagcaggatctttgtacaatcacaggctatgacaagatcagttttcagcctaatagtggagctcaaggagagtatgctggtttaagggcaatacaatgttatcacgaggcaaagggagaagcacatcgtgatgtatgtctttattccatcagcgctcacggtactaacccagctagtgctcaaatggctggaatgaaagtcgaaccaatccaagtacgtgctgacggtactatagacgtaagcgatcttaaagcaaaagc

SEQ ID NO: 17533 - DNA, 990 bp, Diabrotica virgifera
  misc_feature (878)..(897): n is a, c, g, or t
  misc_feature (966)..(989): n is a, c, g, or t
atatattggtgaaactttttgtgaaattactggaaaaatggatatagaagaagttcagtcagttagtgtcaggaaacttatttcagcctttgaaaaccaaactaattctcctggagccacatactttagaccaagaactagaacattgaacaactctaccatcataaaatgatgctgatataaaaagccaagattggaacattgaaggtcataattgttgctttggaatgattggaacaaccgatgtatgaagttctcaatctcttctgacatagacaacatgtgcgtctgaacgatatatgttatagtaaatgacactcgatcctgcattcccacattgttgaaagccggacattatggagaactagttttgacaattaaacctgtagattatgatattgactcaacacctccggaccattattttggatattgttaatatactaatataatttatggtcatcccacagaataaggttactacagaaaactgataaacgcttttctaaggataagaggggttatatataataaagacaattacgataatagagagatatatgatggtgctaatgaggtatgcgctaacaaagtaatcatttgaagataggatttgagagatagtcgtcttgtcgaaatgtactatgatgaacaaagttgtatcaggaaagctacgccatttgttgtgcgggagaacacatcaagtctcagcaaatatttcctcgtgagcttcccagagagaaaaatactgccgagaaagtctcggcagaagttgaagcctaaagaattgtctactattacccttgacgataacgattaatttcatctccctagacgagcgaagaaaaggttaccttgtttgtttcttatctttatgnnnnnnnnnnnnnnnnnnnnggtttgaaattgtattaaaatggggaagggtcaaaaccgcggacggccaacgttatcgtttaattgggnnnnnnnnnnnnnnnnnnnnnnnnc

SEQ ID NO: 17534 - DNA, 737 bp, Diabrotica virgifera
  misc_feature (2)..(25): n is a, c, g, or t
  misc_feature (81)..(102): n is a, c, g, or t
gnnnnnnnnnnnnnnnnnnnnnnnnattctagccgccaccctcattgtggccataaatgccaatttatctgcctttgagcnnnnnnnnnnnnnnnnnnnnnnacacaacaaattttacaacgttattgaggacaaacttcgaattggctggtatccgactcgatcctcatgaaaagacgtgtgaataaagcggtcaaaaaaaaaacgcgagatgctcaatagatgctgacgaaagattggatagacactgagatatgagctagcaaactcttgaagatcgacaacatgaacgagagatagcatcgccaggaaaagagaacgacactggtgacaacatgcgcacactgctgaaagccggacattgtggaagagtagctttggcggagtgaccaggacattatggttattgacacaatggctcaggaccattatattgtatatcgagaaaatactaatatagcttatggtcgtaccacacaaaaaggttactacagaagaatgataagcgcttttataaggataagaggtgtaaatgataataaagacgactacgataatagagagagatatgatggtgctaatgtggaagatggtaacagagtaacaatatttatagagaggctttgaaagatagacatcttgccgagatgtaccaatgatgaactaattgaatcagggaaactaaaccatttagttgtggcgtagaaccacgtcaagacgcagcaaaaattttcctc

SEQ ID NO: 17535 - DNA, 891 bp, Diabrotica virgifera
  misc_feature (295)..(324): n is a, c, g, or t
  misc_feature (836)..(836): n is a, c, g, or t
caaagaggcctaacaggatagcagggttaaaccaaaatgtaatcaatctacttttttgttttctcgaccgaaaacttacatgtacattcttttgatgacattgtataatattacaattaatattctacagcgaagttacaaaatattgtgtattacactgttctctcgaagaacaagtacctagtgtataatctattataaactgctcactaccaaattgcttaaaactgaattcctcccgtttatggtactatctttttctaatttttaaaattctgttatgtaaaaacaactnnnnnnnnnnnnnnnnnnnnnnnnnnnnnncagaatattttccaaaatagatacatcttaagttacactgtaacatatattacactttaatctttatagttaagttagatgtgatacaaagagttattgttttaatttctgatctggatataatccagagaatgagtgcatttaaaagcggatctcaaagtgtctagaaatcggcttacactccaaaatagtgccccttttaaataagggcccacatgcggccagagttagcatcgcagtgcgactctggatagttgccaaatgttacatacatacactcttcttaagaaataatgcctcggatttggagatcgttccgcaactgattccacaagatatatgtaatattttcagaatttgtgaaagctttattgtttttataagaatgattaatgtactgttcaagactgcttacaaaacttactttttatactaatatattaaaatggaaatagagaggaacagatttatggtaattttgagaaccatatgatattagatattatttaatnagtgctctatttgtaaaagctagaaacatcctttttttatttctttgtaaaattt

SEQ ID NO: 17536 - DNA, 994 bp, Diabrotica virgifera
  misc_feature (74)..(97): n is a, c, g, or t
  misc_feature (546)..(739): n is a, c, g, or t
  misc_feature (884)..(884): n is a, c, g, or t
  misc_feature (913)..(913): n is a, c, g, or t
  misc_feature (918)..(919): n is a, c, g, or t
  misc_feature (925)..(925): n is a, c, g, or t
  misc_feature (968)..(968): n is a, c, g, or t
ggttcaatcagttcatttaattgaccaaataatcgtgtaaagaaattttaaagtcagtttctattaaaatggannnnnnnnnnnnnnnnnnnnnnnntgctggagatattcccgattctagaaatgaaggcaaaatccaagggcttagaaagtctatggaaattggatttaaaatcttgaaagagggtggtagtgctttggacgctgttgagcaggctgtaagatatatggagaacgatgaaaatttcaacgcaggatacggatcagtattaaatttagacggagaagtagaaatggacgctagtattatggtaggatctactcttagtgcaggggctgtaacagttgtgaaagatatcaaacatccaataagcttagctcgcttggtgatggaaaaaacaccccatgttctactagcagcagacggagcttctaaatttgcgaaagatcatggctttccaacaactgacccagtaagtttaattagtccagatgcgaaaaaagctctagcagaatttatacgtaagggaggagatctcactgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacactatcattaaatattgtttagctattgccataataaaggatatagaaaatggaaaatccgctcaagaagcaaccgaacaaaatatgaaaagaatgactaaacgtttgaataatactgcaggagctataaccctttccaanaatggtgaacctgggatctattttacttnctaannagatgncgtggatgtatcaaaagggcaatgaacttcatttatggaattnatgctatgagcataaaactgaaattc

SEQ ID NO: 17537 - DNA, 799 bp, Diabrotica virgifera
  misc_feature (41)..(66): n is a, c, g, or t
  misc_feature (228)..(259): n is a, c, g, or t
  misc_feature (270)..(296): n is a, c, g, or t
  misc_feature (385)..(410): n is a, c, g, or t
  misc_feature (412)..(445): n is a, c, g, or t
  misc_feature (659)..(679): n is a, c, g, or t
  misc_feature (686)..(717): n is a, c, g, or t
  misc_feature (731)..(754): n is a, c, g, or t
  misc_feature (784)..(798): n is a, c, g, or t
atctttatttattttaaactaccaaaatgatccttcagtannnnnnnnnnnnnnnnnnnnnnnnnnctagttaattcgtattgtgagagcatattttatttttatcacagacaactttattttttgtaccttcgcgtcctccggcatcattaattaatactcatatattctcttatcttcgaatttcaaagagctacacaattaacattcttattgtaaaatcaacannnnnnnnnnnnnnnnnnnnnnnnnnnnnnnnccccctttagnnnnnnnnnnnnnnnnnnnnnnnnnnncaaatttatttactaaccatatctttataattaaatacctttcacaccattaacactaaacctttttagggccgcgcttaaacataccnnnnnnnnnnnnnnnnnnnnnnnnnncnnnnnnnnnnnnnnnnnnnnnnnnnnnnnnnnnnctcttattactccttcctatctattactatctgtattctttataaatcttctattaacatctacctttaacttatttcactccagcaatgatgataatatgagtatcaacaaattctatatgcactaagaatatataggttcactaaagcaattcgccaccattcttttcacctgtctactacaaacacgtcttcttgtattcaataccaagannnnnnnnnnnnnnnnnnnnnccgagcnnnnnnnnnnnnnnnnnnnnnnnnnnnnnnnncagtccttagatannnnnnnnnnnnnnnnnnnnnnnnatggaatgataaaaaagactgtctttatgnnnnnnnnnnnnnnng

SEQ ID NO: 17538 - DNA, 952 bp, Diabrotica virgifera
  misc_feature (735)..(735): n is a, c, g, or t
  misc_feature (742)..(742): n is a, c, g, or t
  misc_feature (816)..(816): n is a, c, g, or t
  misc_feature (836)..(838): n is a, c, g, or t
ccatcttctgtctcgtttttcgaggagaaagaatgggacagttagttctgttggaagcgatggcggccaattgtatacctgtgatagttgccgacggtcacgtgatgccttttcggaatatcatcgattggaagaggttttccgtgtttataatggagagccatcttagtactttaatggatgtcttgaataacatttcggataagcgaataaggcagatgcaacagaatctgctttatatctatcagaaatatttctcgagtatgaagagtattgttctgacaacgctcgatattttacaagatagggtatatcctcatttaggcaagacgtacgatgaacttaatcttaaaccagatgaaattaacaacaaccccttattctttccgatgacttcaccgaaatctcatggattttcggctgtaattttaacgtacgatagagtagaaagtctttttatgctaatagaaagattatcaaaagttcctagtttaatgaagatcatagttgtatggaataaccagagaaaaagtccccctccactgtcagaatttccaaaaattcagaaacccgtgaacgtaattcgaacacatgcgaacaagttatccaatcgcttttatccatacaaagagatcgaaacggaggcagttttacatatagatgatgatattgttatgctaacatcggacgaagtggaattcgcttatgaagtctggagagaatttccagaccganatagtgngttttccttcaagaactcatatttgggataatgtaacccaaatgtggaaatacgaatccgagtggactaatganatctcgatggtactcactgnnngcagcttttttacataaatactggagtttcttatatacaaattatatgcctgtagaagtaaaagattgggtcgatgaacacatgaaactgtgaggatattgcgatgaatttttt

SEQ ID NO: 17539 - DNA, 540 bp, Diabrotica virgifera
  misc_feature (90)..(109): n is a, c, g, or t
  misc_feature (236)..(260): n is a, c, g, or t
  misc_feature (262)..(286): n is a, c, g, or t
  misc_feature (430)..(448): n is a, c, g, or t
aacgcaaccagggcggagagagaggagagaaaaggaacccccttaaagccgatagttttggaacttgtgggtataggagtagtgaagtgnnnnnnnnnnnnnnnnnnnngcaaagttagaagagtttaaaaggtagaaaatgatgaaggagtgtaagcgttataatatcatgtttttgttcggcaatgtgatggggttttgaatatgaataattttgtataacatatagtagatannnnnnnnnnnnnnnnnnnnnnnnngnnnnnnnnnnnnnnnnnnnnnnnnnggaaattttagtctgtgaaattagacttaaaccgttagtataaattaatttttcggtactaagtgagtattggcgaagtgtcatatttaaacatatgcgattacttatttgcatatggtattatattaattatttgtaaattgnnnnnnnnnnnnnnnnnnngaaagattgaaaattagaaatgatgattttatgtagtcattaaaaagttgtatatgaagtaagatgatataggttgaataaaggaagtcggg

SEQ ID NO: 17540 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17541 - DNA, 723 bp, Diabrotica virgifera
  misc_feature (2)..(720): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtc

SEQ ID NO: 17542 - DNA, 785 bp, Diabrotica virgifera
  misc_feature (97)..(120): n is a, c, g, or t
gtgaatgtggacaggtaggaacacccgagcatagatcatcctgcttggacctttacgaagacgccaatgcacttctaatctgcattacaacactgannnnnnnnnnnnnnnnnnnnnnnngaataacactatgatattctaaaccacttgccagacagagttttccaaaaacaactgcagctctacaatcaacaaaaaaacatacatcgaattccctaaagattctactatctcatcgttatactttggacaagtgtttcaactctcaaattaatattacgaaatactcactttagcttcacacttcaccactattggtggatagaaacgatcgataaacactatctaaattagacctccttgataagcggactggagagatgaaaagtgtgagcattgagttactctccggacaaggtgttgaaccagctgtctaatgactcaccacaaccgcctcagagaacagcttgctccactaaacaatttacaaacttaccatcgagttcgaactactgaaagtattgtagacacactaggaagacatgatagaaggccgcactcgagggagagcttgagcaactcacggtttgatggcctactgaaatcattactgtaataattattagcttaacaagagattcttaagagcagactgacatgaggcacttcactgctgcatgaatgaagtcttgacatcacttgatgtgcatacttcaaagatctctacattagatgatctatatctactatgttatagaattaacatgtagataatttgtagttag

SEQ ID NO: 17543 - DNA, 921 bp, Diabrotica virgifera
  misc_feature (493)..(515): n is a, c, g, or t
  misc_feature (535)..(571): n is a, c, g, or t
  misc_feature (626)..(670): n is a, c, g, or t
  misc_feature (713)..(737): n is a, c, g, or t
  misc_feature (804)..(821): n is a, c, g, or t
gcggtccggaaaaaaataaaatatctcttcggtaaatgtaaaggaaaaaattctctctttacaacatagttcaattcggtattcggtcgggtggatctcttctttttctcaatggaaaattctctcttttcgtaccttcggggtattcagaggaatctcactcaatctcaataaatctcaatcataatcctaactacatcttcttcgaaatcctaaaaatggtggctcaaaaaaattaaaaaatctttctaattcggtaaaaaataaaatcatctctaaaatcaaatctttctttcgtaaatcggaaaatggttatctcggttttctcaaatcaatcaattctcaaatctctcctcaaagaaaataaaatctcaaaatcttaatcctcacatctaaacaaatacatcaatcttaatcaaattaaaatacatcttctaataatctaatctaaataatctaaaataatcttctctcatggggaacgaagctcttnnnnnnnnnnnnnnnnnnnnnnnctaaaaaatcttaaatcttnnnnnnnnnnnnnnnnnnnnnnnnnnnnnnnnnnnnnatatttctaaaaataacgttaatctaacctaactttaaaaaatctaataactttnnnnnnnnnnnnnnnnnnnnnnnnnnnnnnnnnnnnnnnnnnnnnctaaaatttagtaaagaggataaatattagtatctaaaaaaannnnnnnnnnnnnnnnnnnnnnnnngggtttaataaatggaattcggaacattttttttcacccggttcataaaaaaacaggtctttttggnnnnnnnnnnnnnnnnnngccggccacgattaatttggaagagccgggggattttggacgtggtaagggagcataatcattcagttttttaatggaaggtcggaagaagggtgggagg

SEQ ID NO: 17544 - DNA, 809 bp, Diabrotica virgifera
  misc_feature (2)..(44): n is a, c, g, or t
  misc_feature (52)..(79): n is a, c, g, or t
  misc_feature (94)..(131): n is a, c, g, or t
  misc_feature (134)..(164): n is a, c, g, or t
  misc_feature (176)..(222): n is a, c, g, or t
  misc_feature (232)..(367): n is a, c, g, or t
  misc_feature (423)..(543): n is a, c, g, or t
  misc_feature (570)..(589): n is a, c, g, or t
  misc_feature (599)..(630): n is a, c, g, or t
  misc_feature (632)..(775): n is a, c, g, or t
cnnnnnnnnnnnnnnnnnnnnnnnnnnnnnnnnnnnnnnnnnnngtacctcnnnnnnnnnnnnnnnnnnnnnnnnnnnncatatatttcattcnnnnnnnnnnnnnnnnnnnnnnnnnnnnnnnnnnnnnntcnnnnnnnnnnnnnnnnnnnnnnnnnnnnnnntaacgaaacgtnnnnnnnnnnnnnnnnnnnnnnnnnnnnnnnnnnnnnnnnnnnnnnncatttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattattcatttttcatatattcattaatttttcttttttcataaattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggttattaaaaacacgtctttttggnnnnnnnnnnnnnnnnnnnncgcccactcnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagtttataaattattaatagttttttcag

SEQ ID NO: 17545 - DNA, 479 bp, Diabrotica virgifera
cgcctcccagtactaccaaattaaagttattattcttataataaactagcgtgaatattaattacccttactgaaagggcctcgtctagtattaattgttaccatcttactccgaatatttagatttatagccataggtagttgtgtagccgcgaatagtcatcattccttgactgcaatgacagaggagtttagagggcgaagacgatgagggactgtgccccgttcataccatgtttctgttatgcaatgtcatagggatatgaatttgatcaattgtatatgaacgacttgtgagacgtgcagaagagatttacttgtatccgcaatatttataatttaaatctcagaagataatgatcttataaaatacacttaacccgtggatttaaattactttttcggctgaggtggatattgcgaagagacatatttacctataagccggtcacttatttgcacttggtatgatagaaagg

SEQ ID NO: 17546 - DNA, 137 bp, Diabrotica virgifera
  misc_feature (18)..(128): n is a, c, g, or t
aatggaaaggtaattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggaggg

SEQ ID NO: 17547 - DNA, 610 bp, Diabrotica virgifera
  misc_feature (341)..(369): n is a, c, g, or t
  misc_feature (485)..(502): n is a, c, g, or t
  misc_feature (524)..(544): n is a, c, g, or t
  misc_feature (551)..(577): n is a, c, g, or t
  misc_feature (580)..(592): n is a, c, g, or t
gtcactgtatttgtcgaatatagtttaggaggtacagacgatagtgcttgtccaccactagttaaatttagaaaaggatgcaatatttgtatctgcagtccaaacggttatgattatacctgtacacagaacaaatgccatccaacgaaacggaacgacaacttggaaagactattatcagatgaggattattataaggatgatatgagcaatgccattgattcaaaatctacatctgactcagttgaaatggatgaagatgaaagtgatgaagaatatgaaatgcccgatgaaaaggaaggccgtttcagagataacaacgaacttgacagcgacgacannnnnnnnnnnnnnnnnnnnnnnnnnnnngatggtgatccagattttgatccagacagtttttacgacaactttgatagtgagcatgatgacaactatgttggaaagggaaggcctgttactcggagaagatataaaaagttccnnnnnnnnnnnnnnnnnncaatatgacattgagaactaannnnnnnnnnnnnnnnnnnnngtattannnnnnnnnnnnnnnnnnnnnnnnnnnacnnnnnnnnnnnnngaacattattaatatttc

SEQ ID NO: 17548 - DNA, 942 bp, Diabrotica virgifera
  misc_feature (8)..(730): n is a, c, g, or t
  misc_feature (737)..(774): n is a, c, g, or t
  misc_feature (794)..(807): n is a, c, g, or t
  misc_feature (810)..(832): n is a, c, g, or t
  misc_feature (840)..(862): n is a, c, g, or t
  misc_feature (892)..(923): n is a, c, g, or t
ctaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggaccaatatataaa

SEQ ID NO: 17549 - DNA, 96 bp, Diabrotica virgifera
gcttattctgctcacgtacctgctgttcaagcttggtaaagagaggactgacgaaaaagatccattaatgttaaaattgtgtatatttatttgaac

SEQ ID NO: 17550 - DNA, 74 bp, Diabrotica virgifera
  misc_feature (4)..(61): n is a, c, g, or t
gtgnnnnnnnnnnnnnnnnnnnnnnnnnnnnnnnnnnnnnnnnnnnnnnnnnnnnnnnnnnggtcccatttttt

SEQ ID NO: 17551 - DNA, 725 bp, Diabrotica virgifera
  misc_feature (226)..(246): n is a, c, g, or t
  misc_feature (325)..(344): n is a, c, g, or t
  misc_feature (409)..(457): n is a, c, g, or t
  misc_feature (597)..(617): n is a, c, g, or t
tttggtactttaggaataatttatgctataatagcaattggcttattaggttttattgtttgagctctcatatatttacagttggaatggatgttgatacccgagcttattttacctcagcaactataattattgcatgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgcc

SEQ ID NO: 17552 - DNA, 905 bp, Diabrotica virgifera
  misc_feature (184)..(221): n is a, c, g, or t
  misc_feature (224)..(249): n is a, c, g, or t
  misc_feature (271)..(317): n is a, c, g, or t
  misc_feature (343)..(360): n is a, c, g, or t
  misc_feature (366)..(384): n is a, c, g, or t
  misc_feature (415)..(472): n is a, c, g, or t
  misc_feature (524)..(571): n is a, c, g, or t
  misc_feature (576)..(681): n is a, c, g, or t
  misc_feature (716)..(745): n is a, c, g, or t
  misc_feature (765)..(785): n is a, c, g, or t
  misc_feature (794)..(886): n is a, c, g, or t
gtttctctcactctaaaatacataaaatcactctccccggtaaatggtaaaggaaaaattttcaccacacggataggttcatctcagttcgggagagaatcacttaactctcctaaaagaaaattacttctctacctcgggtatccagggattaactaaattaataattacataacttacaacnnnnnnnnnnnnnnnnnnnnnnnnnnnnnnnnnnnnnnccnnnnnnnnnnnnnnnnnnnnnnnnnnccccgtaacggaaacggttacnnnnnnnnnnnnnnnnnnnnnnnnnnnnnnnnnnnnnnnnnnnnnnncttaatctaaacaatatatcttatcnnnnnnnnnnnnnnnnnnctatcnnnnnnnnnnnnnnnnnnngggatcgagctctaaaaataaaattttcaannnnnnnnnnnnnnnnnnnnnnnnnnnnnnnnnnnnnnnnnnnnnnnnnnnnnnnnnngttaataatcttaatcttttaatcatattaataattttaatctttttcatcnnnnnnnnnnnnnnnnnnnnnnnnnnnnnnnnnnnnnnnnnnnnnnnngatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggattaaatataaaggtctcgcctggcccactgnnnnnnnnnnnnnnnnnnnnnnnnnnnnnnggggctaaggtagctaatcnnnnnnnnnnnnnnnnnnnnntgggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacccttatagagttttat

SEQ ID NO: 17553 - DNA, 810 bp, Diabrotica virgifera
  misc_feature (26)..(44): n is a, c, g, or t
  misc_feature (167)..(189): n is a, c, g, or t
  misc_feature (203)..(223): n is a, c, g, or t
  misc_feature (237)..(265): n is a, c, g, or t
  misc_feature (287)..(306): n is a, c, g, or t
  misc_feature (460)..(478): n is a, c, g, or t
  misc_feature (483)..(504): n is a, c, g, or t
  misc_feature (596)..(651): n is a, c, g, or t
  misc_feature (677)..(698): n is a, c, g, or t
  misc_feature (792)..(809): n is a, c, g, or t
cgcctcgcacccacgcgcgccgaacnnnnnnnnnnnnnnnnnnngaacgcgctaagaatccttttatttaatgctagatcaattagaatatgcgagagaatatctttatttttatccaagaaaccctcattttctcgaaccttgtgtctcagatattataaattacnnnnnnnnnnnnnnnnnnnnnnntatttaaaggcgcnnnnnnnnnnnnnnnnnnnnngtaaaacaaatatnnnnnnnnnnnnnnnnnnnnnnnnnnnnncattccgttgttaaatacatcnnnnnnnnnnnnnnnnnnnnacatatctatttcttcaccatatatttataactatctcattttcatattattaatcctaaatacttttagcgacgtgcttaataatagaactttattatatgttaattcttatatagaaattaggactaaacattttcatattttagaatatgnnnnnnnnnnnnnnnnnnnatcannnnnnnnnnnnnnnnnnnnnnctttatcaacatataaatctacatcatctaaatttagaaacgacgataacattactattaaaaaattcgtatatataacgaaaccatataannnnnnnnnnnnnnnnnnnnnnnnnnnnnnnnnnnnnnnnnnnnnnnnnnnnnnnnctgtattaatgacatggtctcgcccnnnnnnnnnnnnnnnnnnnnnnacgcgatattttgaccgagctaaggtagcataagcattagtacttttattgaaagctgtaatgacaggtggatgaaacacacaccgccgttacnnnnnnnnnnnnnnnnnng

SEQ ID NO: 17554 - DNA, 646 bp, Diabrotica virgifera
  misc_feature (410)..(428): n is a, c, g, or t
ctcctcgcgtccggcactgagccttgaggtaagccgttgttcatttttctaacgctacttcgtgcatcatttatatatacctgaaacagactgttagatattagattgataatcattgtatactttccttgaaaaatatgatgtatttatttatcaacaagtataatttacatgtttccaggtttataacaacttagaatataaagactgttattcgaaaacaaatattttacagaattaatttgatacagatatgataatcggacgtttaaacatatgttcttaatgcgacattaattctcagtcatctatcaaaacgatatttatgattgagatcattctcaaatattggtgtataagacacttgacggcttcagcttcagatatcaaaagttctattgaaatgtacnnnnnnnnnnnnnnnnnnncatcattgcttttcagcatttaccatgaatgctataaatctatatttatagagtagaatatgtagatttgagcaattttttcttgataatgatcttactgattatttaaatctgataatgaagataagatatattatacaaaaatagctatagctaggccacactacatacgtcactataaaggtattacaacaacatactgtgtctacccgtgtatt

SEQ ID NO: 17555 - DNA, 757 bp, Diabrotica virgifera
  misc_feature (284)..(320): n is a, c, g, or t
  misc_feature (484)..(504): n is a, c, g, or t
  misc_feature (506)..(519): n is a, c, g, or t
atgatcgaccatataactcaatcaaggcaaacgacaggtgtcatttgactgcgcgaggaactaaaatgtttgaagagcactacccctgtgctcacaagagaacaaagtcttattctgtaaaattttacaggttcatcagacttaataatatagctgctacaccaattattaactttaatccaacatcgaggacgcaatctttattatcaactagatctctccaatatgattactatgatatcccaatggtcatttatacattataatctaaaccacaagatatnnnnnnnnnnnnnnnnnnnnnnnnnnnnnnnnnnnnngaaagcttattatattattaacataagaatataattactccagaagcttaaaattaagattttattaatgtacattgattatataaaaattaatcattagatacttccatcttcattaatatgctataaatcattttgattgattattatttccatttttgatnnnnnnnnnnnnnnnnnnnnncnnnnnnnnnnnnnngatttagtaatgaagataatattactattcaaaaataggatatctcactcattcacacatcggtaataagggaattctacaacatttttgtctcctgtgcattaaaagacatgtcattttgcattatatatgatgccactcctgtccactgattaatttaaatggccgtatgcttttgactgggctacagcagcataaccattagcttttttattgacagctgaaatggcaggtctga

SEQ ID NO: 17556 - DNA, 708 bp, Diabrotica virgifera
  misc_feature (81)..(99): n is a, c, g, or t
tagcgtcggctgctataaaatcttactcctctttgaagaaaaccatgtagaaagagagaaaaaggagggatccggagaaannnnnnnnnnnnnnnnnnntttccttgagggtttagaagaaaaaatataaggtagatatgtggccatagacaaacataaatggtgagcgagtatacaagggcccagaaataggaacagatatggtaaaagacatgttatagagaattcctatgtccagatatgatactccactttcaaagataacttcttcatagaacctgttgatgagactcatatagtcaaaaaaatagttatcatgaaaagcgtcataaatcattgatattaaactatgttgacgccttgggcttcaaaatacaagtatattatcagttatacattatagatatagattagagattatgaaacaggcgaattcaagataaatgatataaatttatcttgaatgactagcactactaagattctgattgatttttaattaagaaacttcttacccgactatatggacttattacatgaaggtattcataaatattgcataaatatggataggtagtcacagagacatatctatcaataaaggcatccttgtaacgtgtcctgtcgccgggagcattaaaagactctcaactctgcatacatccatgcagcgaagcctgtccactgagtagctccgaatggccgaca

SEQ ID NO: 17557 - DNA, 916 bp, Diabrotica virgifera
  misc_feature (131)..(156): n is a, c, g, or t
  misc_feature (842)..(843): n is a, c, g, or t
  misc_feature (854)..(854): n is a, c, g, or t
ctagtgtaatatcggcggaaagcttttatcaatttcttttcgttacagttgttctgcatttgcttttaaaaagttgtagtttaaatttgatgtttcgaaattattgcaagcattcgtaattaatttccttnnnnnnnnnnnnnnnnnnnnnnnnnnaccagtcatatctacaaggtcatatggttatgacaaatgtagttagaaagattgtttttcggaatcaatattttttcagtggaaaataaatcagaaattaagaatggcggagagtcggctgctcataaaacgtcctagttcctcaagtcctcctccaaattgtgcaatttgtttgggttcattctcaaataaatgtgtatctgatacttgtttgcatcaattctgtttcaaatgtcttttggaatggtcaaagataaaagcagaatgtcctctttgcaagcagccatttaccagaatacttcataacattaaaaacaatggcgaatatgatgaacatgtggtggacattcttgctaatgaccttactgctgaggaaatacatgttgaggaaattagggaatataatacttttttaccaaatgctctgccacccaccagacatcactttcattttaggacaacatttactgtggatacccatggagaacatgcaatacaacaaatgcttttgacacatccccaaatttcagtcagtacaagtggatatcctgaaaggcattctgcatatcatagacgtcgacgtgagattccaagacgtgagatgccaagacgagagattccgactacaactgctttccggagatctgtttatacacgaaatttatgggccattgcgcctccagatnngtgatggaatntcatggcgtgtactccagagtatttcaggcaagcaccattaaactcgcatagactggtaccc

SEQ ID NO: 17558 - DNA, 238 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(117): n is a, c, g, or t
  misc_feature (155)..(155): n is a, c, g, or t
  misc_feature (166)..(193): n is a, c, g, or t
  misc_feature (201)..(235): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttannattttacatgatctgagtttaaaccggtgtgagccagngtggtttctannnnnnnnnnnnnnnnnnnnnnnnnnnngaaaggannnnnnnnnnnnnnnnnnnnnnnnnnnnnnnnnnnatt

SEQ ID NO: 17559 - DNA, 803 bp, Diabrotica virgifera
  misc_feature (15)..(15): n is a, c, g, or t
  misc_feature (105)..(128): n is a, c, g, or t
  misc_feature (643)..(673): n is a, c, g, or t
cgattcatatacacnagcgggaaaaacaatttagattgtaaaaatcgaacaagtaatattcaaagtgtaccttttaaagtccatgccgactgtgacgctaaagtnnnnnnnnnnnnnnnnnnnnnnnncaaagctgatgaaaacgaacaattaacctcttcgtttagaggatatcctctaaaaggaaaacacgtaaacttacctgatggatactttggacttgttttacatgaaagtattcggcccgagactgagaaatgcgatagaaaattatatgttactaatatgttttcacagctgacacattggaattgggataaacagccaagcaagaacgataccatagtccaagctctagattggattgacatagcggaagcacttcacagtcccatactagaagaataacactgaattttccaaaaattccttttcttccatcatagatcaaaagaaaatgtgccttttactacagatacttacacaacaagttaccaacacaaaaataaggagttagtgtattatatacatattttttaattattcaataattgttaaacactctgcaacttgttataagtctggattttttgaattttgtatttagatgtaaaaaatattaacttttatagcgaaatcatgnnnnnnnnnnnnnnnnnnnnnnnnnnnnnnnatatctaattatttagtttattaattaaaataataaggcccaaaattggcttgaagtaagtccttatttaaaaatttgttgtgtaaaaatgtagtacctatctatttcatgtaaaaattgtttgtttaat

SEQ ID NO: 17560 - DNA, 996 bp, Diabrotica virgifera
  misc_feature (84)..(107): n is a, c, g, or t
  misc_feature (164)..(179): n is a, c, g, or t
  misc_feature (181)..(196): n is a, c, g, or t
  misc_feature (199)..(281): n is a, c, g, or t
  misc_feature (290)..(481): n is a, c, g, or t
  misc_feature (500)..(704): n is a, c, g, or t
  misc_feature (713)..(744): n is a, c, g, or t
  misc_feature (746)..(930): n is a, c, g, or t
  misc_feature (934)..(935): n is a, c, g, or t
  misc_feature (940)..(988): n is a, c, g, or t
atttatctttaaaataatcaaaatatctttctctacgtaaaaagtagatagtaaaaattcttcatctctcaatcgatcagttcnnnnnnnnnnnnnnnnnnnnnnnnatctctctcatctctctctctcaaatagaaataatttaatcttctcccgtacctccnnnnnnnnnnnnnnnncnnnnnnnnnnnnnnnntcnnnnnnnnnnnnnnnnnnnnnnnnnnnnnnnnnnnnnnnnnnnnnnnnnnnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattatttcatttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattnnattannnnnnnnnnnnnnnnnnnnnnnnnnnnnnnnnnnnnnnnnnnnnnnnncatattat

SEQ ID NO: 17561 - DNA, 610 bp, Diabrotica virgifera
  misc_feature (2)..(16): n is a, c, g, or t
  misc_feature (18)..(191): n is a, c, g, or t
  misc_feature (202)..(307): n is a, c, g, or t
  misc_feature (309)..(405): n is a, c, g, or t
  misc_feature (412)..(453): n is a, c, g, or t
annnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattannnnnnnnnnnnnnnnnnnnnnnnnnnnnnnnnnnnnnnnnncatagtaaagatgagaatattagtattagaatactgtatatttagtagaaatatataggtgtaaaagaggaattcgtcaacatattttatcgcctgtttatgaataacatgtgctattgtattaaagataatgtctcgaatgcacattgattaattt

SEQ ID NO: 17562 - DNA, 548 bp, Diabrotica virgifera
  misc_feature (292)..(310): n is a, c, g, or t
  misc_feature (320)..(337): n is a, c, g, or t
  misc_feature (422)..(443): n is a, c, g, or t
ttgccgaattttcttattaaatcaagaaattctttatcatttgccccgcctgtttcacaaaaacattcctcatttgtattatatattatctccctcctgcccactgatcaaattgaatgacctcgtcattgtaacctaactatgctaaattattctttactggcgtcatggtactctgtaaatgaaccatcgtatgctaacaaaaactgtctttatttcttttatcaacaaatttattttcaattaaacaaccttaaattatatcaatcaaccataacacccaatacacttnnnnnnnnnnnnnnnnnnncattttttcnnnnnnnnnnnnnnnnnncaaaaacttatctaattgcctaagattgaactaaatattaacatatctctatattattactctcatataatgattctatgatccnnnnnnnnnnnnnnnnnnnnnncctgaccttacggttaccatcgtatttttattgtgtagatccagtacgaatatatagactgcatcctcgaagtcggattcatctttatcatcggtgtatgcagca

SEQ ID NO: 17563 - DNA, 299 bp, Diabrotica virgifera; identical to SEQ ID NO: 12808
  misc_feature (5)..(100): n is a, c, g, or t
  misc_feature (107)..(144): n is a, c, g, or t
  misc_feature (164)..(177): n is a, c, g, or t
  misc_feature (180)..(202): n is a, c, g, or t
  misc_feature (210)..(232): n is a, c, g, or t
  misc_feature (262)..(293): n is a, c, g, or t

SEQ ID NO: 17564 - DNA, 874 bp, Diabrotica virgifera
  misc_feature (11)..(28): n is a, c, g, or t
  misc_feature (47)..(64): n is a, c, g, or t
  misc_feature (140)..(152): n is a, c, g, or t
  misc_feature (155)..(177): n is a, c, g, or t
  misc_feature (183)..(217): n is a, c, g, or t
  misc_feature (222)..(246): n is a, c, g, or t
  misc_feature (267)..(670): n is a, c, g, or t
  misc_feature (709)..(721): n is a, c, g, or t
  misc_feature (724)..(761): n is a, c, g, or t
  misc_feature (768)..(866): n is a, c, g, or t
tttatcttctnnnnnnnnnnnnnnnnnntcttcttccggtaaatggnnnnnnnnnnnnnnnnnntacacgatagttaattcagtatccgcgagtgaatacttccctttctaaaagaaaaatttacttttcgtacctcggnnnnnnnnnnnnnacnnnnnnnnnnnnnnnnnnnnnnnactacnnnnnnnnnnnnnnnnnnnnnnnnnnnnnnnnnnncaccnnnnnnnnnnnnnnnnnnnnnnnnnccccggtaacgaaacgttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcgcctggcccactggattaatttggaagggccggnnnnnnnnnnnnnggnnnnnnnnnnnnnnnnnnnnnnnnnnnnnnnnnnnnnngggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagg

SEQ ID NO: 17565 - DNA, 904 bp, Diabrotica virgifera
  misc_feature (116)..(134): n is a, c, g, or t
  misc_feature (139)..(164): n is a, c, g, or t
  misc_feature (190)..(208): n is a, c, g, or t
  misc_feature (419)..(444): n is a, c, g, or t
  misc_feature (502)..(516): n is a, c, g, or t
  misc_feature (782)..(782): n is a, c, g, or t
ctcgatctccggtcgaacgcactaccacggagctaaactccctttgctttgacagcttacaagatttctcatacatactgacaaatttaatagaccaagtgaggtataaaaatacnnnnnnnnnnnnnnnnnnnatacnnnnnnnnnnnnnnnnnnnnnnnnnncccgaggaagacaaataaaaagcacnnnnnnnnnnnnnnnnnnncatttactaaaaacactaatatattcttttaatgacttatttgcgctgatacagatactatctttaaagattagcaacgaactacatactgtctgtctacgcatgcgccagggaagtataaaatttcaccctcaatcgtaaagaagtataacctcaaaaatgattttattaacgtttcgacgtctacatcggatgtcgttgtcaaaatacnnnnnnnnnnnnnnnnnnnnnnnnnngttgttgcttagtaaaaaattcttctaaaaatttaatttaatctgactcatttatatnnnnnnnnnnnnnnnatattatacagactttaaaatgatatttccaatatttatgagttgcgttcctggaactctactaaaagatagttcattcgattacatgaaatcagcccaactcaagaatatccgtcacaaaataatcatttttttagttaaattgtggcttgtttctcatttagaatagttgattacaaaaatgccacaaggaaatagcttcagaacaactttgagatatgttgcctatccagagggatacgtcattaattatttatttgcattanattcctccaagaataaattgtatacagagtaagttttattatatggaacgcatcaattatctcgggaacagcttgcacgatttttataggtttcagtgagtaaggagccgtccattaatcac

SEQ ID NO: 17566 - DNA, 200 bp, Diabrotica virgifera
  misc_feature (7)..(44): n is a, c, g, or t
  misc_feature (66)..(66): n is a, c, g, or t
  misc_feature (111)..(132): n is a, c, g, or t
  misc_feature (134)..(134): n is a, c, g, or t
  misc_feature (174)..(192): n is a, c, g, or t
taacagnnnnnnnnnnnnnnnnnnnnnnnnnnnnnnnnnnnnnntgggacctcgatgttggattanagtttataattggtgtagcagctatatatattaagtctggtcgannnnnnnnnnnnnnnnnnnnnnangttaaaccgtgtgaagccaggttgttttctatctttattnnnnnnnnnnnnnnnnnnngaaaggac

SEQ ID NO: 17567 - DNA, 95 bp, Diabrotica virgifera
  misc_feature (42)..(62): n is a, c, g, or t
ttggggtttaaatgttttattcgaagcaaaaattacctacgnnnnnnnnnnnnnnnnnnnnngagacggagtacaataagtatcatttaaatatt

SEQ ID NO: 17568 - DNA, 1044 bp, Diabrotica virgifera
  misc_feature (21)..(39): n is a, c, g, or t
  misc_feature (496)..(517): n is a, c, g, or t
  misc_feature (536)..(555): n is a, c, g, or t
  misc_feature (557)..(587): n is a, c, g, or t
  misc_feature (597)..(681): n is a, c, g, or t
  misc_feature (704)..(718): n is a, c, g, or t
  misc_feature (720)..(800): n is a, c, g, or t
  misc_feature (852)..(852): n is a, c, g, or t
  misc_feature (857)..(857): n is a, c, g, or t
  misc_feature (905)..(924): n is a, c, g, or t
  misc_feature (938)..(938): n is a, c, g, or t
  misc_feature (968)..(987): n is a, c, g, or t
  misc_feature (994)..(994): n is a, c, g, or t
  misc_feature (1008)..(1011): n is a, c, g, or t
  misc_feature (1019)..(1019): n is a, c, g, or t
  misc_feature (1030)..(1030): n is a, c, g, or t
gtccatttcacggcggtccgnnnnnnnnnnnnnnnnnnnctctctctaggtaaatggtaaaagaaaaaattcttctctctcaatggataggttaaattcggtattcggggtggtggatctccctcacttcctcaaatggaaaaatcttacactctttcggtacctccgtcggtaaccatgggtatctcactcaattcgatcaaatctatcataacctcactcacttttcgaaatcttcaaaggaggctcaaaaaaatctcaaaatctttctaatcggtaaatataaaataactttaaaatcaaatctttttcggtaacggaaatggttaactcggttctttaaaataataattctcaaattccttctaaagaaaataaaatctcagatatttaattctaactaaacatataatcaatcttaatcatattaaaataatctttctaataattaatctaaataatctaaaataatttttctatgaggatggatgctctnnnnnnnnnnnnnnnnnnnnnnctaaaatattctaaatttnnnnnnnnnnnnnnnnnnnngnnnnnnnnnnnnnnnnnnnnnnnnnnnnnnncggttaatcnnnnnnnnnnnnnnnnnnnnnnnnnnnnnnnnnnnnnnnnnnnnnnnnnnnnnnnnnnnnnnnnnnnnnnnnnnnnnnnnnnnnngtaatggatggataataattagnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnntggtattaaaatataaaggtctcggcctggcccactggattaaatttggaantgggncggcgggtattttttggaccggtggctaaaggtagcattaatcatttnnnnnnnnnnnnnnnnnnnnggtgggaatggaanggggttgggatggaaaaaaaaactgagtcnnnnnnnnnnnnnnnnnnnnaattttnaatttttaagttannnnaagcttanatttttttaanaagacgagaaagac

SEQ ID NO: 17569 - DNA, 292 bp, Diabrotica virgifera
ccccccccccgcccccgcgcaagagagtcctattgggaaatgtttatccgcgtgaccgaagtgactctatctcacaagagcggtcttggccaccatggtcagtaagaggtagattctgcaagaacttgaaagtattttcctgcaggatgtgtctaatggatcatgactccctcatgaagacccaccttaccatcgaattcatcgagaacctcaaacgtcaacaaattccggacttatgcgtattctattcaagttgtctgccgagccagcttagaagaactcggcaccggcg

SEQ ID NO: 17570 - DNA, 895 bp, Diabrotica virgifera
  misc_feature (46)..(66): n is a, c, g, or t
  misc_feature (713)..(713): n is a, c, g, or t
  misc_feature (730)..(751): n is a, c, g, or t
  misc_feature (799)..(799): n is a, c, g, or t
  misc_feature (814)..(815): n is a, c, g, or t
  misc_feature (830)..(848): n is a, c, g, or t
  misc_feature (853)..(853): n is a, c, g, or t
gacattgcgataggtttcttatttttaatttcaggaaaagaaaccnnnnnnnnnnnnnnnnnnnnngtcgaaactcacagtatgtcttccttaaacgatagcaacgacgtctactcctcaaactattctagcagatcaggacttcatggtaaagtaagccccttttcttcgccgtatttgaattatgacccaggatatctaccacaagcgcaaccagaatttatattcttggatggagccagtaaacaaagaggcagatttgaacttgcttttggacaaattggtggatcatgcatgataggagcagctttaggaggtgcctcagggttttataatgggttaaaagccactacattggcaggtcagactggaaaacttagacgaacacagttgataaattacattatgaagaagggtagtgctactgcaaatacatttggatctgttgctgtgatatattctgcatttggtgtaatactttcttgggccagaggaggaactgatgatgatcttaatacaattgtagctgccacagcaactggatgtttatataaatcgacagctggacttagaaaatgtggtttgggtggagctattggattaggagtatcaacagcatatgccctctgggtcaatagggataagttatcagaattacggcaatttaatccagcgcaaaggtagagcggtgatatagtgaaatggataacatncgtcttgaagttcctgnnnnnnnnnnnnnnnnnnnnnncatgtacaaattttaaaacgagccccattgtaaatattcgcccgaatncaatgtcctctctannaaattgtaaaaatcnnnnnnnnnnnnnnnnnnngattnagtactgattcacattttgatattaatagcactaaggggatt

SEQ ID NO: 17571 - DNA, 629 bp, Diabrotica virgifera
  misc_feature (72)..(91): n is a, c, g, or t
  misc_feature (144)..(165): n is a, c, g, or t
  misc_feature (224)..(257): n is a, c, g, or t
  misc_feature (259)..(288): n is a, c, g, or t
  misc_feature (291)..(320): n is a, c, g, or t
  misc_feature (332)..(412): n is a, c, g, or t
  misc_feature (447)..(502): n is a, c, g, or t
  misc_feature (523)..(544): n is a, c, g, or t
  misc_feature (593)..(617): n is a, c, g, or t
ataaatctatcatcacttaactaactctcgaatctctcaaaagagctcaaaaaatctcaaaatcttctatcnnnnnnnnnnnnnnnnnnnnctctcttctaacgaaacggttaactcgtttttaaatatcattctaatttctcnnnnnnnnnnnnnnnnnnnnnnctaatctaacaatatatcttatcaattaaatatctttataatatctaatatctaaatannnnnnnnnnnnnnnnnnnnnnnnnnnnnnnnnncnnnnnnnnnnnnnnnnnnnnnnnnnnnnnnggnnnnnnnnnnnnnnnnnnnnnnnnnnnnnnggttaataatcnnnnnnnnnnnnnnnnnnnnnnnnnnnnnnnnnnnnnnnnnnnnnnnnnnnnnnnnnnnnnnnnnnnnnnnnnnnnnnnnngagataataattagtattaaaaaattcggtataannnnnnnnnnnnnnnnnnnnnnnnnnnnnnnnnnnnnnnnnnnnnnnnnnnnnnnnaataaaaacaggtcttttggnnnnnnnnnnnnnnnnnnnnnngccactggataattggaaggccggggtattttgaccgtggtaaggtagnnnnnnnnnnnnnnnnnnnnnnnnntggaatggaggg

SEQ ID NO: 17572 - DNA, 895 bp, Diabrotica virgifera
  misc_feature (9)..(29): n is a, c, g, or t
  misc_feature (145)..(158): n is a, c, g, or t
  misc_feature (160)..(172): n is a, c, g, or t
  misc_feature (189)..(227): n is a, c, g, or t
  misc_feature (230)..(260): n is a, c, g, or t
  misc_feature (272)..(687): n is a, c, g, or t
  misc_feature (696)..(834): n is a, c, g, or t
  misc_feature (838)..(857): n is a, c, g, or t
  misc_feature (870)..(870): n is a, c, g, or t
  misc_feature (886)..(886): n is a, c, g, or t
tttttatcnnnnnnnnnnnnnnnnnnnnnttttctccgtaaatgtaaagaaaaattctctcatctctcaacgatagttaattctgtattcgtgagagaaatctttctctctctttctaaaagaaaaatttctttttcgtacctcnnnnnnnnnnnnnncnnnnnnnnnnnnncatcatcatttcattcnnnnnnnnnnnnnnnnnnnnnnnnnnnnnnnnnnnnnnntcnnnnnnnnnnnnnnnnnnnnnnnnnnnnnnntaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttnnnnnnnnnnnnnnnnnnnnaagacgagagacncttatagagtttatanattatttaa

SEQ ID NO: 17573 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (151)..(151): n is a, c, g, or t
  misc_feature (163)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagnccaggttggttnnnnnnnnnnnnnnnnnnnnnnnnnnnnnnnngaaagg

SEQ ID NO: 17574 - DNA, 813 bp, Diabrotica virgifera
  misc_feature (6)..(28): n is a, c, g, or t
  misc_feature (164)..(181): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggaaagtgggggactttccnnnnnnnnnnnnnnnnnnccatttccaacaatcgtttttccgattatagcgccatctatccataattcgaaaaaatttctcgaataaaagttacttactttgacgtaaagaatccaaatctgcaataaaaaatgggggttccgatttaagattttaaagtaaccccccactccacctccgcgggttgtcgtttttggtgccattcgatagatttttcaatacgtgtatttatcagtttttcgatttgacgttcatttggctttgtggctgacatcgatatattggctttttttgtgaaactttgtgactcgcccatttccttatgccccgctcaaatcgtcagattgtttaaatatacactgttttgcatgtactcaacttaccttatcttgatctgatgatttcgagtttttctaaggatagatttttttcggacccccttaacgaactcccctgtattaagagccaatgtagtggtagaggtatatttacagggtacaaggtttctccctatgtgataacttgacgcgctctagtaactgcaaaaatccccgcttgggatccctaccataagagtgtttaagatagttgcacattgaattttacattatctatatatatatattaccacaaagatatacctttactaa

SEQ ID NO: 17575 - DNA, 140 bp, Diabrotica virgifera
  misc_feature (7)..(44): n is a, c, g, or t
  misc_feature (78)..(100): n is a, c, g, or t
  misc_feature (108)..(129): n is a, c, g, or t
taacagnnnnnnnnnnnnnnnnnnnnnnnnnnnnnnnnnnnnnntgcgacctcgatggtggattagagttatactggnnnnnnnnnnnnnnnnnnnnnnntggtcgannnnnnnnnnnnnnnnnnnnnnagtttaaaccg

SEQ ID NO: 17576 - DNA, 897 bp, Diabrotica virgifera
  misc_feature (16)..(16): n is a, c, g, or t
  misc_feature (44)..(44): n is a, c, g, or t
  misc_feature (279)..(279): n is a, c, g, or t
  misc_feature (296)..(296): n is a, c, g, or t
  misc_feature (307)..(307): n is a, c, g, or t
  misc_feature (374)..(375): n is a, c, g, or t
  misc_feature (395)..(395): n is a, c, g, or t
  misc_feature (427)..(466): n is a, c, g, or t
  misc_feature (527)..(546): n is a, c, g, or t
gggtacggcctggcanggtaccagggtccagggaatttcccggnggtcgcacccacggcggtccagggctttcattcaacgggaaatcgggtaggtaggaaaacccttcaagtggactcgcactaaatatggcaattggtatcacatggagtaaaaatcggggctaagtggccaaaaatcgaaagatataatttttcggtgtttaaaggggggtatacgtgccaaggccggaggctggtataaagggggctaactttatacccagggggtttccacaanaactataacattttggngtacttgggcnccaagttttttaacttaaggggctacaattaattaattttcttcaactatataatatagagatgggnnactcaatttttaatatgggntactttaaaatggtcgtttattttaaaactannnnnnnnnnnnnnnnnnnnnnnnnnnnnnnnnnnnnnnnctatacatggcgcactcctcgtctattcgtaatccttggtgatgggtctatattatggtgnnnnnnnnnnnnnnnnnnnnattgtagtttggtcatcaatcagtttttcaaattcgagatcttttgtgggtgatcagtcaatacttttcgataatcataaaataacgctaggatatttatcactatggtcatttcacattcgtagaaggaaccgcaacatttagggaaaataaggactaaatgcgagaaaattgggatgaggcaaatttgggttgaaataaggttattgggctatggaacttactttccaaataaaatactacctacctaaattatcataaatagaacaatttttttaataccagtttttatggaatcattttatatcaaaattatcatttcaaaagtgggaaaagtaaatcattgtcata

SEQ ID NO: 17577 - DNA, 507 bp, Diabrotica virgifera
gcggtccggcgcgcctactacgatcacacggtaaatctcagatgaaaacgcattcgcgatagatcgcgtcgttcatcggtgacagtgcgggacgctcgttctgctgaacgctgcctcaacgatttcctccttcacgactcactgtttcggaacaacacaatgattcgctcaccgcagcagtgcacggcattcaccgagggatgtatcatcgaaaaataccgataagtggaagtgctcgaacttcgtgcctcaccgtcgttccgaagcgttctcaatcggtacacagtggtcggaatgacccacgtcctcgctcatacgcggtcatcgagagagcttcgcagatatgccaaggaagtctaccgtgcgggaaaaaatatcactttcgcggaaggatacggacggtccataggtgaacagataaaggggtgtactgctaccgctatagaagagaatctactcgcacatgatacaaacggagacagctattcgtcgtggctaaaaaatata

SEQ ID NO: 17578 - DNA, 890 bp, Diabrotica virgifera
  misc_feature (365)..(384): n is a, c, g, or t
  misc_feature (467)..(501): n is a, c, g, or t
  misc_feature (701)..(701): n is a, c, g, or t
  misc_feature (721)..(721): n is a, c, g, or t
  misc_feature (833)..(833): n is a, c, g, or t
  misc_feature (878)..(878): n is a, c, g, or t
atagtttttaattacaaacaacttttcatagtaacaatttttaatattctgaaatatcaaaactttaacgaaattcatatttttgacatacgttgtataaaattgataaaattttatacctgattgttgagttttagattttagactatgcagagcattttatgaagaataactttttttcgtatgattggtaataaaaaaggttcccatatggttcctagttacgcagacatactttataatagctcaaaatttttgaattttcacactaagccatcgatattcggattcagcgtactcaaaaacaaaatagaaacatattttatcaaagtaaaatgatgaattcaacgatattgttttcaccnnnnnnnnnnnnnnnnnnnncatagaattatatacatccttctgtctgtctgcgaacacaattcctccgtcagtataccaggtagaatgacagatgaggtgtnnnnnnnnnnnnnnnnnnnnnnnnnnnnnnnnnnnccccaggataattacagcttaagataaaacaaatccgtctcaattattaaattttacaatattgtacgacaatccaaaattttacgtttagttaaaatgttaacagaaatgttaacagaaaataaatcacttatgatgattattaaacataaatttttcttgtttttttcattcatttctagaatagaaaatcgacttanagattttgacccttccttanattttttatggcggcggccctggaaggataatactaaacgtgagaaatttaacctagtctgtctgtccgtctatccgtcctaccgcgaataagactcctcttcactataccnagtagactgacaaatgaggtgtcaaatgaaagctataatccaagnatggtactaaag

SEQ ID NO: 17579 - DNA, 610 bp, Diabrotica virgifera
acctctcgggcccggatatgagtgggagtggagaagggttccctttgggccgaaggagagagactgacttgaggggaagtggccaccatggtagaaagatactttcgtactaatacccgaaagaattttttatgggatgtgttaatggaagaccaacgagctcttgaagacccaccttatgatggtaatcatagacaacctcaatcccttcagattcgcgactgactggtattctcttctattcgacagccgagccgtcttagaaaaactcgactacttccatcatgatctacgacacttatgctgaatcctacacagtatccgagtgaaatcggcgtgaagctttttttaatgataccacgcagtattcaagaagaacgacaatgaaactgcataatctgaagtgacattagagaatcatgtacgaatagacatcaccgctgagagtggtgtggtcaccaaaacagatgctgagattccatgaagaggatacacattcaacccatgatctgaccgaataacgatataaggagatgaaaccagaagttgccagcaatctctctggtattagaaggcaactaagaggaacattatacccattgactgagat

SEQ ID NO: 17580 - DNA, 616 bp, Diabrotica virgifera
  misc_feature (2)..(388): n is a, c, g, or t
  misc_feature (395)..(432): n is a, c, g, or t
  misc_feature (452)..(465): n is a, c, g, or t
  misc_feature (468)..(490): n is a, c, g, or t
  misc_feature (498)..(520): n is a, c, g, or t
  misc_feature (544)..(544): n is a, c, g, or t
  misc_feature (559)..(559): n is a, c, g, or t
  misc_feature (562)..(581): n is a, c, g, or t
  misc_feature (589)..(615): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggntggtttctatctttnaannnnnnnnnnnnnnnnnnnngaaaggannnnnnnnnnnnnnnnnnnnnnnnnnng

SEQ ID NO: 17581 - DNA, 374 bp, Diabrotica virgifera
gcggtccggttttttctttccctcatccagtaaattggaaatatataagaataatcatcactcacatcctcacaaaacggtcagtatcaaggctcgctcgctctcaaaaccaaaggtggatggggtcggaggaaaaaggatttaaaataatgggcggaattcaaacataattaaataaagaagggttcggttccaataaattcacatcggtaatccatcgaaaaacctcgttggctctcaaaaaaaaggaagaatccatcaaattcgaaatcagaaaattcgcaaaatgggggatttcaatatatttcatcatccttcgtaaaaataggtaaaaaataaaatttcctcaacggtaaccgtaaaaaattaaatcc

SEQ ID NO: 17582 - DNA, 603 bp, Diabrotica virgifera
  misc_feature (262)..(318): n is a, c, g, or t
aagcagatctaggtccaaatcaagatccaagtctagatccaagtctagatcaaaatcaaggtccaagtctagatcaagatccaagtctaagtcacaatctagatccagatctaggtctaaatctcgttccagatcccattcaagatcacgatcaagatcaaaatcccgttccaagtccagatcccgctctaaatcaaagtctaaatctaaatcccggtcccgatcaaaatcccaatccaaatcgccttcgagatcaagatcnnnnnnnnnnnnnnnnnnnnnnnnnnnnnnnnnnnnnnnnnnnnnnnnnnnnnnnnnatctggttccagatccaggtctccttccaaatccaagtcaaggtccagatctaggtctagatcaggttctaaatctgcttccagatctagatcgtcttccaaagcttcttccaaatcgggatcaaggtccagatcaggatctcgatcaggatcaggctcagaatctgggtctggatctgaaagtgactaaaattttaagtttcattagacatatttcagatttttttaaattgaacataaataaaccagctattgtaagaattttacagtataaattgtattagg

SEQ ID NO: 17583 - DNA, 925 bp, Diabrotica virgifera
  misc_feature (847)..(847): n is a, c, g, or t
gttcatttggtcgtggtcagctgtagggtatttagaaatgggaatatgtgataaaagtagttttgggtgtgtgttttaatagttttgtgtataatattgaattgtgcttgtaaaacaatgttcagtgattgtgttgctgtgttattgttgcttctagtcctaccttttattgaaagtgctgaacgactgaacgaatacattcgtcactatgagacccttgcctatgacaccgaagctgtccatagggctcacacacgagcgaaacggtccatcgcctcggacaattacgtccatgtggcattcaaggctcacggtcacgactttcgagtacggctgaaaagggaccttcacgtttttcaggacaaacttgaggtgcagggtccaacgggagaaccgctggacgtcgacacgtcgcacatatatcagggacacattttaggtgaacctgacagtgtagcctttggctcaatcattgaaggcgtttttgaagggaagctcatgttgccaagtaagggtgcattttacgtagaaaaggcccatcattattttcctcatacgacacatccgaacagaacattccatagtgttatctaccatgaagaccacgttgaggatccttatgctcacaaaagagaaggtcattctgctggctgtggaatcaatgacgatgtgatcgagtggatgaacaaaatccagtcgtcaggagaagacctgcccattaccccctctacggttgctttcaaaaaagccgtcaaacacaaaaaacatttaaaaaccaaaaaagacaaggaggagccgaatcctctgccgaattacgaggacgtcgtgaacaaatactcgaaagaangcaaaatgacaagcaacagtaggcacagaagagccacaagaaagagacaaaaacaaaatacctgttcgctgtacatac

SEQ ID NO: 17584 - DNA, 534 bp, Diabrotica virgifera
  misc_feature (278)..(296): n is a, c, g, or t
cggacacatcgttcgcttgatgtgtgcgcctgctactgtaaataatttatagaataagagaaaatgtcgctatccaccgctctcccattattgattcaataccttgacgatgtagtattagggattagatttaaatatatggtgtcatatactattttacaataaaggggatctaatatattcatgtttttcttgcaaaactgatagttttaataatgtttttccatttataggtttcttcctttgtaaatgtatttcctttttattcaaatccttgnnnnnnnnnnnnnnnnnnnctctttgtaactggatatttttatcttagtaatccttgataatttttactttcaacttaagtatgaaagttcattagctactgcttttccctacgtattagaattaaagtttttcatattttaacctatattagtatttatggttagatatccttatttatatcttagatatccttattattaagatagacgtttacattatttaaataaatcctccgataatactattaagattaaa

SEQ ID NO: 17585 - DNA, 947 bp, Diabrotica virgifera
  misc_feature (18)..(48): n is a, c, g, or t
aaaatatcataaaatccnnnnnnnnnnnnnnnnnnnnnnnnnnnnnnnctatttttagcgtattctgcaagtaattcgcaatgtcggacgaaaacatttttatattcgtgccaaacataattggatatgcaagaatcgttttggctataatttccttttattttatgccaacaaactatattattgcttgttcatgttatgtaatatcagccctactggacgctttcgatggacatgctgccaggtactttaatcaaagcaccaaatttggtgctatgcttgaccaactgacagatcgctgtggtaccatgggattggtggcagtactggcccatttctaccccaagtatatgtttctgtttattctatctatgtgcattgacattgcctgccattggatatatctacattcgtccattttgcagggcaaaacaagccacaagtttgttgacatgtcagaaaacccaataatgagactctattacaccaataaaaacgtgctgtttgtaatgtgtgccggtaatgaagcattttatgctgctttatatcttctccactttactgaaggccctattattgcaggtttgggattatggaggatcatcatattcctttcagcgccaatatgtttcattaagacaggaatctcccttcttcactgtgttgtggcctcaaagaatttggctatcatcgatattaacgagagaaagaatgctaccaaaaaagcattttaaaagaagtcaattttccaaaggctttgcttacttaacagactggagaacatattgtgtcagtacccctaatagaagatttgtgaccaaaggataaatagttgctccattgtaaatgttgttagggttgtgttaagtcatactgttgttttttgaggttagctcattttatttctaattttctatattactgctcattcattttaaactcttttc

SEQ ID NO: 17586 - DNA, 247 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (241)..(243): n is a, c, g, or t
  misc_feature (245)..(246): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattannnanna

SEQ ID NO: 17587 - DNA, 765 bp, Diabrotica virgifera
  misc_feature (5)..(41): n is a, c, g, or t
cttannnnnnnnnnnnnnnnnnnnnnnnnnnnnnnnnnnnncctaaaataatttagtgtcccttctcagcaaactccaattttaactgtcttcttaagatttttccagacggatttcttggaattgcatcaacaaccgatactcctccaaccagccgtttatagttagcaacttgttgagctacatatgacttaatttcatcaccactgatatttttgtttttctttacaactatgtaagctctaggaacctccccgtattgctcgtgtggtattccaatcaccgcagcgtcttccactcctggatgacctctaattacttcttcaagttcagctggagctacttgaaaacctttcaccttgattagttcttttattctatcagtaatgaaaagacattcatcttgattataataagcaatatcaccagttttcaaccaaccatccaagaacgcgttttctgtttcttctgcacgattaaagtatcgcttcattatctgaggaccctttgccaataattctccttttttcgttaggtcctagtggtgtacctgtagtatcaccaggtgctacaattttgagtaaagtatttggtaccactgttccaattgtgcccccattcgcttcatttctcggtatatattttgaataatacgttaaaattggggatgtctctgtcattccataaccctgtactattttggattttggattttgagttttttctaaaaatatctggttcggcaagaaaatcctaaaaggtgca

SEQ ID NO: 17588 - DNA, 867 bp, Diabrotica virgifera
  misc_feature (29)..(736): n is a, c, g, or t
ttaagaaagaaaggaaatgtatccctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagttcacatcgataatacagattgcgacctcgatgttggataaagtttataattggggagcagctataatattaagtctgttcgacttttaaagtttacatgatctgag

SEQ ID NO: 17589 - DNA, 847 bp, Diabrotica virgifera
  misc_feature (6)..(30): n is a, c, g, or t
  misc_feature (59)..(81): n is a, c, g, or t
  misc_feature (275)..(348): n is a, c, g, or t
  misc_feature (353)..(418): n is a, c, g, or t
  misc_feature (436)..(454): n is a, c, g, or t
  misc_feature (463)..(477): n is a, c, g, or t
  misc_feature (479)..(495): n is a, c, g, or t
  misc_feature (498)..(516): n is a, c, g, or t
  misc_feature (531)..(551): n is a, c, g, or t
  misc_feature (689)..(738): n is a, c, g, or t
  misc_feature (743)..(845): n is a, c, g, or t
ttttgnnnnnnnnnnnnnnnnnnnnnnnnnctttatatatcttcggtcctctctcgtannnnnnnnnnnnnnnnnnnnnnngatagaaaccaacccggctcacaccggtttaaactcagatcatcgtaaaattttaaaagtcgaacagacttaataatatagctcgctacaccaattataaactttaatccaacatcgaggtcgcaatctttattatcgatttgaactctccaataaaattacgctcgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 17590 - DNA, 921 bp, Diabrotica virgifera
  misc_feature (40)..(64): n is a, c, g, or t
  misc_feature (778)..(778): n is a, c, g, or t
  misc_feature (799)..(827): n is a, c, g, or t
  misc_feature (829)..(829): n is a, c, g, or t
  misc_feature (861)..(861): n is a, c, g, or t
  misc_feature (866)..(866): n is a, c, g, or t
  misc_feature (875)..(875): n is a, c, g, or t
gaagaagaaacataccaaagttaaaaatgaaactgaatcnnnnnnnnnnnnnnnnnnnnnnnnnggaaaatgcagcgaagagtagttgtaactggtcttggagtagtgtcccctgttggtaccggcgtcaaagaagcgtggaaaaatattatttcaggaaaatcaggaataacaaggttagaaggtcctgaatatgaatctttaccatgtaaaattgggggctacgccaaagacaagggggagaaaataagtttatcaaattattttagtaaatcagaattaagaacaatggctcctgcaaccggatttgcacttatatctgccaaagaggctttggaagatgcaaaattagaccaaatggatgagaatactaaaaacacagctggagtagctgtcggaatgggtatggtagatctacaagatatttgtagtacttatgatgctttaaaaaaaggctaccatcatgtgagcccttattttgtaccccgaatacttcccaatatggcagctggacaaataagcatcaagtatggtttaagaggacctaatcattcagtatccacagcatgtgcaactggtgcacatgccattggagactcatttagatttataagaaatggagatgctgatattatgatttgtggaggcaccgaatcttgtatatctcctctgtcaatagctggattttctaggctaagggctttaagtacttcttttaatgatcaacccgaaaaagcttctaggccttttgacaaattacgagaaggatttgttatgngagagggaagtgcagttttannnnnnnnnnnnnnnnnnnnnnnnnnnnncnagaatgctcacatttatgcgggacttttaggntatgntttatctgnagatgcatcccatttgacagctcccagatctgatggtgctggagcc

SEQ ID NO: 17591 - DNA, 829 bp, Diabrotica virgifera
  misc_feature (11)..(28): n is a, c, g, or t
  misc_feature (181)..(201): n is a, c, g, or t
  misc_feature (211)..(241): n is a, c, g, or t
  misc_feature (275)..(305): n is a, c, g, or t
  misc_feature (307)..(372): n is a, c, g, or t
  misc_feature (374)..(393): n is a, c, g, or t
  misc_feature (395)..(790): n is a, c, g, or t
  misc_feature (793)..(793): n is a, c, g, or t
  misc_feature (795)..(819): n is a, c, g, or t
ctctctctacnnnnnnnnnnnnnnnnnnctctctcattcaacatagttaatcagtatccgcgagagaatctctctctcctctctaaaggaaaaatctcatctctctccgtacctcgcgtatcagggatctccatctcaattaataatctatcatcatttactatctttcgaatctctcaannnnnnnnnnnnnnnnnnnnncttttcatcnnnnnnnnnnnnnnnnnnnnnnnnnnnnnnntaacgaaatcgttattcgtttttcaaatatcatnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnannnnnnnnnnnnnnnnnnnnnnnnncttaattttt

SEQ ID NO: 17592 - DNA, 688 bp, Diabrotica virgifera
  misc_feature (224)..(251): n is a, c, g, or t
  misc_feature (328)..(348): n is a, c, g, or t
ccttacgcgtccgattcttctgaaaacgaagatttgaagtaaccctgttgaaacaacaggtattcacaagatgtcttgaacctaccgttctgtcagacgtatccacagataccatttatttatctgaccttgagtataagatgattagtcagagataatagcgtatatacgattctctaatttaaaagaaccaaaaatttaacgtttttattgtaaaacatacnnnnnnnnnnnnnnnnnnnnnnnnnnnncgtaattcgttttcaaatatatctacttattaaataaataaatgaactttatttattaacaatacatttacaattgnnnnnnnnnnnnnnnnnnnnnctacttaatattaactgtggagcttaagaataaaaatttattagtatttaattttcctcatacgaaataggattacagattttcatagtctcaacacacgattattatttacttttcgatatcattatatacatcctttataaattttttaccaggatacaagtttaaattatttaaatcttagtaacgatgattatattaggattaaaacaatgtatatttaatataaatatatagattctaataaaggaattcagcaacatatttatcacctggttcctaaaaacatgctctttatgaagtaaatataaagtctcgtctagcctactgattaatttca

SEQ ID NO: 17593 - DNA, 904 bp, Diabrotica virgifera
  misc_feature (13)..(35): n is a, c, g, or t
  misc_feature (144)..(167): n is a, c, g, or t
  misc_feature (716)..(735): n is a, c, g, or t
ttcataatatacnnnnnnnnnnnnnnnnnnnnnnnaactacttataatacaaaaacaatcttatagtataaaaacataaaaccaagaataattcgagtctcctttcaaaatgtaatatcaatctgatttaacatggcattaacnnnnnnnnnnnnnnnnnnnnnnnntattcatttataacaggtcagtgcatagactatttattagatacaagctttgtcaaacattttcttttgataagtatttaatgcctaaataatcatgttgaaacagaaattatgacgacaaattattctaaaaaattttttagctaaaacatatatttgtaaaaataatagattccgcgagacaatcataattgaacattccacaaggtaaataaatcaaacgataaaaccggcaccttgagtttttttaatcaaacaatcatcaaacaacttgagtttatgtaattttcaatagtaataaatttctatgaaactttaataaaattggagaaaatgaaactactgtaaatcaattcatatgtgcatataaaatctttcaagctaaaggtattttagaacgtaaattttttaaccagatggcagtgttgatttgtttagttactagtgtttcggaagattgtctgaattatgttataagcatacttacaaagcaaagcatattgaaattaactaccaagagtaagtacaaatctgaaacacgaacattcnnnnnnnnnnnnnnnnnnnnctgccccacttgatggacaaatctaaggatgtaataaaagagtgttatcaagaaattcctgtagttgattgaacatatttttgaatacagtttctaaatatgtcgtaacgattttttgaccttgaaattaataatggcaatagtactaatgtattttattatacttacc

SEQ ID NO: 17594 - DNA, 849 bp, Diabrotica virgifera
gaaacccaactagtagctttttacgtcagtaaactgaatccctcaaatcaggtacatttgtatgctaagtaccttgaaaaaattatagaccaacaagaaagaaaatctgcgctaatcttcgccgaggatagtggattggaagtgcatgcaattacaaaacaagtattagaaaacattaggaatcttccacatgaaaccgaagaaaacggaagtctacagcacaagatcaccgaagttgacaagtacaaaatttcgtgtattgattggatactttactacgaagaacaacgagcagaagctctcttccagataaacgcattgatattcgcattcctaacattaggaaagttagatgctgcgcaactagctttcaataaagtgcctccaaacagtgttgagaaaatacttaatgaaggtaaagtgaatgataaaataaaccagacaatcaaggaattcctatgttataaagcttatcttgacgcccaggaagcttttagcgaatggtttaagcatcgcaaaagtcagcccactccaccagacagtctaccagagaatgctctatttccagaaaaagtggcccatcaacatagggagtcgcagtataaagcagagttgggaaggtggaaactttcggccgatcatatggcgaaaaatgcgaaggccaaattatacaacgtccttcttttccccgacggttggatagtaggtgcagctgaagaatattatctaaggtcgacgtgcattccggaagtagttcttttattgtatgctgtgttgtacgaatctggtcagcacgaagaatgtgttcaactagcagatattctagcttcgaaaaaatatggaatatat

SEQ ID NO: 17595 - DNA, 920 bp, Diabrotica virgifera
  misc_feature (80)..(98): n is a, c, g, or t
  misc_feature (113)..(130): n is a, c, g, or t
  misc_feature (168)..(185): n is a, c, g, or t
  misc_feature (187)..(202): n is a, c, g, or t
  misc_feature (289)..(313): n is a, c, g, or t
gtaaattgaaatattaacaatttagaaactaaaatgcacaataacctggtaactgttccaatacagtatgtaccaagtgnnnnnnnnnnnnnnnnnnngtatcagttctccgnnnnnnnnnnnnnnnnnnatacatattggttacagttgtatttgatttgaaagtannnnnnnnnnnnnnnnnncnnnnnnnnnnnnnnnngtccaatatatgcaacacggttaaacatatctcagaaagtaaacttgtatgtcattagttgtattcaggtgtactttaaaatttggnnnnnnnnnnnnnnnnnnnnnnnnnatggaatcatgcacgttcctggtgatcgactataacggtgcagacctcttaaggcgagtccgctgtatcacaccccatcatcctaacttggtccaaaaggacctggtcttcggctcttctgagacccaggctatttcatatctgctaaaatccgcaggagctctaaatcagaactctttctgctgttgcgaacgtttaatcctctggtaggccaaagccgggcatttccagaagataagtgaggatgtttcctcttatatagatggcaccttgggctatccgccaatccaagcatatataggtgccgccttagtatacaatggccaataagcatactggccaccagagagcagctcctattaagaatggcctctctacatggatcctagtctgtccaatacctctaccactaacccaagagtcctgtgatctccacaaaataaactccccgagacaacctcgaccagtactgaagagcactccaaccacaggttcgaatccaacgggcggagtggatgggtcccgtcctgtcagggcgtcgagaagcatttcattcccttaaatactcagtattccggaacttatgagttgaccttcttggtcagcg

SEQ ID NO: 17596 - DNA, 882 bp, Diabrotica virgifera
ccctgattctcctgaattacagataaggaaaatgggtgatctgtattttatgttgggtcaatattctttagctttccaaacgtaccatctggcaaagagagagtacaatactgaccaagcttggttgtattatgctggggcgctagaaatggctgctttggctgcatttatggccaatcaatcaaccaaaaagacctgtgattatatggaggagagcattaccacttatttaaatacatgcaaaatgccccagtttgctaccagagcaacgattttaggatctgaatgtttgaaatttcgaaaaatgtatggagaagcagctcaccagttgattagaatgattagtgaagaatctgatttacgttctgctttgctgcttgaacaagcttcgtattgttttctgcagactaaaatggtcagaaaatacgcttttcatatggtattagcaggacatcgctttgctaaagccgcacaacggaaattttctttaaaatgttacaaacaggcatatcaagtatacgaaaatacaggatgggacctggccactgatcatatacattataccattggccgacaagcaaacaatttgcaacaattcgatgaagctgtatcatcttttgccaaacttttaacaggagagagtaaacagactgcccagcagcaagctacatatttaaaagaatatttaaccattttagggaataaactccgacatgacaaggaatctgatgtgattgctagtttacgtttaaaggtacctattgaaattgaagaagatcccagtcaagaagtatgtccaattttgcctgttccagaactagatatcgaatccttaagacttttagcttgtccttcacgacctatatcgacacctggcaaaac

SEQ ID NO: 17597 - DNA, 392 bp, Diabrotica virgifera
  misc_feature (2)..(193): n is a, c, g, or t
  misc_feature (200)..(237): n is a, c, g, or t
  misc_feature (257)..(270): n is a, c, g, or t
  misc_feature (273)..(295): n is a, c, g, or t
  misc_feature (303)..(325): n is a, c, g, or t
  misc_feature (355)..(386): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 17598 - DNA, 166 bp, Diabrotica virgifera
  misc_feature (7)..(44): n is a, c, g, or t
  misc_feature (57)..(57): n is a, c, g, or t
  misc_feature (64)..(77): n is a, c, g, or t
  misc_feature (80)..(102): n is a, c, g, or t
  misc_feature (104)..(104): n is a, c, g, or t
  misc_feature (114)..(115): n is a, c, g, or t
taacagnnnnnnnnnnnnnnnnnnnnnnnnnnnnnnnnnnnnnntgcgacctcgatngtggatnnnnnnnnnnnnnnggnnnnnnnnnnnnnnnnnnnnnnntngtcgactttnnaaaatttacatgatctgagtttaaaccggtgtgagccagggtggtttctat

SEQ ID NO: 17599 - DNA, 735 bp, Diabrotica virgifera
  misc_feature (109)..(130): n is a, c, g, or t
  misc_feature (270)..(318): n is a, c, g, or t
ggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaaatacaatatcaattgaggagtttgctaaaactacccctgataatcctccaactgtaaataataaaataaaacctaaagctcagagtgttactggactatatgtaatagtagttccatgataagtagctaatcatctaaatactttaattccagttgtaacagcaataattatagttgctgatgtaaaataagttcgggtatcaacatccattcttactgaaaatatatgatgagctcacacaataaaatctaataagccaattgctattatagcataaattattcataaagaatcaaaagttattttt

SEQ ID NO: 17600 - DNA, 135 bp, Diabrotica virgifera
  misc_feature (7)..(44): n is a, c, g, or t
  misc_feature (61)..(61): n is a, c, g, or t
  misc_feature (79)..(79): n is a, c, g, or t
  misc_feature (110)..(131): n is a, c, g, or t
taacagnnnnnnnnnnnnnnnnnnnnnnnnnnnnnnnnnnnnnngcggacctcgatgttgnattaaagtttataattgntgtagcagtatatttattaagtctgttcgannnnnnnnnnnnnnnnnnnnnnagtt

SEQ ID NO: 17601 - DNA, 931 bp, Diabrotica virgifera
  misc_feature (266)..(280): n is a, c, g, or t
  misc_feature (282)..(294): n is a, c, g, or t
  misc_feature (657)..(679): n is a, c, g, or t
  misc_feature (815)..(815): n is a, c, g, or t
aaactacagaacaacacaaccagaatattgaagagtcaaaaaatgtagatcctccttcttccacagtttcacacgtggattctagttcagatgttaagaactcagtcgatttaaaaagatactttgatttgttagatcgacttatacaaaggaatacacctctttctattggtcatcaaaaatatgtcgatattattagaagcagtatgaataaggtagctgctagcaaaagcagacgaagtccagtccgggaaatttgtttgacnnnnnnnnnnnnnnntnnnnnnnnnnnnncagattccaacaaatctgatagcgagggtaaattacgaatagcagacactgaaatgatagaatttgatagaatgtcaaaaaatgtagaagagctggaaatcattactaaaaagttagaagaaaaagacgaagttacagtgttgaaagttgaaataattaattttgctaaagctgttctaacagagtggaggcataaattgaaagataaagaagaaaatccatcgaacattgaccctattactagtaatcatcctatctctaaatcccccgaaaagacagtaaatactaatgtttctgacgaaaacctgaaagacgaagagcctgattcacttaatgaaagtactgaagtagaaagttctagtnnnnnnnnnnnnnnnnnnnnnnntcaaagaaggattcaccaaagacaaggtaagcaggagcaagaaaaacagaaaggctatgaggatgacgcttctagagaaaattatagtatgtgggtaccaccaagtgccaaagtggagacggaagaacaaatctanatgataaatatggctactaaatactgttttgtacataatatgaagaccttatttgcacatatttgcactttttttaaataatctgtaaaatggtttaatgtaaagattctatattt

SEQ ID NO: 17602 - DNA, 931 bp, Diabrotica virgifera
  misc_feature (5)..(27): n is a, c, g, or t
  misc_feature (62)..(81): n is a, c, g, or t
  misc_feature (871)..(871): n is a, c, g, or t
tcttnnnnnnnnnnnnnnnnnnnnnnnagaccacagttttagaatgaccagctacaatgagnnnnnnnnnnnnnnnnnnnntagaagttccttcaatgcaggagatcgtatcgacacaaactgggtaactgtttttggcttccctcctagtgctctcaatttaatattagctcagttatccaattgtggtcctatagcagagaaaaaggtaccacctcaaggtaattgggttcatgtcaagtttaatcatataacagaagtatcaagagcactgtctttaaattgtaaactgattaataacagcatcatgatcggagtgactccatatcaccacaaagaaaataaggagaatgatagttccatgtatgcatcgcctatgagagttagatcattgaggcattcgtttatttcacctagctcacaaaattctgttatttcgcctcaggctttaccacagaagtctacaggaatagttacgaaagctatggaatacgtgtttggatggtaaatgtatgtttgatagaaatagagacttaagacaatgtttgaagtattagtttatgtcattcatgtttttcatactgtattagaatgtaacaattgcttgataaagttaattttgtgatattggctcaaactctaatcaactctagatttaacatctttaaattatccttgttgggatatctgacaacctataatagacctggatcttgtgtaccaaaaaaaagttgagctattgacaagttttcagctattaaatgctattaatcaacttttttttggtatgcggggtccaggtctataagtcaaactgacacgttttaagattggtacaatattttgtattattgatcatatctgcaactgnacataagtgctctaaactttgttgcaaacacacgctaaacacaagtgctcgaaatgacat

SEQ ID NO: 17603 - DNA, 178 bp, Diabrotica virgifera
  misc_feature (3)..(87): n is a, c, g, or t
  misc_feature (95)..(95): n is a, c, g, or t
  misc_feature (101)..(151): n is a, c, g, or t
  misc_feature (155)..(155): n is a, c, g, or t
  misc_feature (158)..(158): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnnnnnnnnnaataattnatttannnnnnnnnnnnnnnnnnnnnnnnnnnnnnnnnnnnnnnnnnnnnnnnnnntaantanttttttgatcccaatttttt

SEQ ID NO: 17604 - DNA, 697 bp, Diabrotica virgifera
  misc_feature (130)..(147): n is a, c, g, or t
  misc_feature (424)..(441): n is a, c, g, or t
aaaacaataggtatattagatgaagagtggtagaaattttgttggtaatcaaattatgtaaatcaaagcattacctactataaatagataggtacatacattttccaaataggtaagtacctacctatgnnnnnnnnnnnnnnnnnnctgaaacatttacaattaagtacgtacctgttgcttttaaaaactatttaaaaagttactacaattataaacttgcttttgtctgtgtcctcacaacaataaaaactaatatacaatatttgtttatccataacctctatattgaacaattattgtcatgtcatttgaacacccaatcagagcaaaggtataatgcatctgtgccggggaacaaagtttttgatgaattcgcgcatattaaatttcactcccatcgctcctaaagaagtataacttnnnnnnnnnnnnnnnnnntgcaaaccggttattttttcacaaatgtttcctttagttggtctaaaaggttacaatgatatagaatttattgttttgccagtttgcaggtaatccacaaacaaaatttctcccgtatcccaaagaactgatgctaacaccttcttggtcgatttatgggcaccaactcgttttgaagccgaagaaccaggttcacaccactctttagcttcttgttttaattcaagatgatggtgatagacccaagtctcgttca

SEQ ID NO: 17605 - DNA, 761 bp, Diabrotica virgifera
  misc_feature (94)..(111): n is a, c, g, or t
  misc_feature (115)..(137): n is a, c, g, or t
  misc_feature (146)..(159): n is a, c, g, or t
  misc_feature (161)..(187): n is a, c, g, or t
  misc_feature (200)..(217): n is a, c, g, or t
  misc_feature (219)..(244): n is a, c, g, or t
  misc_feature (261)..(292): n is a, c, g, or t
  misc_feature (294)..(311): n is a, c, g, or t
  misc_feature (313)..(341): n is a, c, g, or t
  misc_feature (343)..(364): n is a, c, g, or t
  misc_feature (369)..(409): n is a, c, g, or t
  misc_feature (450)..(512): n is a, c, g, or t
  misc_feature (742)..(742): n is a, c, g, or t
gttatttcaaaatgatagctgtatcatctctatgctgccctacaattagaagatctctatgttaactgccaattaattctttttgagagagacnnnnnnnnnnnnnnnnnnaaannnnnnnnnnnnnnnnnnnnnnncatcatgcnnnnnnnnnnnnnncnnnnnnnnnnnnnnnnnnnnnnnnnnntagagctaaaaannnnnnnnnnnnnnnnnncnnnnnnnnnnnnnnnnnnnnnnnnnncaatggaatgttattcnnnnnnnnnnnnnnnnnnnnnnnnnnnnnnnncnnnnnnnnnnnnnnnnnncnnnnnnnnnnnnnnnnnnnnnnnnnnnnngnnnnnnnnnnnnnnnnnnnnnnctagnnnnnnnnnnnnnnnnnnnnnnnnnnnnnnnnnnnnnnnnngagaaactagcagtaataattttcatattttagatcatcgnnnnnnnnnnnnnnnnnnnnnnnnnnnnnnnnnnnnnnnnnnnnnnnnnnnnnnnnnnnnnnngtaactcatctaactctagttagtgtggataatattagacttatgactttgcatatgtaaaaaaactctatattgcttctaaaggaattctgcttcacttcttttcacctgtttattagaaacatgtctctttatctctttcttctatcctcgcctgcccactgcttaacttgactgaactcgacattttaaccgtcttactatagcataatcattatccattttattgnatgctgatacgtgggagtg

SEQ ID NO: 17606 - DNA, 56 bp, Diabrotica virgifera
  misc_feature (11)..(47): n is a, c, g, or t
gtttttttggnnnnnnnnnnnnnnnnnnnnnnnnnnnnnnnnnnnnngggggggat

SEQ ID NO: 17607 - DNA, 797 bp, Diabrotica virgifera; identical to SEQ ID NO: 8964
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t

SEQ ID NO: 17608 - DNA, 889 bp, Diabrotica virgifera
  misc_feature (13)..(31): n is a, c, g, or t
  misc_feature (43)..(65): n is a, c, g, or t
  misc_feature (100)..(134): n is a, c, g, or t
  misc_feature (142)..(819): n is a, c, g, or t
  misc_feature (827)..(859): n is a, c, g, or t
  misc_feature (868)..(868): n is a, c, g, or t
tttttatcttatnnnnnnnnnnnnnnnnnnnctctctctctcnnnnnnnnnnnnnnnnnnnnnnncttaatcgatagttaattagtattcgtgagagaannnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttannnnnnnnnnnnnnnnnnnnnnnnnnnnnnnnngtttataanattataaataagtttttttag

SEQ ID NO: 17609 - DNA, 591 bp, Diabrotica virgifera
  misc_feature (15)..(35): n is a, c, g, or t
  misc_feature (194)..(258): n is a, c, g, or t
  misc_feature (260)..(357): n is a, c, g, or t
  misc_feature (364)..(401): n is a, c, g, or t
  misc_feature (421)..(434): n is a, c, g, or t
  misc_feature (437)..(454): n is a, c, g, or t
  misc_feature (467)..(489): n is a, c, g, or t
  misc_feature (516)..(543): n is a, c, g, or t
  misc_feature (577)..(590): n is a, c, g, or t
cccttcattccagcnnnnnnnnnnnnnnnnnnnnnttatgctaccttagcacggtcattagattgtttattgaaagatggaatgaagggatggatgagaaaaaaactgtctgtatttagttgatagaagaagtttatttttaagtgaagaaaattaaaagtttgtagaagacatagaagaacctatattagtgnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgatggatnnnnnnnnnnnnnnggnnnnnnnnnnnnnnnnnnaagactgttcgannnnnnnnnnnnnnnnnnnnnnnagtttaaaccgatgtgaaccaggatgnnnnnnnnnnnnnnnnnnnnnnnnnnnnttagtacgaaaggatcatatatagaaaatgacannnnnnnnnnnnnng

SEQ ID NO: 17610 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17611 - DNA, 665 bp, Diabrotica virgifera
  misc_feature (3)..(172): n is a, c, g, or t
  misc_feature (177)..(311): n is a, c, g, or t
  misc_feature (315)..(357): n is a, c, g, or t
  misc_feature (359)..(382): n is a, c, g, or t
  misc_feature (390)..(467): n is a, c, g, or t
  misc_feature (502)..(561): n is a, c, g, or t
  misc_feature (585)..(600): n is a, c, g, or t
  misc_feature (602)..(644): n is a, c, g, or t
  misc_feature (646)..(661): n is a, c, g, or t
ctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagnnnnnnnnnnnnnnnnnnnnnnnnnnnnnnnnnnnnnnnnnnncnnnnnnnnnnnnnnnnnnnnnnnntaaaaagnnnnnnnnnnnnnnnnnnnnnnnnnnnnnnnnnnnnnnnnnnnnnnnnnnnnnnnnnnnnnnnnnnnnnnnnnnnnnngtagtaaagaaatgtaataaaataatgtaataagnnnnnnnnnnnnnnnnnnnnnnnnnnnnnnnnnnnnnnnnnnnnnnnnnnnnnnnnnnnncattaataaaaagtagtaaatacnnnnnnnnnnnnnnnngnnnnnnnnnnnnnnnnnnnnnnnnnnnnnnnnnnnnnnnnnnngnnnnnnnnnnnnnnnnttcc

SEQ ID NO: 17612 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17613 - DNA, 856 bp, Diabrotica virgifera
  misc_feature (3)..(337): n is a, c, g, or t
  misc_feature (341)..(359): n is a, c, g, or t
  misc_feature (376)..(398): n is a, c, g, or t
  misc_feature (412)..(433): n is a, c, g, or t
  misc_feature (464)..(490): n is a, c, g, or t
  misc_feature (504)..(557): n is a, c, g, or t
  misc_feature (561)..(579): n is a, c, g, or t
  misc_feature (594)..(740): n is a, c, g, or t
  misc_feature (742)..(845): n is a, c, g, or t
aannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtnnnnnnnnnnnnnnnnnnnggggtgtgtttttttgnnnnnnnnnnnnnnnnnnnnnnngggtgagaaaaggnnnnnnnnnnnnnnnnnnnnnngcccctctcttcttttcctccccctcctccnnnnnnnnnnnnnnnnnnnnnnnnnnntgtgttgttgtgtnnnnnnnnnnnnnnnnnnnnnnnnnnnnnnnnnnnnnnnnnnnnnnnnnnnnnnaccnnnnnnnnnnnnnnnnnnngggccggctttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggagcg

SEQ ID NO: 17614 - DNA, 70 bp, Diabrotica virgifera
  misc_feature (2)..(18): n is a, c, g, or t
  misc_feature (20)..(64): n is a, c, g, or t
cnnnnnnnnnnnnnnnnncnnnnnnnnnnnnnnnnnnnnnnnnnnnnnnnnnnnnnnnnnnnnntacctc

SEQ ID NO: 17615 - DNA, 955 bp, Diabrotica virgifera
  misc_feature (5)..(243): n is a, c, g, or t
  misc_feature (266)..(334): n is a, c, g, or t
  misc_feature (343)..(423): n is a, c, g, or t
  misc_feature (665)..(680): n is a, c, g, or t
  misc_feature (682)..(730): n is a, c, g, or t
  misc_feature (767)..(813): n is a, c, g, or t
  misc_feature (822)..(840): n is a, c, g, or t
  misc_feature (851)..(868): n is a, c, g, or t
  misc_feature (870)..(913): n is a, c, g, or t
  misc_feature (923)..(949): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgaaggattgtatgaaaatnnnnnnnnnnnnnnnnnnnnnnnnnnnnnnnnnnnnnnnnnnnnnnnnnnnnnnnnnnnnnnnnnnnnntctacaatnnnnnnnnnnnnnnnnnnnnnnnnnnnnnnnnnnnnnnnnnnnnnnnnnnnnnnnnnnnnnnnnnnnnnnnnnnnnnnnnngattaaaatttagatttgatgattataatagtattataaaattacatatgtatttaaaatatatatctataataaaggaattcgtgaacgtttttttcacctgtatattgaaaacaagactttttgtatttaatataaagtgtcgcctgaccgctgattaatttgaattgccgcgggattttgaccgttctaagggaccaaattacttatttttttgattgaaaactggaatgaaggcttgnnnnnnnnnnnnnnnncnnnnnnnnnnnnnnnnnnnnnnnnnnnnnnnnnnnnnnnnnnnnnnnnnatttctttaaaaagacgaccaagaccccaataaagcnnnnnnnnnnnnnnnnnnnnnnnnnnnnnnnnnnnnnnnnnnnnnnnatattaacnnnnnnnnnnnnnnnnnnngcggtgcattnnnnnnnnnnnnnnnnnncnnnnnnnnnnnnnnnnnnnnnnnnnnnnnnnnnnnnnnnnnnnnggcccaatcnnnnnnnnnnnnnnnnnnnnnnnnnnncccttt

SEQ ID NO: 17616 - DNA, 787 bp, Diabrotica virgifera
  misc_feature (474)..(495): n is a, c, g, or t
  misc_feature (706)..(721): n is a, c, g, or t
atttattgtaataaaaatttagtatactatcttgttttctaaaggagatattcaagcttcctaattatgatatttaattgtttcattttttcagttgttcttgcagttactctggcttacagcccagagatcaagaagatcgtaggaggtaaaagcggttatggtaccaccacccgttactgggattgctgcaaaccgtcatgtgcttggaaagaaaacatcaaaacaccagacatggagccaattgctacttgctctacagatggtgtaaccgttgtcaatgcatctgttcaatcaggatgtatcggcggaacgtcttatatgtgcaataatcaacagcccttcgttgtgaatgaaacccttggatatggttttgctgcagtttctttctccggtggtgttgacaatgacttgtgttgctcttgttatttgcttacattccaaaatcaaattaataacaaaaagctggttctnnnnnnnnnnnnnnnnnnnnnngaccttggttcaaaccaatttgacatcgcccttcccggaggtggcgttggagcattcaatcaaggatgtcacgaccaatggaatgctccatggactggctggggtcagcagtatggaggaatttcatcaagagaagaatgtctttcgctccttcctaaagaattgcaatctggatgtcttttccgatttgactttatgcaaaatgctaacnnnnnnnnnnnnnnnntcgaacaagttgaatgtcctgccgaactagtcaaaattagtggatgtagtcttccactttaaatac

SEQ ID NO: 17617 - DNA, 833 bp, Diabrotica virgifera
  misc_feature (2)..(56): n is a, c, g, or t
  misc_feature (90)..(109): n is a, c, g, or t
  misc_feature (114)..(272): n is a, c, g, or t
  misc_feature (275)..(305): n is a, c, g, or t
  misc_feature (311)..(402): n is a, c, g, or t
  misc_feature (416)..(433): n is a, c, g, or t
  misc_feature (459)..(486): n is a, c, g, or t
  misc_feature (489)..(545): n is a, c, g, or t
  misc_feature (559)..(613): n is a, c, g, or t
  misc_feature (615)..(676): n is a, c, g, or t
  misc_feature (683)..(798): n is a, c, g, or t
  misc_feature (800)..(832): n is a, c, g, or t
gnnnnnnnnnnnnnnnnnnnnnnnnnnnnnnnnnnnnnnnnnnnnnnnnnnnnnnngaggaaaagaggggagggggagaccgcccccccnnnnnnnnnnnnnnnnnnnncaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnnnnnnnnnnnnnnnnnnnnnnnnnnnnnnngcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagggggagaagnnnnnnnnnnnnnnnnnntcccccctctcacccacaaaagagannnnnnnnnnnnnnnnnnnnnnnnnnnntgnnnnnnnnnnnnnnnnnnnnnnnnnnnnnnnnnnnnnnnnnnnnnnnnnnnnnnnnncaaaaatagatagnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnngtgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnng

SEQ ID NO: 17618 - DNA, 708 bp, Diabrotica virgifera
  misc_feature (2)..(59): n is a, c, g, or t
gnnnnnnnnnnnnnnnnnnnnnnnnnnnnnnnnnnnnnnnnnnnnnnnnnnnnnnnnnnatatgttgatgacgaagcccttcgtgcattgtttgggaatctatgagaatgtgatataggccagagtctaaagtggattcagagtcaatagggagagatacaatggttggagctatagaacaacttacagtagatgagtttgagaatagatatactcaaggcagggatactatattgtcaccactcccagaacttagttagtccagattagaataccatatgataggtgaagatcgtggttatgacaacccaagttttgcctgtaaagaaaaaaagtatgaagtggatgagagtgatcccacaggaggacatgcacagaacatacagcaatcaataaacgtttatgaaattgactagggtgaaaaccatgtggcatattacctactctgaatgattagtacgacctgctagcttcatggtaacggatcccggagcagatgatggatcttcgggagttctaatttgtgctgaaacttatttgacctacaaaaaattgggagaccaccataatattcgtctgcccatacctccgaataaggaaagattgacatgctcctgaaagagaaatgatatttggttgagcagctacgcacaaaacaatatcgatagctcttttctctggcttgccctgagcaaggagatcatttta

SEQ ID NO: 17619 - DNA, 952 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(496): n is a, c, g, or t
  misc_feature (634)..(683): n is a, c, g, or t
  misc_feature (688)..(796): n is a, c, g, or t
  misc_feature (799)..(844): n is a, c, g, or t
  misc_feature (852)..(926): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnncttaaaaattagatatatttaaaaac

SEQ ID NO: 17620 - DNA, 94 bp, Diabrotica virgifera
  misc_feature (25)..(50): n is a, c, g, or t
cgattaaagaataaatctcccttcnnnnnnnnnnnnnnnnnnnnnnnnnnctttttgatcccactcctttgattacaataataatttaccctta

SEQ ID NO: 17621 - DNA, 800 bp, Diabrotica virgifera
  misc_feature (2)..(772): n is a, c, g, or t
  misc_feature (776)..(776): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtanaagcttaatttttttaaagacgag

SEQ ID NO: 17622 - DNA, 893 bp, Diabrotica virgifera
  misc_feature (592)..(607): n is a, c, g, or t
tcctgcttaaataactatcttaaataggtcggtcggaagaagaagatggggcgacctaatttcagatatctgaacgatgtgcgggaagatttaagagagattgggaaggtgtaaatatctaaatgaacagtattattttatcacacaagacacaaaccacgtaaacaataaaatcagaaatttcttatgaatattatttaacgaaattgttatggagtaatacaaacaagctcctcccaattttgtgacgtcagacttaaactgtctgaaatgaaaacgttttttaaacgtattttaacgtcattaatcttacgtatttaaaatcacctacaaaagacgtctatatgacgtaattttcaaacacgtgtatatattcaaccaaaactgacatttcctcgacgttacaatatgacgttacttggttgcctggatactgaacggaggaacgccacgatgctaagatggccgcgctagccccgtccctagtggctacaaatcaacgaaatttctggataaccctcgtattaacaatcattagttggttagttagaacggtttggtcgctaaaacaccaaaaattatctgggaacannnnnnnnnnnnnnnnataggctatatttcttattggtaaaatgtgtagctgacgcaataattcaagtgtatagaaacgttgttttgtaattaaaaattttattcgtgcttaaaattggcgggcgtatagagatcctccaagaggtgattccatatatttattaaatgtatatttatacacataagttgctatcagaagatcattatatatagaacatatatcactgcttctgcgttaatttttgtatttataaaagtcattgatcgttgttgttgtattctgcagcgttatcatatttttt

SEQ ID NO: 17623 - DNA, 845 bp, Diabrotica virgifera
  misc_feature (32)..(50): n is a, c, g, or t
  misc_feature (126)..(146): n is a, c, g, or t
  misc_feature (190)..(213): n is a, c, g, or t
  misc_feature (276)..(289): n is a, c, g, or t
  misc_feature (292)..(308): n is a, c, g, or t
  misc_feature (420)..(438): n is a, c, g, or t
  misc_feature (682)..(705): n is a, c, g, or t
  misc_feature (739)..(739): n is a, c, g, or t
caacgcactgtatcttgaaaatggatggcatnnnnnnnnnnnnnnnnnnngcaaaccccaattatttttcagttttttaccttttctagtgacggtgttaccttttttgaaaaatatgtataaaannnnnnnnnnnnnnnnnnnnnaaccgagaaaatgcggttttttatttttaaaggtgcgtttcacnnnnnnnnnnnnnnnnnnnnnnnncagggtgaaatattatgcaaaaatacacgttatatatttttttcgtgaaaacgagtgtcttannnnnnnnnnnnnntcnnnnnnnnnnnnnnnnncgttctaaaatttaaatttcccgccaaagattaaaaaaaattttcggacataactttttaaagcttacaacttttttatttaaagtttttcgctagttctcgatgcggctgnnnnnnnnnnnnnnnnnnnaaaaagcctaattaggctctaggtgggtcatatgaccacctagggggctaaaaatttcagaaagttagtttcactatatgtgctaaacggtgaccaatatggaattcgaatcgagttgggggcagttttcatcatcttacccagttaggccctttgaacataataagtaaaagtttattacattgctaaattaatgtctactctagaaattaatatagatacaatgataattctttgccttatnnnnnnnnnnnnnnnnnnnnnnnncttgaagaaggtggcaggcagcatgatctgctgngtctgcaataaggaccatgtcgtcttcaaacctcaagttattcaaaaacaccccatttatgttgagtccgatattttcccaatgattgttcctcgtagcactctat

SEQ ID NO: 17624 - DNA, 1020 bp, Diabrotica virgifera
  misc_feature (57)..(74): n is a, c, g, or t
  misc_feature (701)..(722): n is a, c, g, or t
ggcgaccttgccttgccgtggattgtttttagttgtttgtattatttgtgctttttnnnnnnnnnnnnnnnnnncggatacttttataatagctttaatagtattattaacatagtgcataaaatggtgtcctgtttttaacgcagttggagtagcagaaacaaatgtagataaaaaaatctgcaggaataacgtttcaattatgacagaagctcaaaacaaaacttgcggttagcgaaaaccaaatactttggcttcggagcttctagacaattgacagttataaattattggggacttagaaattttacacccgtattttgaatttctctaatagatggtttgtttaaaccccaaattttcctttaaggttttttcttattaattgaaaacaatcatttttgtttaagaatatttttattatgtgaaatatttatgtttttctttggtagtaggtaccgtctatttatgaaccttggtaggtacctactgtttttgatgtggtaataatataactttcataatatggttaattatttgactgtaatttataactttcctatggttaattattctatagagaaattcaaaatactggtaaaattgttaagtccccaagaggccaagaggtaccgaactataagtaacatatcctatacatacatataggtacatattattataaggtacctacatgacannnnnnnnnnnnnnnnnnnnnnctaatatgtactataatataattaggtgaataagtatatttttgaatttcatttacctttatatagataatctacaaagcgaagtgaggtttttcattttctgcctttaactcaaatgaagaataagttgtatatgatgattaaggattaaagggactatatatatactttttcaattgccccgccaaacccaatgaactgggaattggtttaaaaaccacccaagacttattttttgctttttctatacagcaaggcgtgtctttagggcccgtttatggagaggcccaaataaaaa

SEQ ID NO: 17625 - DNA, 699 bp, Diabrotica virgifera
  misc_feature (657)..(675): n is a, c, g, or t
gagaaagagcattcatcagtctacatcagtctttagctaattgcgtatcagtaattagtcagtgttcggaagtactcccggggtagaattaccctagtgtcggttctatcaataaatacctttatcgctattcggtgtttatatccttatctttatacaccaagacaccgaggtccaggtgttagtctgttgcaatccgcatagttactggtgcggagagaagaccgtcccctgtcacttttatacagctgggagttgtaaaagagggtccagttgcagataccagcatccagttccagtcccgacaaggttccagtaggaaccatcttttaaggagggggcaatgcgacgctgtttataacagtctgctcagagattggcctatcctgactgaacaatctagtcgttgctggagaacgcgcgaaacagctattccttttccacggcgttcggggcgagcgctgccgaagtatatataggaccgaaattcgggcacaggccagtcagtcaatgaacgagccgcgacgcgtaatataattgtactcgattcggatttaataaaatgtatatattagttatcgaagttattatgtttagttagttaaatcataaatttgagttgtaaataaattagatgtgttagttggtgtcatttgnnnnnnnnnnnnnnnnnnngtgatgtaaataaaataatataag

SEQ ID NO: 17626 - DNA, 959 bp, Diabrotica virgifera
  misc_feature (802)..(802): n is a, c, g, or t
gaagattactacggataagaagagaaaggaagcagccatcgaaagagagaaaaaggttactatttacaggagttacaggaaaggggactttcccgatgttcagatatccttgtcggctcttttgaaacctttgcaggctttggctttgcacgatagcgagatgtcaaagatcctcttcttggaaatatttaaaggcctcgctaacaaaatagaaaacaatcaacgattcctttcttcggtgccagatagcatcaaaaatatcttccaatcatcagtgtcattcaaccgatacctatttgctgctctcttggacattttgctgaaaaacaaagagaaaatggtatttgatccaaaacttatttcttatgttgcgcaagaaagtggtttggcctctacaggggcacttttaattgaagagtatcttatatcaggtgtaggggatgacatgcctagtactagtaaacggaaatttagagaagatgattgggagactgttagctggattaaattggcagagttatataaagaactcgaagagtgggataccgttcgagctatcttcttagaaaaaatggactgtaaacgagacctacaaaaagccatcacctatgagtcaaaacatttttacaaagatgctgctgacctttataaaaagttgatctcatctgatgaatcgcacaacagaagagatttctactacgacgcctatttcaaatgctttgccaatcttggccaatgggaaactatccccaatgctgtagcgactgttgtaggtactgaagacacgtggaagagcctttgngaagacgagtggtcccaacaaaagcttctgccgtggtatataaacatccacgtgaaaaatcagttatttacacaagaaactgacgaagagtttttgactaattttgacagttgtttatcagatgccaaagtgaagagtatcttaatacccatttttc

SEQ ID NO: 17627 - DNA, 449 bp, Diabrotica virgifera
  misc_feature (27)..(45): n is a, c, g, or t
  misc_feature (58)..(78): n is a, c, g, or t
  misc_feature (123)..(167): n is a, c, g, or t
  misc_feature (186)..(219): n is a, c, g, or t
  misc_feature (228)..(259): n is a, c, g, or t
  misc_feature (287)..(300): n is a, c, g, or t
  misc_feature (302)..(352): n is a, c, g, or t
gaccgtgtggcttgtaatattgatgcnnnnnnnnnnnnnnnnnnncaaatcaagatcnnnnnnnnnnnnnnnnnnnnngagattattattttacgttgttttttttaggaagtgattttttcnnnnnnnnnnnnnnnnnnnnnnnnnnnnnnnnnnnnnnnnnnnnnctatatatttatgattagnnnnnnnnnnnnnnnnnnnnnnnnnnnnnnnnnngtagacatnnnnnnnnnnnnnnnnnnnnnnnnnnnnnnnnctataagttagtattgagaattttgacnnnnnnnnnnnnnngnnnnnnnnnnnnnnnnnnnnnnnnnnnnnnnnnnnnnnnnnnnnnnnnnnncaacacattatttcatgtatttgaatattattaatgatgggataatttgcattagttgtttgtatatatattggacattcatagtattaactctagg

SEQ ID NO: 17628 - DNA, 111 bp, Diabrotica virgifera
  misc_feature (7)..(44): n is a, c, g, or t
  misc_feature (82)..(104): n is a, c, g, or t
taacagnnnnnnnnnnnnnnnnnnnnnnnnnnnnnnnnnnnnnntgcggacctcgatgttggattaaagtttataattgggnnnnnnnnnnnnnnnnnnnnnnntgttcga

SEQ ID NO: 17629 - DNA, 101 bp, Diabrotica virgifera
gaagctggtcgcctgcagtccggtccggattccgggtcgcccctcgtcgctttcaccaggcatcacagctgagtttgatttaagttttcagttcaacatgt

SEQ ID NO: 17630 - DNA, 918 bp, Diabrotica virgifera
  misc_feature (59)..(86): n is a, c, g, or t
  misc_feature (189)..(211): n is a, c, g, or t
  misc_feature (584)..(603): n is a, c, g, or t
  misc_feature (874)..(892): n is a, c, g, or t
acttaacattgaggattccgaacaaaaaaaaacttacttcataaaatatttcatacacnnnnnnnnnnnnnnnnnnnnnnnnnnnncacattttacaccacacatggcagtacttttggtgttatgatttctaactgacaaatattatttaattttagtaggtagtcataaaatattttgaggtagtcnnnnnnnnnnnnnnnnnnnnnnncaaactagtgcgcacagcgaatggacgaattgacaactacgaacacagcccaaatttcggcgaatcagctgttcgtgttaatgcgcagcctttgatgctttgatgcacacacgaatcatgtttacgaatcggtttttaacgaagaagacactacactacacactattcgtgaactgcacgcgaatcgcgcatcacgaatcgcgaatacgtgcatagtctgtagccacctttactatattatatacagaatgaatacatcagaaatgaactcaacacttgatagtgcatacttttataaccatcaacatgtactgacaatttattgggaattcagaaggcacttattggatttgtttattgtcttttgatatgnnnnnnnnnnnnnnnnnnnngttgttttatttgaatgctagcaatatccgtaacttttgacgaactccaaaagtttagtgtgtttaagtcctcgatgtagttatggagctctgttaacttaaatgatgaatttcgtcttattcagtatgtatgtaagtttgtgtaaatagaacacaatctacttttagaaaatctaatgatcagtagttaatattaatttgtagctttgagagaacctgaaaattttccagtactgtgaatggatttgataagtcgcttgctgggggggcnnnnnnnnnnnnnnnnnnncaatgaatcgctttttggggaaaccc

SEQ ID NO: 17631 - DNA, 858 bp, Diabrotica virgifera
  misc_feature (32)..(47): n is a, c, g, or t
  misc_feature (50)..(82): n is a, c, g, or t
  misc_feature (203)..(250): n is a, c, g, or t
  misc_feature (278)..(316): n is a, c, g, or t
  misc_feature (318)..(372): n is a, c, g, or t
  misc_feature (379)..(426): n is a, c, g, or t
  misc_feature (483)..(509): n is a, c, g, or t
  misc_feature (549)..(565): n is a, c, g, or t
  misc_feature (567)..(581): n is a, c, g, or t
  misc_feature (745)..(774): n is a, c, g, or t
ccttttgagtccgcagccgattacaagaactnnnnnnnnnnnnnnnnagnnnnnnnnnnnnnnnnnnnnnnnnnnnnnnnnncgctgatcccgttgcctttatgaagaatttcatccctctagaatttattgtttgtaccttgggaatcaagaaatattaactaaaaaatatagatttattattttcgaagttaaaatagctnnnnnnnnnnnnnnnnnnnnnnnnnnnnnnnnnnnnnnnnnnnnnnnntatactgaaatgtaattctttttttgtnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnngtaggtnnnnnnnnnnnnnnnnnnnnnnnnnnnnnnnnnnnnnnnnnnnnnnnncaatcataaattttcatattttaggatatagcgattatttataattatatataatannnnnnnnnnnnnnnnnnnnnnnnnnntaaaatatcaatcgtaacttatttagattaaataataggnnnnnnnnnnnnnnnnngnnnnnnnnnnnnnnnaaacttaatatataagttattgaaagttattgctgacgcatttttttcacctgtaacattaaaagatatgcatttgtgtgtaaaatataaaagactcttctgcctacttgattaatttgaatgggcatcgactgtttttattgttgctaaagaaagaattgatnnnnnnnnnnnnnnnnnnnnnnnnnnnnnngcaatttccttatggaattacaatactgactttattttaattatatgataaattatcattttttaagttatcaagcttaaattt

SEQ ID NO: 17632 - DNA, 916 bp, Diabrotica virgifera
  misc_feature (167)..(184): n is a, c, g, or t
  misc_feature (802)..(802): n is a, c, g, or t
  misc_feature (882)..(899): n is a, c, g, or t
gacagactcaatcaggaaataaatcctctttaaaaattgccttgtcagcatataaacacgagggtttgaggggtttatatagaggtttttgctcaacaatattgagagaaataccattctcagttatacagtttccaatactggagtatttgaagaaaagttatagnnnnnnnnnnnnnnnnnncatacatctcgactcttgggaagttgcagtatgtggatcgatagcaggtggtgtttcagctgccgtaacaactccattagatgtagcaaaaactagaattatgttggctgatagaaagcaggtcagggcaggagaaatgacagttgcaaatacgctaaagcaaatttatcgcaccgaaggcgttaaagggttattttccggctttgttcccagggttatgtggatcactttagggggttgtattttcttcggtagttacgattttgcaaaaggtacatgcttgcaacttatagataaagacatcgaatattaaagaatgtatttgttcagtaaagaataatcaattgttcaagagcgtgttaaaaacagttcagttaaaacagtatttttagatttttaaataattaaatgagtatatacgttttttttctgcgaatttggttgcatgtcattgaatagatgtttggttttattttgactgttcagcttcgtcaaattttctgagttgcagggaatgcagggaaatttcaaacgagaaaacttaaacttatttccactcttcaacatgaacatgattgaaaaataattttataatccagaattatactatcatgctcnaaagatgcatccacaaaaaattaaggcatttgaaatgtggatttatatgatactcgagattcccttgaattatcatatannnnnnnnnnnnnnnnnnagaaaactaaataaaga

SEQ ID NO: 17633 - DNA, 961 bp, Diabrotica virgifera
  misc_feature (120)..(148): n is a, c, g, or t
  misc_feature (189)..(208): n is a, c, g, or t
  misc_feature (267)..(287): n is a, c, g, or t
  misc_feature (355)..(387): n is a, c, g, or t
  misc_feature (414)..(473): n is a, c, g, or t
  misc_feature (482)..(529): n is a, c, g, or t
  misc_feature (710)..(727): n is a, c, g, or t
  misc_feature (818)..(837): n is a, c, g, or t
  misc_feature (846)..(869): n is a, c, g, or t
  misc_feature (886)..(911): n is a, c, g, or t
  misc_feature (931)..(960): n is a, c, g, or t
gttcggtgcgcggactgataacagacgatcttttgtactctaccataatcgtttgagaaaagtattagagaaataaaacaaaattgtcacacgatgaaactgtatttcttgaagcttgannnnnnnnnnnnnnnnnnnnnnnnnnnnncacttattattttcgagtttaaaagagctaaaaaactatgnnnnnnnnnnnnnnnnnnnngattttaaataagtattttgcaacgaaatgtaattcgtctttaaaaatatctaatatgnnnnnnnnnnnnnnnnnnnnnatcatattaacaatatatctataatataaatagttgtatattattaatattagatattttgagggagnnnnnnnnnnnnnnnnnnnnnnnnnnnnnnnnnctttcaagtaaaaattaggatgaaagnnnnnnnnnnnnnnnnnnnnnnnnnnnnnnnnnnnnnnnnnnnnnnnnnnnnnnnnnnnntaaattctnnnnnnnnnnnnnnnnnnnnnnnnnnnnnnnnnnnnnnnnnnnnnnnncatcagaagtaaaaaattgcatatgtagaaagaatatataggtttttaagaggaattcgccagcatttttttcacccgtttagtaagatcatgtgcccttgcataaaagatagagactcgtctgaccactgactaatttgaacggtcgcgacattttgaacgtgctaaggaacaataaccnnnnnnnnnnnnnnnnnncgccgcaaaggaacttggtatggagaacaaaactggctttatccaattaaccaagaattctcatctttaagctaacaacgctcaactttgnnnnnnnnnnnnnnnnnnnnccctataannnnnnnnnnnnnnnnnnnnnnnntgtttttttaaggaacnnnnnnnnnnnnnnnnnnnnnnnnnnctattttaatttgggcgggnnnnnnnnnnnnnnnnnnnnnnnnnnnnnnt

SEQ ID NO: 17634 - DNA, 990 bp, Diabrotica virgifera
  misc_feature (671)..(689): n is a, c, g, or t
  misc_feature (790)..(808): n is a, c, g, or t
  misc_feature (811)..(823): n is a, c, g, or t
  misc_feature (893)..(914): n is a, c, g, or t
aacgactttattgatcagttgaaatgtagcgcttaaacagacaagacatatatcacaaatagcttttgcagctctaaatacttcttttcactataactagctattaggtaaaggagacgatgtggccacatccatgttgtcatccaaaaaatcactaaaagcaagcgaatcttgcccttttgagtcgaaggtaaattcggtacccaacctttcaaacattgagtatgttgctgtcaaaagattttctacttcgagcaattcaatcctctgttgttccctacatttaattagttgctgttccacactttttatgtcgaattcctggttgtgattatactctttcattgtttgtaacattggtgttaggtcagtggctgttctctttatctcagctatcattctagctgcttcttttccagacaacatcttggcgtaggtatcttccatttctactgcttcgtcttcaattggtgcttgagaatcaattttgttatcacttttatcttgttgatgttttgcagccatatttttagttgaaatatcttcacttttggcactattctgatctactgtcgcttcagatcttatagttacatctatatcttctacttctactccattatcgtattttggagctaagctttcagttaatgttagaacatcttgtgctnnnnnnnnnnnnnnnnnnntaagtcgagttaattcagcatgtaatcgtaaaattacctgtttactaggttcttctttatctgctgaacgttttttactatcttctctaaccattattgtnnnnnnnnnnnnnnnnnnnacnnnnnnnnnnnnnattggtagattgttggtgctatttgaaattttcgtataaactgtgatataatttttattggtatttatgnnnnnnnnnnnnnnnnnnnnnnctttcatgaagttgagatagtgtgtaaggtatacactgaattatgtaatttgcaaataaataaaataattgattcc

SEQ ID NO: 17635 - DNA, 573 bp, Diabrotica virgifera
  misc_feature (204)..(240): n is a, c, g, or t
cccccccatacgggcgtacaactttgtccagaaaaaggcggaatccccttttagcggaccggatgaacatattttttaatagtgagagggataccatggtgagagagaattttgtatgtataccaccaaactgcattgtttgagcccatgggatcaagaaagattgaatagaaaataacgcagttattttttttcgtagttacnnnnnnnnnnnnnnnnnnnnnnnnnnnnnnnnnnnnncgattttatagaatttttttgtcaccgaaaggctgttgctttttcaataatgtccatattgtttaagataacgaccaattgtgtctagacgccatatatttacaaaattattatttgtttattactactatgagagctttcgagggaggcgcgaaaaaacatgaggtttattgtgttgctctagcttccgtataagttacaaggattcgcgtgttctcaattagctaaagacactagttattatcaatctacttatatgttttgttgcccatgtactacaatattaaactataaattttaaacttatttatatctactaacgctcgcactcta

SEQ ID NO: 17636 - DNA, 167 bp, Diabrotica virgifera
  misc_feature (112)..(129): n is a, c, g, or t
ggtttattgggagatttggaaagtagtttataccagtacgtcactggaaagactccggctggttacgagtttatgatggggtagtttaacttgtatataaaattatatttgnnnnnnnnnnnnnnnnnntataataatgctgtaaatagtttcattttatttgaatt

SEQ ID NO: 17637 - DNA, 101 bp, Diabrotica virgifera
  misc_feature (10)..(76): n is a, c, g, or t
  misc_feature (83)..(83): n is a, c, g, or t
  misc_feature (92)..(92): n is a, c, g, or t
aagacgagannnnnnnnnnnnnnnnnnnnnnnnnnnnnnnnnnnnnnnnnnnnnnnnnnnnnnnnnnnnnnnnnnnatttatnttaattggnggtggataa

SEQ ID NO: 17638 - DNA, 153 bp, Diabrotica virgifera
ccttcggacaggacatttcagaaggtgtagcccataccaacggtctgtctttagtatctagggcgcatcgactcgtcatggagggttacttttggtgtcacgaaagatagtagtgaccattttcagcgcccccaattattgctaccgatgagg

SEQ ID NO: 17639 - DNA, 952 bp, Diabrotica virgifera
  misc_feature (172)..(172): n is a, c, g, or t
catactgacagaacttccatattttcaactaaatgaactgaacacttctattattaaaacaaaacataacactctaaacctacacgcaaagcagatataatgagaattatacttattgctttcaaaaacttcctacataccatgtcgcaactattatctttgaggaaacaanaactatgtacaacatattatctgatgggtagtatcgcaaaaactcattgcttgacagaccactattaatcctgtaggatcatagcatgccttacaatgtgttactattcaaacaatagttacatgtgaaatatacgcacacacactgacattgacatatataacaccgaacgtactaataagatacactttattagctcgaattatgtcaattgtagaacaccgagagattcaaacatatagagggagatcgtccatattatccaacacgagaacgtcattctaccagtgactgacaacttacttaatagtcacaagtagtgagctagagacttaatatcgtactctcatccatatagtaatatattagatgaccagccagaaactgtaacgatctctgagtagacatatgccatgtgataagagtcttatattatgaccgtatgttctctcatgaagacagatctccatttactatgacaactgaaagatgttcatctcaatcatacagcgttgtaactaagtcaatagtacatgtctatgtattctgtccagacatgtgagagcaatgatgctcaggaaaaatgagacgtatacgagtcatttctgtaaaagagtactcgatcactgtacatgctgatccccactactgcaatgatgatctaatatcaaaacaaattacaggaacatgtgaaaatagtccagaattatgttctaacctattaaaaaacgtagagcctacttttgctgagttttacttcaaatgttctgaacatacatc

SEQ ID NO: 17640 - DNA, 754 bp, Diabrotica virgifera
agccgggattcatgctccacgatgcattttctcttattactactctgtactgtacttgtgctgtaaggtgcgcatgtgacatctctcccccggctgtgattgacgtttaagacagacctttcaccgatgctcgcgcatcttgaagaaaagaaagttcgattgcacctattgtctcgaaatctccagagaaatgaagaccacagtgagagataccagaatggggacagatccctctacttgaagaaccatcagaactgaccctagatgtcctgagaggattcaacggcgtatgcattgagcttccacacctcattcacatattataaaagaatgatgacgtacacgatccgagcctgtgcctcaaatggctggaacttaatcaaatggatgaggatgaagaaactgatgaagaacaatatgatgactcagaatatcgccaacgaggtggtagactaaaggatctcgtggacctcgagattcaattcaatgacagggaacgcagagtagaagtactgagaacacgacagagatctgattgccccagaggagacgacaatcgcggcggcgatgctggtgtgaccgatggcgcatatgactacctaactaaacacagtgcttgacatagaccatgatgacggtatcataatgatagatggtgatgtgagacacggtgaccgccaagctcctaagcgtcatgacgtacgcgtcttcccctctcttcgataatgcatataccccagatggacgttctgta

SEQ ID NO: 17641 - DNA, 275 bp, Diabrotica virgifera
ttttaataccttgctgtgagcagacatcgatcaagagtgggtatatcttcactatttccgatattctagaaggtccgttatgagactttaaatggtgtagtacatagccaaggtaattttcttgcaatgacccgttatctccgcttgaagatataccacggtcaccaggcagcacgattaggatcatatactaccagaagatgtatcattcagttatgtttatatatagtaaaaaggtccattgttagggatgagattgccaacagatgtgtatt

SEQ ID NO: 17642 - DNA, 649 bp, Diabrotica virgifera
  misc_feature (481)..(515): n is a, c, g, or t
ccaagtgagagtgatgccagtatgttgcgttagaatcgaatagcaaacatcgattataattttttatcgagaagatcatttataaaaaaaataggagtaataaagtttcttgtgatgattggattaagaccacgcctacatacgcatgacatgagaaatctatgatattgcagagaagaatatgtacagacctatacgctggtttataactagactaccgccacatcgactctaatggcgcatatagaaacgacctggtcatcgaaaaaggcttgaaaaaaagtgtcgactctgcttgaatgacaaacacaatctcttcattgcctcctagctcccaggtccaggtatacatcccgatagattggaaaaagatctgaaaaaatcaatggctgacctgctgctgtattacctggatctttatcttatacgcttacctgacctacataatagaaggggaagagagtccacagaacaaacaagnnnnnnnnnnnnnnnnnnnnnnnnnnnnnnnnnnncggtctctcgtgggacgaacaatcatatatgaggactcctgtttcaacgtacatctcatccataaagtgttgaaattcagcagaatcaacacagctatgcattctatccaacttcacgtgttcctacaacaacc

SEQ ID NO: 17643 - DNA, 893 bp, Diabrotica virgifera
  misc_feature (670)..(671): n is a, c, g, or t
  misc_feature (710)..(710): n is a, c, g, or t
  misc_feature (735)..(735): n is a, c, g, or t
  misc_feature (794)..(794): n is a, c, g, or t
  misc_feature (822)..(822): n is a, c, g, or t
  misc_feature (828)..(829): n is a, c, g, or t
  misc_feature (842)..(842): n is a, c, g, or t
  misc_feature (850)..(850): n is a, c, g, or t
agaacagctgatgttaaatgttatctattggcttccaccccttattttcattttcaatattctatgaagattattatcagagttattcagtattactaaaaaatgaatcgtcagcctccaacgtacggagctatagctccgtcaacacaagtggtatttagtgatcaagtagctacggaattcaataatagctcagaaaacgttgttactaatatttatacaataaacaacagtatcaaagttttgggaaatgctttaaaagtaattggaaccaaaaaagacaaccaaggcataagaagccaagttcatgtcacgcaattaagtacaaatcaaatagctgccagtactagtaaggaaattgttaatttaaaacagctttcaaaaggacacaaacaaagacttcttcaagttgaaaaattagaagaaaatttcaaagaagcactagggaggtatcataatttgcaaaaggatgtggccaataagcaaaaattgcatttattggtaccctcagaaagcgtggaggaaacagcacaagatgataatgatgaacagcaaatgcaggctcaaaaaactagagagttggcatttgaacaagacatgttaatagagcgagaaagtagaattatgcagatagaatccgacattttagatgttaatcaaattatgaggnnagttggggtccatagtacatagccaaggagggaccatanggtctaaagttgtcgctgcatgtgngagagcaaattaatagcaacacccaaaaacgccattttcattcagtatcagtccattcngtcaagaaagtcaagcagacgcgaaccnacgcgnnagtttttattttngctttttngtattgaaaagatagactaagataggggagattaaagtgatac

SEQ ID NO: 17644 - DNA, 132 bp, Diabrotica virgifera
  misc_feature (41)..(41): n is a, c, g, or t
  misc_feature (65)..(78): n is a, c, g, or t
  misc_feature (81)..(96): n is a, c, g, or t
  misc_feature (118)..(118): n is a, c, g, or t
taacagcgtaattttattgggagagttcaaatcgataatanagattgcgacctcgatgttggatnnnnnnnnnnnnnnggnnnnnnnnnnnnnnnnattaagtctgttcgacttttanaatttacatgatct

SEQ ID NO: 17645 - DNA, 755 bp, Diabrotica virgifera
cgtccgcacaggttatatatcaccgtagagatattatttagcagtcctgtttaataaaattcttcatagttcaccatgacaggctgtgacgtattcgacatcgacaacgcttatttcggaggactgtgttcgccgacttgaaatgtgtgatcctgaagccatcggactatttgaattagccccagcgtgatatgcttgaatatctaacactgaacttgtcagcgactgagtatgcaacttttttggacacaggaccctcaccatttgacagtattcgcggcctcaagtcataacgtccagaaaaactcgggattgagtgccaggacatgcgtgacccattggtaaagtctctctcgacatgtatgaacttcattacctacagatatatgatccacaacataatattgcttattacagccactcttcaccagagaccagtcactgaattaatcgcctaaatgccaccctctatacagtattcgagaaagtgaaagacatccacgtaactgctactccagatgacatagactacgctggattggcgaacacaccagcttgctccattcttcgttgacctgcatcatacgaacaatatatgaatgcaacgaacgatgacatcatcataaacaacatatacaaagcttacttgaaagaattttataccttctgcaagcgaattgtaggaactactgccgatagcatgtgtgaaatgttgacttttgagtgagatacacgtcgctatgatgattaccatc

SEQ ID NO: 17646 - DNA, 377 bp, Diabrotica virgifera
  misc_feature (159)..(207): n is a, c, g, or t
cccccttgggccccgcgaatttaagtcccaagatgtctagacccctttggaaaccccggtacattgctagtgtaactacatatttatgacttgtgcatttaacaaagctagcagtctgtgccccggtctggtccacaatgatgtcggatcctgtgtagnnnnnnnnnnnnnnnnnnnnnnnnnnnnnnnnnnnnnnnnnnnnnnnnntggtagaaacatcaatgatgctgataactagatctacctagacttagtggattcctgatcatccaattctacttatgacgttggaatcacccaatctatacgctaggctctggacaatggatgatgtcacaccttccacatagtccgccgctattctccgagagcactgc

SEQ ID NO: 17647 - DNA, 587 bp, Diabrotica virgifera
  misc_feature (4)..(44): n is a, c, g, or t
  misc_feature (49)..(257): n is a, c, g, or t
  misc_feature (259)..(291): n is a, c, g, or t
  misc_feature (293)..(305): n is a, c, g, or t
  misc_feature (343)..(391): n is a, c, g, or t
  misc_feature (393)..(435): n is a, c, g, or t
  misc_feature (437)..(458): n is a, c, g, or t
  misc_feature (460)..(481): n is a, c, g, or t
  misc_feature (485)..(502): n is a, c, g, or t
  misc_feature (509)..(536): n is a, c, g, or t
  misc_feature (565)..(582): n is a, c, g, or t
cttnnnnnnnnnnnnnnnnnnnnnnnnnnnnnnnnnnnnnnnnntagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnannnnnnnnnnnnnttgaatgaccgcgatattttgaccgagctatggtagtnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnannnnnnnnnnnnnnnnnnnnnntnnnnnnnnnnnnnnnnnnnnnnattnnnnnnnnnnnnnnnnnnattttannnnnnnnnnnnnnnnnnnnnnnnnnnngtatgtaatagtgtgattaaaaatagaannnnnnnnnnnnnnnnnngatat

SEQ ID NO: 17648 - DNA, 76 bp, Diabrotica virgifera
  misc_feature (3)..(23): n is a, c, g, or t
  misc_feature (28)..(74): n is a, c, g, or t
ctnnnnnnnnnnnnnnnnnnnnnccccnnnnnnnnnnnnnnnnnnnnnnnnnnnnnnnnnnnnnnnnnnnnnnnat

SEQ ID NO: 17649 - DNA, 55 bp, Diabrotica virgifera
  misc_feature (9)..(45): n is a, c, g, or t
attattaannnnnnnnnnnnnnnnnnnnnnnnnnnnnnnnnnnnnatttatttaa

SEQ ID NO: 17650 - DNA, 743 bp, Diabrotica virgifera
  misc_feature (2)..(677): n is a, c, g, or t
  misc_feature (687)..(738): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcnnnnnnnnnnnnnnnnnnnnnnnnnnnnnnnnnnnnnnnnnnnnnnnnnnnnaataa

SEQ ID NO: 17651 - DNA, 89 bp, Diabrotica virgifera
  misc_feature (10)..(87): n is a, c, g, or t
gttaaaagcnnnnnnnnnnnnnnnnnnnnnnnnnnnnnnnnnnnnnnnnnnnnnnnnnnnnnnnnnnnnnnnnnnnnnnnnnnnnnnca

SEQ ID NO: 17652 - DNA, 869 bp, Diabrotica virgifera
  misc_feature (227)..(241): n is a, c, g, or t
  misc_feature (555)..(580): n is a, c, g, or t
  misc_feature (805)..(805): n is a, c, g, or t
  misc_feature (833)..(833): n is a, c, g, or t
ggagcctaagaaggaacgtaccagtgctacatttgattctgcagaccttaagaaatctataaaaaccgaagaagaagaagatggtgtctcttgcgaaggcatccaaaatgatgaatgcaatgcaatattaaaatatcccggaaataactttaaccaaaatttaactgctactacagatgtgaacagagaagaaaaatattttgaatgtgaaatatgctccaaacaannnnnnnnnnnnnnntctttaacaatacatatgacagtgcatactggtgaaaaaccatttgaatgtgaaatttgcaagaaacagttttcattgaaagtatatttgaaatcgcatattatgagtgtgcatactggtgaaaaaccgtttaatagtgaaatttgcaccaaaacgttttcaaggaaacaaattttaaagtcgcatatgagagtgcatactgtcgaaaaaccatttaaatgcgaaatttgcaccaaacagtttgcaagaaacacacatttaactagacatatgatagttcataccggtgaaaaactatttgaatgtgaaatttnnnnnnnnnnnnnnnnnnnnnnnnnntctttaacaatacatatggcagtgcatactggtgaaaaaccatttgaatgtgaaatttgcaagaaacagtttgcattgaaagtatatttgaaatcgcatattatgagtgtgcatactggtgaaaaaccgtttaattgtgaaatttgcaccaaaaggttttcacggaagcacggtttaaagtttcatatgagaaggcatactggtgaaaaacctttcgcatgcaanatatgcaccaaacagttttccaggaaangaaatttcaagtcgcatatgagagtgcatactatta

SEQ ID NO: 17653 - DNA, 906 bp, Diabrotica virgifera
  misc_feature (370)..(384): n is a, c, g, or t
  misc_feature (888)..(888): n is a, c, g, or t
gaagctcacatgtaaatagaaacatggaagaaacgaatggtgaaaatcaaagtaaaaatttaatagaacagtatttgaccacttcgaacatttaattagtgcaaatgaaaagaatcgaataaaaggcagtttaaatatactaaaacattttaatactgtccaggaaaaagatattgaagtaaatcatgcattgacaaggattataagaggtttgggatcgtccactaacatccccaggacaggattttacactattttagtcgctttgctaaattttagaaatgatatatctctatcacagatttttgaccttatggagaaacatttgcataaagcagggagtaatgcaaaatcggaaaatgcagatatnnnnnnnnnnnnnnnattagcatgcggggcaatcgtccgatcaaatctttggtctaaaacaactcatgaagaaaagttaaaaattgttgaatgtatcttaactgccagtaaagaacgtacttatcaaggattactagcgtttgagttcatcacaaacatatttgaaaaagttgaagacaaagatttttatgctttgtgtcccttgttgaaagatgaagtgtcaaaaccacttgaaaattatactttggattctttatatttactaaacaacatgaagaaaaaatatccacaactaccaaaaaaattgaaatctgttatagtgtatcctgaagttttatctgaagaaaatataggaaaattgtgtcggattttaatgatcattcccaaattatcttccctacaacatcctgtttatgacattataagcattgaagcagcaacatccagcaacttgaaccattttctagaagaactagattggtacttagacataccaaacagggaataacttcttgtcgncacaaatatacaccatac

SEQ ID NO: 17654 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17655 - DNA, 548 bp, Diabrotica virgifera
  misc_feature (6)..(42): n is a, c, g, or t
  misc_feature (58)..(76): n is a, c, g, or t
  misc_feature (121)..(139): n is a, c, g, or t
tttagnnnnnnnnnnnnnnnnnnnnnnnnnnnnnnnnnnnnnacctttcgttactagnnnnnnnnnnnnnnnnnnngatagaaagccaacctggctcacaccggatgagactcaaatcatnnnnnnnnnnnnnnnnnnnacagacttattaatatagatgatacaccaattataaactttaatccaacatcgaggtcgcaatctttatgatctaatagaactctccaatacaattacgctattatcgcgaaagtaagttattcttataagattattctactcgactgaaagaatattaatgagtacatattagtataaaatgcatatatatgatctttaaaataaatgtgttgtgattgattgtgcgcagtagggttgaataaatctttgtatttaagaaaaggtggcacacaaaaatgggatggcatagatgatcgcgtgaatatatgatgccagcagtatatttagtatgacaggagtttgatgataggacaaggcgcatacgagacaaattgctagtattaataatatgaagattatatatgtga

SEQ ID NO: 17656 - DNA, 730 bp, Diabrotica virgifera
  misc_feature (4)..(33): n is a, c, g, or t
  misc_feature (121)..(138): n is a, c, g, or t
  misc_feature (246)..(263): n is a, c, g, or t
  misc_feature (280)..(302): n is a, c, g, or t
  misc_feature (329)..(376): n is a, c, g, or t
  misc_feature (438)..(471): n is a, c, g, or t
atcnnnnnnnnnnnnnnnnnnnnnnnnnnnnnncagaatatcttttagtaaaaggaaagaaaacccttatttaatgatagataattagaactgagacacaagattttatttttatcaaagnnnnnnnnnnnnnnnnnnccttgaggatcagggattattaaccactacttatatatttattatttctcgaacttaaaagacgcctacaaaattagaagtcttattgtaaaataacatattttaacnnnnnnnnnnnnnnnnnngacgatattcgtattgnnnnnnnnnnnnnnnnnnnnnnngtacattaagtttatttattatcaacnnnnnnnnnnnnnnnnnnnnnnnnnnnnnnnnnnnnnnnnnnnnnnnngaatgagcttacaaatcctactacattaaaaattactttttcaagaaccattaggatatagnnnnnnnnnnnnnnnnnnnnnnnnnnnnnnnnnngtctcatatatgatcactcttatcctgtataaatctttgactcacatatacattctacctattatagctgtaccaatgatgataacattagaattcaaaaaatgaatatttacaccgctgatgtcgtcgccaatagaggaaatcgacaacatctttttcacctgatcatcatcaacatgtctctgtgtgttaaatataaagacgcgcctgtccactgattaattaggatgtccgcgaaatcttgaccgctgctagggac

SEQ ID NO: 17657 - DNA, 979 bp, Diabrotica virgifera
  misc_feature (42)..(54): n is a, c, g, or t
  misc_feature (57)..(70): n is a, c, g, or t
  misc_feature (724)..(795): n is a, c, g, or t
  misc_feature (798)..(837): n is a, c, g, or t
  misc_feature (905)..(973): n is a, c, g, or t
ttttcgtccacaacagttgtgaattcgacgatacaacgggtnnnnnnnnnnnnnacnnnnnnnnnnnnnncgtctttaccttctgtcagaagaaatgcgatatgaagtactcagcaacgttacagatacagtctgataatgaaatcacaacgagatcaatgaagaatcaagaggtgaaaacatttaacgatgctattcacaaggtcactttcttacagtctgagtttcttaggttaaacagcttcgattttatgactacgaagttcttgaaaataccaagaactgaaaaacttaatttaacatactctataaaaatcgtagataacaattttctaatagaacccgagccgactaagggggactccgatatccaacgtgccgcaggtattggaaaacacttcgaatgtccaatatgtcaggaatatatgtctcctcctatatataattgtgccaccggccatacaatttgcaagaattgcaaggataagctcgtattttgtccgtattgtaaggctttggtcggaatctctaggaactatgtgatggaggatatgttagacacgcttttacttcattgccacaatgaatataaaggatgtacttttacgggtaaagtacaagagataaaattgcacgaggtaatgtgtcattacaattgaatgctatttttagtacttacgtttattcaaatatttaatttactgatcaataaattattctaagnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnnnnnnnnnnggaaaggggtttttaaaaaggggaacaaaggtcctgttgattgggccaaaaaaataaaatgggggggnnnnnnnnnnnnnnnnnnnnnnnnnnnnnnnnnnnnnnnnnnnnnnnnnnnnnnnnnnnnnnnnnnnnnaatttt

SEQ ID NO: 17658 - DNA, 295 bp, Diabrotica virgifera
  misc_feature (2)..(135): n is a, c, g, or t
  misc_feature (137)..(183): n is a, c, g, or t
  misc_feature (193)..(219): n is a, c, g, or t
  misc_feature (228)..(240): n is a, c, g, or t
  misc_feature (242)..(254): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnncattaaaacnnnnnnnnnnnnnnnnnnnnnnnnnnnattaatacnnnnnnnnnnnnngnnnnnnnnnnnnnagggatcaggaatatgtctgattgaattatcaattgtagaa

SEQ ID NO: 17659 - DNA, 911 bp, Diabrotica virgifera
  misc_feature (681)..(681): n is a, c, g, or t
  misc_feature (724)..(724): n is a, c, g, or t
  misc_feature (864)..(864): n is a, c, g, or t
caacagatggttggaaggccttgagttgaaaaaagttgtgaaaagtgtgaaaatagtttgagttttcttgctgagttaaacatgagttcaaaacatagacataagaatagcaagtctagaagtcgttccaaatcatcaataattacagaaatattatatcccagagatgacataaaatgtgtagaagacaaaaaattcagcataaaggtgtcaaaaataatgggcagatacatggtggctaataaagaaattgaaccaggcgaagtaattctgagtgaactgcccatagtgatcggtccgtgtacagactgcaaagttcaatgtttgggatgttacaaaaatttggaggaacaaccgtttatcaaatgcaaatcctgcaattggcccttatgctcccaaaaatgttccgggcttaacaagagactgggccatactgaagttgaatgtgccatccttagagaaactcaatcatcaaactttttggactacaatgatttttccaagataaggagtcgattatgtgctctagcaccattcagatgccttttgctcaaaaaaactgatccaaaatcctatgacctgctcctggatatggaacatcataatgatttaagaagaaatatcccggaaatttgggatactaatcagagaaaagttgttgatactattattaaagattgnggactgaactgctttactgaagaagaatccatactatgtgtgngattttagaggtaaacagctttgaaattggtcatcaagatagaaatatccgaggactatatcctacagcattccttatgtctcacgactgcgtacctaatactaaccattgcgacgaagaggcaattatagattaacagntagggcttctacgaaaattgaaatggatatccagttactttaagtat

SEQ ID NO: 17660 - DNA, 897 bp, Diabrotica virgifera
  misc_feature (697)..(697): n is a, c, g, or t
  misc_feature (734)..(734): n is a, c, g, or t
  misc_feature (769)..(769): n is a, c, g, or t
  misc_feature (807)..(807): n is a, c, g, or t
  misc_feature (884)..(896): n is a, c, g, or t
ggaatattcggtggcatctgtgaaaatggtatttggaggaggaggtacaactacgaggtataccacagatataaacatatatttggtggtaaagacgtagtatctcttataagaataggaagattaagatgggcaggacatctagcaagatcacagcataacaaccctcctagaagaatccttatgtcacaacctgtgggaagtagaaataggggtaggccaaaacttagatggaaggatggtgtaaatgaggatgggatgaaaataggcgcagcaaactggtaacggttggcaacggataggactgactggcgtaatagactttcgaagctctttcatagggctgtagcaccattgatgatgatgttaaaatttgctctaaccttttctattctgatttcctggaagtaatcatttgtagagttgatgatacttccaatacatgtatattggtctactcgttcgacattggttacgtttatgagaagattctcattatttttttgagtgttcgatattctcataaattttgtcttcttgacgttcattgttagaccgtatgctcggctattctggtcacgaccctaaagattttcaataatttcgacaaagatgacagtgtaatccgcatatctaatgttgttaatgggaactccatttacctttactccagctgtttagaatagaagataatagnaaggtgtttgctgctgattcttaatcataaatcttanactgcacaaagatgagagataagtgtattgataanatgtagatgtttacaaagatcaatttatatttgataanatagttattagaccataagaatttattggaagaatctctaaagattatttaaagataagtgatattctgatataggnnnnnnnnnnnnnc

SEQ ID NO: 17661 - DNA, 965 bp, Diabrotica virgifera
  misc_feature (100)..(126): n is a, c, g, or t
  misc_feature (766)..(781): n is a, c, g, or t
  misc_feature (884)..(884): n is a, c, g, or t
  misc_feature (921)..(922): n is a, c, g, or t
  misc_feature (943)..(943): n is a, c, g, or t
attttggagaaaaatcacgggaaacattttttgctcagaagggacaaattatctaaaaaaaaattagttcgaagcgaaaaaattatttttgtgaaattgnnnnnnnnnnnnnnnnnnnnnnnnnnncgatcaaggtaccgcccggcaccccgtggatttgttgtgaggacctcttttttgggggagtttgtgcaaaagagtcaaatcggagtagtttcgctcgacgggggtgacaatacagccccttctaatcctgttacttcatccattacttacatttttttgaaatgttcaaccagttcacccctgtcattaaaacagtgttggaaataaagtgttcgaatttgtaatcaagagtgacatattaagtactttttataaaagcagttaatatgtttttagttattttgataactatttattgttatatatttagatagattcaaactaattccggtcaaagaacgctagcagtagtagctttcgtcataaaagtctacaagggtaactataaattgacgtaaaagtatacttaatatgtgtcacatttgatattcataatattgtgtagatatgtgtgtttttctttatctaaaaatatagcaacatgttcgagacggtaataagataaatactccgccctgtatatagttcagatttgtttatcaaatgtttttattcaaaatagaatgttcggaataaattaaatatagatatatactgtctattctataagttttttaaatgtgtttattgtagtattttnnnnnnnnnnnnnnnntttgtttatattatgacaagtatgcttttaattattactcataccatctcacccaatttgttatttgtggatgatcatcgatacttatacactattttatcgntttatttattatatcagcattaattataagagagttnngtacttctatgcagactgtcngtagaaatatatgatttaacgt

SEQ ID NO: 17662 - DNA, 895 bp, Diabrotica virgifera
  misc_feature (20)..(47): n is a, c, g, or t
  misc_feature (843)..(844): n is a, c, g, or t
  misc_feature (873)..(874): n is a, c, g, or t
gtttataaaaagtatgaacnnnnnnnnnnnnnnnnnnnnnnnnnnnngtgatatatacatgtaaaataacattttccgcaatttttcttaatatatagtgggcttttctatatatcttattccgtttgttggttgatttcatatatttgccattttctacataaattatatttgatgatatatgatttcatgtcagataagtgggaaccgagtcgtcctaaatgaaatttggaaagacaggcttcgcaacagccagatatttgccatcaacaaaaaatactcagagacatggtaaatggtggggttcggaggacggggtaagtgttgatagactaaaaactgttgatttctaccgattttacactatttaacattttattaaacgaattatgtgccatggcatcgtccaagtattcgtgtttagtaacacttttaaaacatggtctcaccattaacatgctactcctgtttagaatatattgacaacagaaatcatgacatcactcacatcgctaacattccatttgcctacgcttaaaagtatgtctagatcatacctatagtttgtctagttatacctataaaaacggctaatatagggttgacaccatccaagaatgcctggattccaaagtggaccaagtgtacttgtacaagtttacttgaacaaagttggttgccacaattaaatgactttcttgttaatggtgttcgagtggttgctgatatggaccaagagctagcaacgtcggaaaaaaaatcattttaagacggctgattctttcgtatattgttccttgtgcttcctcgaacaccgtaccggccgtctggctgctgatgcgnngtgcgttcattacacttccccatcactannatatatagatttgttatgtta

SEQ ID NO: 17663 - DNA, 936 bp, Diabrotica virgifera
  misc_feature (759)..(786): n is a, c, g, or t
  misc_feature (794)..(794): n is a, c, g, or t
aagaaaactaggatgtaacttgtaaatcaaacttattgtcaaaaatttttatcgactatatcggacatgtgaaataatcgttttggttcttaaaaaaccaaagaaactttagggataaactaaatactccaatatggctactaataacataggaattgactggctggggactatgggtagccttggtgttggggttgattttgataactcttctgaacacccaggaacttccaacatgaatcaatatgaacaaatggaccgaacgaacgcaactttaaagagaaatccaaaaatggagttatctaagaatgatctcatcaaattggttacattttttgaaggagagatacaggctagggatatagtcattgcagctttaaagtctgagaggctaaaacaagtagtcaacgtgggaagatacagaccagtggtattgtcggacccttatacagctttacttagagacagtattgcagatgggccaaaagctaaatcaccagttagcgaaaaagaaatggcacaggcagctgagcaacagttacatgcatttgggcagctaattttacaacaacgttgggcacatcaacatatgatgaatatactaaaagaagcagaaaataagcacaagaaggttattcaggaattagaggaagaaaagtgtaaacatgaacatgacacagctcaaggcgatgacatcacatatggactggagatggaacggactcgcttaaaacaagaattagaaatggaaagaaacannnnnnnnnnnnnnnnnnnnnnnnnnnngaggcagntggaaagtgcagatgatgagaaagctcgtcaaaacaaatagttttattgttattagcagaaagaaagaaatcattgtaaaatacattgaagaaagaagagaagtgagatctagcacagatatatctgaagaaaatctcgaat

SEQ ID NO: 17664 - DNA, 750 bp, Diabrotica virgifera
  misc_feature (2)..(659): n is a, c, g, or t
  misc_feature (668)..(715): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaatgnnnnnnnnnnnnnnnnnnnnnnnnnnnnnnnnnnnnnnnnnnnnnnnnctatttttaacgttataagcttacatttttctact

SEQ ID NO: 17665 - DNA, 933 bp, Diabrotica virgifera
  misc_feature (8)..(26): n is a, c, g, or t
  misc_feature (32)..(50): n is a, c, g, or t
  misc_feature (268)..(380): n is a, c, g, or t
  misc_feature (382)..(930): n is a, c, g, or t
tatttatnnnnnnnnnnnnnnnnnnnctttcnnnnnnnnnnnnnnnnnnnttttctctcacgatagttaatcgtaccgcgagagaatctctctctcccctctaaaagaaaaatctctcactctccgtacctcgtgtatcagggattatctcaattaataattaatcatcatttaactactctcgaatctctcaaaagagctcaaaaaatctcaaaattttcatcgtaaaataaatatctttaaatcaatttccccgtaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaa

SEQ ID NO: 17666 - DNA, 177 bp, Diabrotica virgifera
  misc_feature (26)..(62): n is a, c, g, or t
  misc_feature (75)..(95): n is a, c, g, or t
cggtccttcctggggtccgatcctcnnnnnnnnnnnnnnnnnnnnnnnnnnnnnnnnnnnnnaaccccctctaannnnnnnnnnnnnnnnnnnnngggatctttattaccactatgcattaatttttcgaattattacgggacctacgtgtagctagacattggtgccgcgatgatg

SEQ ID NO: 17667 - DNA, 198 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (161)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttgtttnnnnnnnnnnnnnnnnnnnnnnnnnnnnnnnncaaaag

SEQ ID NO: 17668 - DNA, 505 bp, Diabrotica virgifera
atcgtatatatattatcgtagtaaaacatgtttgagtaaaggaagagaggaatgacgaataaatgagagatagttagaatcgccagacaacgttctccgtccccgacgagaacagttcaccctcacggagctcgtgcatgaaagacaaaaggttcgataatcaatcgtattctccacgttctcatatactagagctaaagaattaaaagaattactgcaaaatcagtatcttaaataatatcgttagcaacgctaatagagttctgagttaacatatatctacgtcgttgaaaaatacgtcagtgagaaagagctacgacgagaagataaatgaaaaaccgtaacattaatattatctcatatcgttgagataggacgttacccgtaagattcgaattagaagttactcgactatgtagaaattgtcatcaagaatttttcgtatcttcagaagaagacattatctatgacgataaatgaattacgtctcgtcctcacgaactcg

SEQ ID NO: 17669 - DNA, 71 bp, Diabrotica virgifera
  misc_feature (6)..(48): n is a, c, g, or t
  misc_feature (51)..(51): n is a, c, g, or t
gtgatnnnnnnnnnnnnnnnnnnnnnnnnnnnnnnnnnnnnnnnnnnntanttttttttgatccatttttt

SEQ ID NO: 17670 - DNA, 404 bp, Diabrotica virgifera
atatggtggtaattagcgtgttatagcctgacatatttgtacccgtgacatcttcccctctttcttgtgacgccgtgtgagtcattgtgtcttgttagatatgtatcaatattactcttaccgtagaaatgagggccaaaacagaagtgtgtcatcttaaaatttaaacattttatatagtgttagcaacacgaacatgatttcctatgttaaatatatgaattatgtagctttaacaatgttcatccatgtatatatttaagatgatcaatatgtatacattgagaatttcacagacttatgtttcagcggagcgagacaagcaagatcagagtgtgtgaacttgaacacgcccacagagtattgagtctgccaatttggtctaggctcgtatacctttgtac

SEQ ID NO: 17671 - DNA, 175 bp, Diabrotica virgifera
  misc_feature (2)..(46): n is a, c, g, or t
  misc_feature (54)..(166): n is a, c, g, or t
cnnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgt

SEQ ID NO: 17672 - DNA, 934 bp, Diabrotica virgifera
  misc_feature (844)..(844): n is a, c, g, or t
  misc_feature (896)..(921): n is a, c, g, or t
aatctcatcctataggttctaccaaagaatgctaacacacccactgggtgtgttagtgttctttggttctactaatatattatatttacatattctaattgcatatgagaatgtagttattacattctacaatattacgtaaaaagtaagtataaaatatataaactttagttagttatataggtacctatgtataataaatattatatgggtaagtagcctatatataaaatataagtaatatatttagttattatgtgcacatcaaaataaaaatgctgcttatataattatataatagccaaatatatataatatgtatgtaaattactaaaatttaaaggtatctatatacattatacatacttttacttactaggtatttaggaaatattgaagtaccaatatgaatttattattttcaaactgctttttatgttcttaaaaatgttttagtccttgtagctagaaatacttggtcctacctaacagcgtagacataaatgcatgcataacaactgtactggaaactattttcatattttgctcttttgttacctacccccttcccttgtgcaggtataaaatgcaatgcaagggtcagaatggccgtttccggattcccgaaaattataggtaaaaatacttaggtatggtataaactcaaatcaaaatggtatattcatttcaactgaaaacgaaacgagaatttctcatttttcttcaatagaattaagttttaaactttttaccatacaattaaaacggtttaaaaaaatgaattagatagttcactagtacctaccaaaatagataaatttgattaattattcttaacgcgaangtgataatctatataggctaacattattcttcttcctataggtacatacagnnnnnnnnnnnnnnnnnnnnnnnnnntatatacaagtat

SEQ ID NO: 17673 - DNA, 645 bp, Diabrotica virgifera
  misc_feature (5)..(47): n is a, c, g, or t
  misc_feature (49)..(99): n is a, c, g, or t
  misc_feature (101)..(116): n is a, c, g, or t
  misc_feature (149)..(185): n is a, c, g, or t
  misc_feature (191)..(218): n is a, c, g, or t
  misc_feature (235)..(263): n is a, c, g, or t
  misc_feature (267)..(288): n is a, c, g, or t
  misc_feature (290)..(322): n is a, c, g, or t
  misc_feature (324)..(418): n is a, c, g, or t
  misc_feature (488)..(504): n is a, c, g, or t
  misc_feature (507)..(519): n is a, c, g, or t
  misc_feature (534)..(605): n is a, c, g, or t
ttatnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnncnnnnnnnnnnnnnnnnctaattaataattcatcatcatttatctcatcnnnnnnnnnnnnnnnnnnnnnnnnnnnnnnnnnnnnnattcgnnnnnnnnnnnnnnnnnnnnnnnnnnnnttcgtaacggaaacggnnnnnnnnnnnnnnnnnnnnnnnnnnnnncagnnnnnnnnnnnnnnnnnnnnnncnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcttttcaaataacttatcactcactttccatcatcaatcattttcatttttctaaattttttcttcnnnnnnnnnnnnnnnnncannnnnnnnnnnnnggaggataatattannnnnnnnnnnnnnnnnnnnnnnnnnnnnnnnnnnnnnnnnnnnnnnnnnnnnnnnnnnnnnnnnnnnnnnngttattaaaaacacgtctttcgtataaatataaggtctcg

SEQ ID NO: 17674 - DNA, 995 bp, Diabrotica virgifera
  misc_feature (3)..(765): n is a, c, g, or t
  misc_feature (832)..(832): n is a, c, g, or t
  misc_feature (846)..(868): n is a, c, g, or t
  misc_feature (878)..(878): n is a, c, g, or t
  misc_feature (909)..(909): n is a, c, g, or t
  misc_feature (937)..(937): n is a, c, g, or t
  misc_feature (940)..(958): n is a, c, g, or t
  misc_feature (967)..(992): n is a, c, g, or t
gtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattgggagagttcaaatcgataataaagattgcgacctcgatgttggattanagtttataattggnnnnnnnnnnnnnnnnnnnnnnntgttcgactnttaaattttacatgatctgagtttaaaccgntgtgagcccaggtggtttctatctttanttnnnnnnnnnnnnnnnnnnngaaaggacnnnnnnnnnnnnnnnnnnnnnnnnnngat

SEQ ID NO: 17675 - DNA, 858 bp, Diabrotica virgifera
agaaaagatgcctccttcaagaattttatttgtgcccttgtggccttcttggccatgttaatattaatctcaattctactttgggctttaagaaaccgaggcagtggaagtgagagtctattatccacaacgccagttccaaccaatgacacgggtgaacattcagcacacttaaatggatttataacaggcgaaaaaagtaaaaatgtctctacaacaacccatagaaacacccacaagccagaagaaaaagaccctaataaccaggaatcggcaaaaacaccagtatttgtaccaggtacgactacgcttgcttcaaaaactagtgataaagtggttactactggtactggaactagtactgtagcaaccactcaatcaaagttaaccacattttctcccactacacaaaaaattacagtcgatactgtgtcaactccagtgcaaacaattgttaaattaaaaactgttgaaacaactactctacctacaacaacagaaagtaatcctcaagaaaaaaatattactggtggttctccagatacaactacagaagctgttacaaccaataaaaacaatttaccaagttctagttcccaaccgaatagtgctttggcttcgcagacacaatcttcgactatatttactacccctgtttctagtacaatagtgtcatctgctacaactgcgctttatggggtttcaatttcgactaaattagctgaaacttcactaaagcctacaagagaaactcctaccgcagtaacaacaactgttgaaacaactactctacccacacaacagaaagtaatcctcaaaaaacaaatattagtgatggttcatcagatacaactacag

SEQ ID NO: 17676 - DNA, 917 bp, Diabrotica virgifera
  misc_feature (72)..(91): n is a, c, g, or t
  misc_feature (837)..(837): n is a, c, g, or t
  misc_feature (893)..(893): n is a, c, g, or t
gcacaacacaaacagaaacacagtctcgcgttcaatatttacgtcttccgcaaaaaatctaaaacgatattnnnnnnnnnnnnnnnnnnnntatttttcacaaacttttcgcattatcaccagtcaagtgctttcaccttgtatatgggtatctatacttatcaagtatcatcaaattagccaatttaatcgtaatttgataatatattgataatacactccatataaataaatacatagaaattgcagtttatgctgactgtcgtatagataattttaccggcgcgcgtggatgttaagaaaatggtagctaccgtaaaagtggaagaaggattggtcgagggtacgacaaggaccagtactaacggcattccttttcattcgttcacatgtataccatacggaaaagcaccaaagggcgatttacgcttcaaggcaccacaaccagttgagccctggcaaggagttcttcacgttaatcatgaagaaaattgttgtgttcaacttgatatgttaacgtataaactgtgtggttctgaagattgtctcagcttgcatgtatttaccagaaaaatacctagtgaagaaaataaacttaaaccagtaatggtatacatccatgggggaggtttcatgatgggcaatcatagtacatccgtatatggtccagaacatcttatgatggaggacatcgtactcgtcagtgtcacctatagagtaggaatcttaggctttctatctttaagtgacccttccctcgatgtaccaggaaacgctggattaaaagaccaagcactagctctcagatgtgtccagaggaatatcaaatatttcaancggagatcctaataatgtcacgctgtttggagaaagcgcaggtgtagcttccgtgnagtatcagcttctgtctcctacta

SEQ ID NO: 17677 - DNA, 512 bp, Diabrotica virgifera
gaatatagtatttgtttttcctcataatatgacatgtaggaaattttactgctgggaccattttgagaaatttaaggataactcagatgtcctagagccaactcagcgtcaacagacaggaacagtgaaccatagacaggaagtgaaaggtggcaacgatatctctcggagttgcgaggatggaaaggctcaaaacaatgtgattttactaggcaatcgtagttctctacgaccgcctaaggctaccatccgtgggattatgcctgaacgcttctactaccatattatccttcctagtgaaaggtgacaacgatatctcttgtagggccgagagtggaaaggttttaaggaatgagactttcctccagaacgaacatgtgttttataatctttttgatggttatactcatgattgtctgttatcaagttgtaaacttgacaggacagattgcacaaggtctatatgaactgttcatgaaaatgcaacgatcgatacgtgaagtcgatttaga

SEQ ID NO: 17678 - DNA, 669 bp, Diabrotica virgifera
  misc_feature (2)..(46): n is a, c, g, or t
  misc_feature (53)..(583): n is a, c, g, or t
  misc_feature (585)..(668): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 17679 - DNA, 919 bp, Diabrotica virgifera
  misc_feature (24)..(46): n is a, c, g, or t
  misc_feature (95)..(113): n is a, c, g, or t
  misc_feature (303)..(325): n is a, c, g, or t
  misc_feature (416)..(436): n is a, c, g, or t
  misc_feature (527)..(542): n is a, c, g, or t
  misc_feature (863)..(863): n is a, c, g, or t
  misc_feature (874)..(875): n is a, c, g, or t
cacatgtcactcgtgacaagcccnnnnnnnnnnnnnnnnnnnnnnntcgcgttttaaaagttttgaaatacataaaattaagtgtaatcaaatgnnnnnnnnnnnnnnnnnnngcgaggaaacgtgtaaattagaaatagagtataatgacctggatgatgcatttttggacggcattaaatgtgaagttaaggaggaatccaatgggcaaagtacacatgatacctatgattatttagacttaaaagaacgtcctataaaaactgaaatagagcaagatgcaaataaacttaacctatttgnnnnnnnnnnnnnnnnnnnnnnnggttagtattaacaattatattattgaagtccttccatattttagaagtatgtagtatacttaggactaacttttttaccagtgagtggtnnnnnnnnnnnnnnnnnnnnngttcaaaataaattcctcaggtttttgggatttaaaatgagagctattaatgggagtaacaggttttacagttatgaagaaattagagctnnnnnnnnnnnnnnnngaagaatgtcattatcgctaagatttgaaaattctgtatagtttcttaaatggtacagcaaatagtcattatttattgtctaaggttggttttaaagttcctacatacagtactcgaaatgcggttgaaaacacttttcatgtaccatttcatcgatgtaattatagcctcaatgaacctattggcgagtaaccgcaaagtgggcgacgcctggtggcaaatttgaaaaccatcaactcaaggaaaactttgactttgccattaatttgtgtacatatttgcggtcagtttatgttgtaattaacaataatttcgacttanaaaaactattnngtagtgtcctcagtattcattcctattatactctacgtaatgac

SEQ ID NO: 17680 - DNA, 158 bp, Diabrotica virgifera
taattgcataagcaaatatatttatttacattatcacatattaagaaaaagctgtaaacctgaatatgattgtttaaattattctcaatatttacaaaaaccatacaagtatatttacatgaaaatacataattcagtaattagtagatcttgttaac

SEQ ID NO: 17681 - DNA, 347 bp, Diabrotica virgifera
  misc_feature (18)..(32): n is a, c, g, or t
  misc_feature (34)..(48): n is a, c, g, or t
  misc_feature (53)..(129): n is a, c, g, or t
  misc_feature (206)..(228): n is a, c, g, or t
  misc_feature (233)..(254): n is a, c, g, or t
gtcgccttttgaagtccnnnnnnnnnnnnnnncnnnnnnnnnnnnnnnttttnnnnnnnnnnnnnnnnnnnnnnnnnnnnnnnnnnnnnnnnnnnnnnnnnnnnnnnnnnnnnnnnnnnnnnnnnnnnngatattttattgtccgtaggttgagtgttaggaattgttaagtaatgaatatataatagattatattagatatttgnnnnnnnnnnnnnnnnnnnnnnngtatnnnnnnnnnnnnnnnnnnnnnnctgttatggtgatgaaatgtgttttaaatatatgtatgtgtaagaaataaaaagataagttaaatatattaataagatgtatatattaaaaat

SEQ ID NO: 17682 - DNA, 481 bp, Diabrotica virgifera
gaatatctggggcacagaagaggaagctcttttaatgagggccgacggaatcgacacttctaaggtcacattaccacctagacctcaagtattgttccacgaaatgttgacacctttgatatccggagcgcagtgaatcaaagtatctagttataaatatatcgatatgactctttcggtagacctgcaagccaaaaggcaagagtatgcctcgcagtgtaaagattatataatgtgggtgcaagctcagcagtgtctgcgaatgcgaaaatatatgatttctcggcagcgacgacgctatctatgtagcgacagaacacgacgcatatcactattgtgagaatctaataaactgatggttgaggtggaagagaggagaatacacatgtgtgtgagcgtgaagatacccacggagaatggaggcagcgaattgggactaggatggtacagttctgtgcgtagcaatgatacttgaatattc

SEQ ID NO: 17683 - DNA, 507 bp, Diabrotica virgifera
  misc_feature (7)..(491): n is a, c, g, or t
  misc_feature (495)..(495): n is a, c, g, or t
  misc_feature (499)..(500): n is a, c, g, or t
aaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgnaatnngagggtg

SEQ ID NO: 17684 - DNA, 971 bp, Diabrotica virgifera
  misc_feature (901)..(901): n is a, c, g, or t
  misc_feature (922)..(923): n is a, c, g, or t
gggaaacaaataacgttttataaatagtttatagtttaattctttttaaatacattaaattttacacatttcacagttaagcctaaaaaacagatcaagtactttcaaggtttcgcatattacaatgtcgggagattttaattcattgtgggattccatagacctaacaaaagatgaagaagacagcaatgattctgttataacatcagaagtttataattctccaaaccattgttttgaaagagcacctccaccactagtaccgattccgacgaaggtctctgttcctattactgcgaggaataaaaaacttcctaaacttacaaggatagtatataaagatgatccctatgaacatgtggaaccagagacatttatggttaacaagacttcttcaagtatagtttctcctcaatctaccaagttagttcagttagttaatggcagtagaatatataaaatcaatattccccacaatgttattatggcacaaggtaaaggtccagtgtttatgaacatacctggagttggatcaatgcagttgaaattggacccagcatttaaaaatccaggtcttgacagcccagtcactcatgtacaacctccttccctacagcctatatctgcaatcatctcaacacagggtgaaaaacaagaaaatgtatttattaatgagactttgtacaaaaattgtttggtccctttgacagccagagctcagcctaaaaacagtcgtcgtttatcacctaaaaagagcaaagaagagaatcaacttttcattggattcccaaaaaatgactgtaataccagtgataaataccttagacgattgaacaatattgtagatcagtataaaacaaaattacaaaaggaaatggcatattttagtaattaacccaanagtgtgtgtaaaagaaatganncacaaaattttaaacaacaacctgataactttgacgatttactaatca

SEQ ID NO: 17685 - DNA, 675 bp, Diabrotica virgifera
  misc_feature (11)..(11): n is a, c, g, or t
  misc_feature (393)..(413): n is a, c, g, or t
ctcctagggtngggttctagatcgcgagtgatcgatatttcctttaaagagaagaggaaagaagagaagggagaggacatggggagtaggaagagaagaagtgaaggagaaaaaggcccctacttatatgatggatgttatgaggatgtgtaatgtgtggttataggttaataagttaaagattctaaagttatgaagttagaatattgaagtggtaaataatgaaaattattatggaatgagatatagtataaaaaaatgttttgtggtgaaatgtttgtcgagtttgtatatatatgatattaaatgtatccagttaaaatagagtaacatccaaatatctattattttatatctttatactaatgatatgaatatgattaggtaggaaannnnnnnnnnnnnnnnnnnnngattaagtgtctcagttataaatatgatctcttttttgatgatgttaaaatatgatattattgattgtataagactcttaggtataacactaccataccatggttgagttaaatggtgttcttatttattgtgtaggatttgcgtatgtgcaagttgctgaagtgtgtatacaaacagtagctgtataaagtttgtgaaggtgaacagactgattttattctcatgattattagaatggggttgtgtctgcatacataaaat

SEQ ID NO: 17686 - DNA, 926 bp, Diabrotica virgifera
  misc_feature (308)..(337): n is a, c, g, or t
  misc_feature (889)..(889): n is a, c, g, or t
ccgcccttttgttggtctatatcagataccccatccacatacacagttactatagcctgggccactccaaaagggccaccactttcctcttaagactgacataggcgaatctaaggtctacagaagtattgaaagaagaatcgaagaacattatcctaatgaagatactaatttagtcagggttcgtctagctaatggattagaagatatccacaagtacaaaatctttgaagacatcgcatctggagactcaaaacaactcaaccataagtccttgaaattggatgttgatgaagacagaaaattcnnnnnnnnnnnnnnnnnnnnnnnnnnnnnngcccaaagaatcgaagaaggtgaaatcaagagagataacatccctgatttatactggttcgaagtttcgtctcttcatgcagtttcagacttgtacggagagaattctacacaagtcttggaagcgaaacaacttcttaacgaatgtattttaagacttaactctgctttcaataaactttataacggatatgtccttgtcactgttgtaacaagtgatgccagccacactaggagaggcagaagcattcttgctgctgatgaaccaactgatgataaaaccaaatacaacttggcaagttactacagcaaggactaccccgtcatctttaatctcatcttgtggtttggggtagtgatgttattttccctcatcgctatctgcatggctattggtactatggatccgggccgtgattcaatcatttaccgtatgaccagcaccagaatgaagaaagacaattaagtccactttgtttttcaatgttcagttaggagctaaaatccaagtttagtacagtcatatatatgagtgttttctttttgtcatcantacaaagcagtttttaaaggacatgataaatagctga

SEQ ID NO: 17687 - DNA, 96 bp, Diabrotica virgifera
  misc_feature (29)..(29): n is a, c, g, or t
taacagcgtaattttattggagagttcanatcgataataaagattgcgacctcgatgttggattaaagttataattggtgtagcagctatatttat

SEQ ID NO: 17688 - DNA, 941 bp, Diabrotica virgifera
  misc_feature (445)..(462): n is a, c, g, or t
cttcgggtaataattatggaccgcaacagggatcgttcttaaatatcgaagttatatctgaaaaatgtctggactattggctacaaggaataagagagttgaagaaggatcatcctaccaagatcattattgctagcgctatgtgtgaatatatcgaaaaagattggagggaaataacaaaacgagtagaagaagctggagctgatatgttggagctgaacttgagctgtcctcatggagtcaaagaatctggaatgggattggcttgcggacaaaatgcagaaatggtaaagaatatttccagctgggtgagaagtaccgtaaagataccatttttcatcaaattgacaccaaatattaccgatattacagttttagcacaagctgcaaaagatggaggagcctggggtgtctcagctatcaatactatatctggtttaatgcnnnnnnnnnnnnnnnnnnctgcatggccagccgttggtgtagataaaagaaccacgtatggtggcgtcagtggtaatgcaactagacctgtaggacttagagcagtgtctgcaatagcagagaaaataccagatttggctatattaggggttggaggtgtagaatctgcagaaacaacattgcaatacctgcagtgtggagcgtctgcagtacagatctgtagtgcagttcaaaaccaggactttactcttatcgacgactattgcaccggtcttaaagctctcctatacttagatggaaagctaaatggctggcaaggacagagtcctcctacgtacaagcaccaaaaaggaaaaaacgttgttccagtttatgatgcaaatggaaagaaattaccacacttcggcaactaccaaaagaagagggaagagatacttagcacactctacaaggaatccaaatataacgatgaccaactgctgaaccatgaaggacga

SEQ ID NO: 17689 - DNA, 874 bp, Diabrotica virgifera
cgaacaccataccagtgagacttatgatttagacgatattctcgcatgagcagtataaaacgcttttgatattgcacaccgaaaacaacagtaatcgattgcgttatccctaataattattttcttcacaagcgaatcagtgtctccaacgtacttgacatacgctcatatgtcggtacttgagatcgttgttagcgcgatttcacaagacgaacgacaggaaacgagataaccaacgaaactcactcaaggcggaacgcatacacattactttttgcagaggcaaaactgttaaataaatagaatgtggtattcaataacataaatgatcaaaaacaccaattacatcaatattacaatatcccaagtattccagaactagagtaaatacctataaaataatttacataataaagttatgtgctgaaatgctgacactcaggtgtagcctgcgtactctaaaccccagatattgctacccatattattgcggactgcttgaagacagtattacctaccacttccatccaaacctgactaatcaactttgaaaagaataaccgggatctacctaagttataaaggcgacaggacatgactagtctagtgtaattaaaaacaacagacgtgtgttaacagatatgattggaatactccttctcataggcatctttcagtgcgccacagtttttcgatttctctctaacgcatcactttggaagtgactttttttctggctcttgagacgcacgtgaataaagcctctgagaagcaacatatcattgtttacgtgtgatataaatagattgcttctttctttcatcgactattgttgtactgtcttatatacatatacacgagacatattactcct

SEQ ID NO: 17690 - DNA, 291 bp, Diabrotica virgifera
  misc_feature (2)..(130): n is a, c, g, or t
  misc_feature (149)..(168): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtttacattatgtagnnnnnnnnnnnnnnnnnnnngtagcattatacaaatgtatctgtaggacatcatatacgttctatattgtgaatagaacagatctgtgtacgtgcctacgataatctagctcgactggcatgaaacaaaaaagcgagcgtgac

SEQ ID NO: 17691 - DNA, 746 bp, Diabrotica virgifera
  misc_feature (235)..(255): n is a, c, g, or t
  misc_feature (334)..(353): n is a, c, g, or t
  misc_feature (418)..(466): n is a, c, g, or t
  misc_feature (606)..(626): n is a, c, g, or t
aaagaagcttttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 17692 - DNA, 140 bp, Diabrotica virgifera
  misc_feature (101)..(118): n is a, c, g, or t
tttgtttgcgttcttcttcccgtcgcagacgttcttcctctctacgctgtcgctcctctatggcgttttgttattttaaagcttttttggtcatgccgcannnnnnnnnnnnnnnnnnctgatggaaattatattctaat

SEQ ID NO: 17693 - DNA, 531 bp, Diabrotica virgifera
cctcccttcccttccgcgaatcagtaggtcatccatgttgtctatattagtatttcgacgctgtcgttgtcagaggtgaacttattacatgtccactgcaaaagtatgaacatcctatggctgcacttaacacatacggactagagtaaggattattagccaccgacaatataactgtcatagaccaaagctccgtcgttttagctaactatctacatgatctatattatggaaaaattagtattggatctcctgctcaaacctttaatgtcattttcgatactgaatcatctaatctctggattccgcactagtgacagaccctttttgcatgatgcttgcttactccatcacaaatactactgtctctaaatcgcctaccgaagagaaaatcctctcactttacaaaaccaattaagataaaggcccaaatcttgagagttaagaacaaaatgtttcaaggctccacccttcaacccagagatcttatcttactcatagggacttgcccaaaacgctatccgtaccatc

SEQ ID NO: 17694 - DNA, 377 bp, Diabrotica virgifera
  misc_feature (6)..(26): n is a, c, g, or t
tgcagnnnnnnnnnnnnnnnnnnnnncaattacgcaaaaattactaacaaacttaatataaggtttaaaaacttaaaactaacaaatatcggctacaattaactaatttagaggtgttagaccagctcgaacagcaaacttagataggtaactaatttagtatcggctgaacttgtacatccacggtgctaatatatactggaagccggccaggttgagaatttccaagaggtgctaagctttggaccagaaactgggcggggttcggcaatagctctgagaagatcggctctcgacaggattggcaaattcagttttggactagttgtctgataggtgggagtatcatctacttctaggaatgatcatcgggtagc

SEQ ID NO: 17695 - DNA, 792 bp, Diabrotica virgifera
  misc_feature (2)..(146): n is a, c, g, or t
  misc_feature (148)..(161): n is a, c, g, or t
  misc_feature (171)..(192): n is a, c, g, or t
  misc_feature (201)..(226): n is a, c, g, or t
  misc_feature (228)..(549): n is a, c, g, or t
  misc_feature (556)..(593): n is a, c, g, or t
  misc_feature (613)..(626): n is a, c, g, or t
  misc_feature (629)..(651): n is a, c, g, or t
  misc_feature (712)..(743): n is a, c, g, or t
  misc_feature (750)..(783): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnncgtcttttcnnnnnnnnnnnnnnnnnnnnnncgcccaccnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaaaattttacatggatctgagtttaaaccggtgtgagccaggttggttnnnnnnnnnnnnnnnnnnnnnnnnnnnnnnnngaaaggnnnnnnnnnnnnnnnnnnnnnnnnnnnnnnnnnncatatctag

SEQ ID NO: 17696 - DNA, 93 bp, Diabrotica virgifera
  misc_feature (2)..(45): n is a, c, g, or t
  misc_feature (47)..(77): n is a, c, g, or t
cnnnnnnnnnnnnnnnnnnnnnnnnnnnnnnnnnnnnnnnnnnnncnnnnnnnnnnnnnnnnnnnnnnnnnnnnnnntatagaataaatacct

SEQ ID NO: 17697 - DNA, 898 bp, Diabrotica virgifera
  misc_feature (69)..(840): n is a, c, g, or t
gccggttgacagacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagacttcaaaacccccactcccacaaagcaaatggatcactcctgaccaacttc

SEQ ID NO: 17698 - DNA, 697 bp, Diabrotica virgifera
  misc_feature (170)..(202): n is a, c, g, or t
  misc_feature (219)..(239): n is a, c, g, or t
  misc_feature (316)..(336): n is a, c, g, or t
  misc_feature (338)..(366): n is a, c, g, or t
  misc_feature (398)..(434): n is a, c, g, or t
  misc_feature (456)..(473): n is a, c, g, or t
  misc_feature (475)..(505): n is a, c, g, or t
  misc_feature (514)..(539): n is a, c, g, or t
tccccggggtccgcaagcttattagctgtgtttttctgtcccttgtgcagagatcaaccacaaaagacaacatgatgtgacgacgatgttgcggatcttgtcgatgacaaaggatcttttatttaataagatgtgttcgtagttttagtaccatggcgatgatcgtctgnnnnnnnnnnnnnnnnnnnnnnnnnnnnnnnnncgaatttatgaaaaggnnnnnnnnnnnnnnnnnnnnngtattataaatagtatagataatctttttgtaatgaaacgatattcttttttaaaaatatctaattatttatgaacnnnnnnnnnnnnnnnnnnnnncnnnnnnnnnnnnnnnnnnnnnnnnnnnnngacatgatattaaatataattagttatgagcnnnnnnnnnnnnnnnnnnnnnnnnnnnnnnnnnnnnncatatttaagattatgtaattnnnnnnnnnnnnnnnnnntnnnnnnnnnnnnnnnnnnnnnnnnnnnnnnncatatatcnnnnnnnnnnnnnnnnnnnnnnnnnnttattataagtattaaaatgatgtatatataataattataaatatgtatattaacggaattctatatacatttttttcagctgtttattaaaaatatgtctctcttgattatatataaagtgtcggctgcccactgattataaagaatggcctgccca

SEQ ID NO: 17699 - DNA, 821 bp, Diabrotica virgifera
  misc_feature (2)..(17): n is a, c, g, or t
  misc_feature (42)..(66): n is a, c, g, or t
  misc_feature (74)..(105): n is a, c, g, or t
  misc_feature (116)..(155): n is a, c, g, or t
  misc_feature (159)..(187): n is a, c, g, or t
  misc_feature (202)..(378): n is a, c, g, or t
  misc_feature (380)..(567): n is a, c, g, or t
  misc_feature (569)..(589): n is a, c, g, or t
  misc_feature (592)..(615): n is a, c, g, or t
  misc_feature (624)..(636): n is a, c, g, or t
  misc_feature (638)..(760): n is a, c, g, or t
  misc_feature (765)..(784): n is a, c, g, or t
  misc_feature (799)..(799): n is a, c, g, or t
  misc_feature (813)..(813): n is a, c, g, or t
gnnnnnnnnnnnnnnnncggtgagagaatatctttcattttnnnnnnnnnnnnnnnnnnnnnnnnngtacctcnnnnnnnnnnnnnnnnnnnnnnnnnnnnnnnntcatttattcnnnnnnnnnnnnnnnnnnnnnnnnnnnnnnnnnnnnnnnnatcnnnnnnnnnnnnnnnnnnnnnnnnnnnnnggtaacgaaacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnntgnnnnnnnnnnnnnnnnnnnnnnnngcccactgnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttannnnnnnnnnnnnnnnnnnnaagacgagaaacccntatagagtttatanattattaa

SEQ ID NO: 17700 - DNA, 671 bp, Diabrotica virgifera
  misc_feature (16)..(16): n is a, c, g, or t
  misc_feature (19)..(19): n is a, c, g, or t
  misc_feature (203)..(227): n is a, c, g, or t
  misc_feature (396)..(417): n is a, c, g, or t
ctcctaggggccgganatngagagagaggatagaaagaagccctttatactaaggattaggatgggactttatgaacgttgtgcgagaaaagcaaggatctctaagtagcatttttctctatataaacagtatgtaaagagttttacgaaaaggtagagatatacgaatgaagatacgagggagggcctctgagatataatgnnnnnnnnnnnnnnnnnnnnnnnnnaaaaagtttgtgagacatgaatggagctgggtttgtgatatatggaacgttttgagagagaaattagagttagttagaaacaatatatatataattgaatatcagaagattaataatattatatatttataggcatgaaattaaaaaggaaggtgttagtaaaactaannnnnnnnnnnnnnnnnnnnnngatacatagttatatttaaaaagatggtatgatctatttttaaagatgatgatttttatttgctgtggatttttgtattaaaggagtatacttacgttgttgaggtgtagcagggatgcgtggatttgtataaagtgagtgattatttagtctgaataaagaggtgtaataacagaaggcggcgagattttgttcaggtgaatattcagaagatgggtttttgtagcatgtagaaaggggcggctgcacactga

SEQ ID NO: 17701 - DNA, 451 bp, Diabrotica virgifera
aaagactccgaagacccttgtatttttagaacatattaattaattgttgtatatgtatctattttcgtattttatatacgtgcggcattcaaagatgtccagtaaaataactatgcacacctaatatatttgcaatgagacgttactcggttattaatgataaataatattataagccatctacaaaatctattgattaaaagagtactcgataggtaataatttatagttgatgatccattaaatctgctatatgaatgagctgaagagagagaagtatcgttactataacaactaatgtaagattaacagaatataacttatacataatataaaatctgtctattatttcttccttataaataatgatctactattatcttctcattcttatgacagtgaatatacttactatggtcttctgcccaccatattttactatggttgatat

SEQ ID NO: 17702 - DNA, 75 bp, Diabrotica virgifera
  misc_feature (2)..(63): n is a, c, g, or t
gnnnnnnnnnnnnnnnnnnnnnnnnnnnnnnnnnnnnnnnnnnnnnnnnnnnnnnnnnnnnnntcccaatttttt

SEQ ID NO: 17703 - DNA, 896 bp, Diabrotica virgifera
  misc_feature (27)..(47): n is a, c, g, or t
  misc_feature (591)..(608): n is a, c, g, or t
  misc_feature (791)..(791): n is a, c, g, or t
tgaatttctaacatacctacaatagtnnnnnnnnnnnnnnnnnnnnntatgattgttactatagtgtagttttctcctgaggatgctaataaaaaattagcgaaatattgagcaataaacacaaagagatattttttatgttgttgcggaaagtagttcgtgaatgaattaggtatgctgcaattagttctcatagccgtagtaatagtactcttctattactatgcaatcagaccaatgaagtactggaaagagcgaggagtgatacaaggtagaccaatatggctcttcggtgataattggagagccttttttaggttagaaacatttggacaaccataccatacagcatataaactagacccagatgctagatatgttggattttatcagttcactgttccaactctgatgataagagacccagaactgttaaaacaaatcactgtaaaagacagcgactacttcaccaatcaccgagcaattgtaccagacgaaggagatccattatggacaaataatttactcggcttaaaagaccaaaaatggaaggatatgagacacatattgactccgtctttcaccagcagnnnnnnnnnnnnnnnnnncactttgatggtagaatgtgccgaaaatttcgttacgcatttcctcaaaaaaaaccaggatggtttttgatgtctccataaaagatgtgaccactcgttttgccaatgacgtcgttgcttcaactgcgtttggtatccgaacggattcacttgaggaacaaaataacgagttttatttgatgngtagagacatgacagattttacgtcgttgaggaaagggataaagtttttttgggttttttataatgcccaaaatacttcggtttttcaatgttcacttttttgat

SEQ ID NO: 17704 - DNA, 545 bp, Diabrotica virgifera
  misc_feature (222)..(237): n is a, c, g, or t
atgtcaatttatacaaattacaaatagaaccagatgtaaacgacaatatcctggagtgaaacaaagatatagaataagctatgaatgtagatttagaattaataccagattgatcacttgaagaagtgactagaaaactataaacatgaagatgtcatgttgacaatgagtgggtagtctgactatgaaaaaatgaggtccatcgccgatatgtctgccctnnnnnnnnnnnnnnnnacggcgtgattatcgtcatctgagatatagagacagatacactacgtagtactgagtacgatagctgcgtgtgcagaggcatttgcatgtatgacatcatctggaacaacagtaagtaggactatcttccgatcaataatgatctctagctaagcatggaagcgctgctctagcacgcatccaccgattgcaggacgatggctattgtgaagaaataatgagattaatgttaagaccaagcttaaaactgcgttggtgaacctacactccctttacaggaaaaacgaggaggttcccaaaaataatct

SEQ ID NO: 17705 - DNA, 685 bp, Diabrotica virgifera
cccacgggtccgctcgcacttgctttgtaaacattggtctggatggtgcgggggaaaagaacgcccatccaccgtgagaccgcagaatctctcaatatagaatagacatttctgtatctttcatagttcaatgacgacgttttatagcggggaacacacgatgaacaaatcatcaaatatgtcttactcctggctggagagattagaagagatatctctgactccctacgatagaaaagccaagtcattgatcaataacttcggctattatcttaaacaactcacacaagtgaatgctgaacttgaggaataaaaacattccctccctaatgctgatagtactgacatgccgactcatctctcgtcgtatccaattgccacaagaaaacatgtgacgctctgaacaactgttgagacactgccaccgaacagattgcgatgaacctcacaacgaacagtggtccgacatagtaccattcccggactctgaaagcgatcccggtacgatgacataatgaatgatagccctccaaaagcaacttatacaacgccggtcccgatttgataaagtcgattctatctaggacgaggtattccgtgagttgcgcatgactgaatatgagttgcaacgagctgacaaacgagtggaatcccatgattcctgaatcggactacttgtctgaca

SEQ ID NO: 17706 - DNA, 217 bp, Diabrotica virgifera
  misc_feature (18)..(36): n is a, c, g, or t
ccggaattccccggcccnnnnnnnnnnnnnnnnnnntcgtattcgaggttctctatctcctattctctctaagagtagagtttcaattccagcactgatcaaaatatttatctcaagatatccttcccattattaatactaaatatttttagttacgagctccaaaaccacttttcaccacagttcactcctaaaatgtataattcgtattaaatat

SEQ ID NO: 17707 - DNA, 900 bp, Diabrotica virgifera
  misc_feature (786)..(786): n is a, c, g, or t
  misc_feature (811)..(837): n is a, c, g, or t
  misc_feature (878)..(878): n is a, c, g, or t
gaaattcgcaattttaacttttatgatattatgcaaatattcgtgttttgttccctaaagctaaatacatcgaaaaagcctaggaatatttttataacatagtgaaattagtgaaagtaggtacatggggtcgtttagtttcagttgaatttgtgtagttgctagtgctgtagatttttgcgagtaaaacataacggggtgatatcgaatatttgatgaagctttgtgcaggacaggaaaaaataagtggaataatataagttatatactgcagtaagtattgtgcttgtttggattttgttcatgctgtgaagttcttgtttgcttagtgcattgaaatattattttttgtcgtggaacggcgtcatttgactttggatggggtaaatggggctgtaggccttcttcaatgtggcatgcagcaaacaaatatatcttttagcgcatgggggtctcctaaagtgttacaagtcaattgtggaggcgtttttgtggcactctcatgtggtcagatacattaatctgtcacatgccatattgaagagggcctgtagccctatttatgtcatccagggttggatgacgtcgttccgtgataggaaataatcgtttcaatgcactaagaaaacaacaactttctagcatgaacaaagtcgaaactagcagaatacttgctgcagcataaaagctatagtttttttttctcatgtagaaagctttggcaaatgttcattaccacttttgccgttttactcacaaaaatctacagggtgggcaactgcacgngttcaattgaaactgaatgacccannnnnnnnnnnnnnnnnnnnnnnnnnngttataaaaaaatctaaagagattttgtccattttaactgntctgatgtggcacatccatttt

SEQ ID NO: 17708 - DNA, 586 bp, Diabrotica virgifera
aaatccacacgaaatacactttgtgtgcacaaactgcaggagcaatcaaaactgctccaaattcttccggacgcgctgctactacgcgcagtgatcgcacctgacattacttgctattagggaactaggcgtattcggatacattgtataacctagttatgaatatatgtctctcttatcaatgacagttattagatgtagagaaccctcaggagacacaaagtttttgacacaaatctataaaggagattggcccacatcactgtgaaagactctaaagttctatccggagctgctttccgtgaaattcatgccgaatttatagcatcaacagagaaaaatgcaactcaattgctgtatcgattgctccataataatccgtcgttccttgcatattctatgtctttaatagcagttgagaatagtcctctacagattacttttaacaacgcgcacagagacgccaaaacgataggaatcatcgatgatgcagatattcctgtgcacggacacagcttctaaacgtgactacgaaaaggatgtcaggtggtagaagatacacctttcagatatatatcatacaatt

SEQ ID NO: 17709 - DNA, 93 bp, Diabrotica virgifera
agtatcgtcggtatagagacagaacatagatcatcaatagccgcacctagatccaagtcagtgatcgccatgttagaacgacttgactagcat

SEQ ID NO: 17710 - DNA, 893 bp, Diabrotica virgifera
  misc_feature (170)..(188): n is a, c, g, or t
  misc_feature (401)..(418): n is a, c, g, or t
  misc_feature (597)..(612): n is a, c, g, or t
  misc_feature (855)..(855): n is a, c, g, or t
ctaattaaaggacgttatctacttattgaaaataagagagatatataaagtaaaagtagaagaagaactaactgaccccatttgaagcctgtactgggataatacaggggacttactaagtcctgtattatttaaactaatcatatatgaaacaggataacaaatgggtnnnnnnnnnnnnnnnnnnnctgccatgcagactatgcaatactaatttctcaaagggaaaatgatttcgacacctcatttgtcattatatctggtctggaggagttgtgtgatctgtcagacggacagacagacttatacactaccttgttaattttttgttagtttcatattataccagtttttcatttatatcttctagtccaaaaattgccaagagtttttttttgcgnnnnnnnnnnnnnnnnnncgtgtatattcacgctgttcattaattttctcgttaaatattgttgtactaataaatattttttagatatatttccaaaaattgccaagcaatacgtagattaccttcaagtcatcccagattcaataagagaagtcatcaagaatacagtaaaatcaattggggaagaaatcaacaannnnnnnnnnnnnnnnattaaagacgccgttaaagcagctatcccacaagcgctgaacattcctaaaatacaactatttccaaacaatacgttaccaaaactatttggtttttagaaaagatataaacacaaatcagacttttgtaaataataattctaattattgtttaacctaatttgtattttgtttctaatatggttcttttcatgagcatttttcagtgcgtcacagtttttcgatttctctctaacgcattanatttgttgtgacagaaaaaacgcacgtctctgattaca

SEQ ID NO: 17711 - DNA, 327 bp, Diabrotica virgifera
cggcccgggattcccgggccttccccccgcccggccacctcggacgcgaggttttctctccctttttctttttgaccgagttagatttagtactgatgactacattagtatcaaaatattttctgttgatttatactatatatgtttaataaagaaattcgagctctctgtttacgacggtttataattaacatgttccttcgcatgaaatatcaggtgctcacctgccctctgatcaatctgaatgaacgccattttttgaccgtgctgacgacccatatgcattgcacctcattaatgtgagtgctcgtcaaatgtcgtcagcga

SEQ ID NO: 17712 - DNA, 156 bp, Diabrotica virgifera
  misc_feature (13)..(89): n is a, c, g, or t
  misc_feature (92)..(148): n is a, c, g, or t
aagacgagagacnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnncaattttt

SEQ ID NO: 17713 - DNA, 237 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(116): n is a, c, g, or t
  misc_feature (162)..(193): n is a, c, g, or t
  misc_feature (202)..(233): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgagtttaaaccggtggagcccaggttggttnnnnnnnnnnnnnnnnnnnnnnnnnnnnnnnngaaaggacnnnnnnnnnnnnnnnnnnnnnnnnnnnnnnnntatc

SEQ ID NO: 17714 - DNA, 891 bp, Diabrotica virgifera
  misc_feature (201)..(231): n is a, c, g, or t
  misc_feature (237)..(267): n is a, c, g, or t
  misc_feature (311)..(332): n is a, c, g, or t
  misc_feature (423)..(438): n is a, c, g, or t
  misc_feature (440)..(468): n is a, c, g, or t
  misc_feature (483)..(496): n is a, c, g, or t
  misc_feature (498)..(510): n is a, c, g, or t
  misc_feature (538)..(714): n is a, c, g, or t
  misc_feature (718)..(739): n is a, c, g, or t
  misc_feature (757)..(815): n is a, c, g, or t
  misc_feature (824)..(865): n is a, c, g, or t
  misc_feature (871)..(871): n is a, c, g, or t
  misc_feature (888)..(888): n is a, c, g, or t
cggacgcgtggggtttttctcttcatctttcaaataataaaatcttttctccgtaaatgtaaagaaaaatttcctctcacatagttaattcgtatcgtgagagaatctctttctctttcacaaaagaaaaatttctctttccctacctcgggtatccagggattcctcattcataattatcatcacttcatccactttcgnnnnnnnnnnnnnnnnnnnnnnnnnnnnnnnccttcnnnnnnnnnnnnnnnnnnnnnnnnnnnnnnntaagaaacggtattcgtttttcaatatatctaatttctctcagnnnnnnnnnnnnnnnnnnnnnnctaacaatatatcttatcaattaaatatcttttctctctctctcatattaaatatcttttcgggatgagctctcaaaataaaattttctcnnnnnnnnnnnnnnnncnnnnnnnnnnnnnnnnnnnnnnnnnnnnncttttaaaatacggnnnnnnnnnnnnnncnnnnnnnnnnnnnggtattatttatcttttctcatcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggnnnnnnnnnnnnnnnnnnnnnngccacgattaatttgatnnnnnnnnnnnnnnnnnnnnnnnnnnnnnnnnnnnnnnnnnnnnnnnnnnnnnnnnnnntggaatggnnnnnnnnnnnnnnnnnnnnnnnnnnnnnnnnnnnnnnnnnngaattnttatttttaagttaaanagc

SEQ ID NO: 17715 - DNA, 566 bp, Diabrotica virgifera
cgcgcgcccggatgctgagttcttgaagtcaataattaatcactataagtagatattagatactaattgtgtgaacaaagtgttagagtaaacaaaactcctgctatttattcacggatgctctactactacgcacagtgttgcactgtctatgcttgatatgatggaaaaagtatgaatttatgtacgacgtatgagattatttatgttaagatgtcgtttttatgagtgacaattagtagatgaggatagccctcaagacgcatattgtttttgacaaagttgtgtaaaagatcttggcccagatcacggtgaaagtctctaaagttctctccggagctgttttgcgtgaattcatagctgaatatatgtataacagagtcaaatgcactgctattgccgtatccattgttcaaaaagttgtcgtcggtcctgcacatactatgtattgttaaacagataagagtagtcctttacagattacttgaaacaaggcgcacaaatactcgaaaacgattgaaatcatcaatgatgcagatattcttatgcacggacacactgataga

SEQ ID NO: 17716 - DNA, 778 bp, Diabrotica virgifera
cggacgcgagggcgttcgtctgggagcgatctctggtttttcactctgtttcctaacattcccactgcgtgaggagaatatgcatcatctagcatacgctgccgttggacccggatgttgtgtattatctactactactgaccatcgaaattacaaacgggttgtgatcgacaatcataccgtcctaacggtctcacctaccttgcatgaaatgtaaatgggaacttgtcaacatagtagcctggaaactcgactacctttagagcgagacagagcgggatactatctcaatagatatagatttgtgtgagttcacaacattattttactacgtaaccatcattgatggccctgttctgagagctctcctcttttgatcgatgctgaacatgcactgtatgactgagtcttactcattagaatgggatgctatctgaaagctgtggaatcggattatcctacatagtaacgatgacgggatagtgctcttcttgctttctcccgtgccgtatgacaactgattggtgaggccaccgaactgttctcaatcgaacccttgtacattgtgtccctgttctgcgacacccagagagataaatcatactcacatctagaaatacgaggacatgccaactgacgaagcgttccagcccgtatcagaacgtcatggattaaacatgtgagagaatcgtgtaacagatcctcggcatcccttttccgagctgccgacaacagagatactatatgcaatttgatagctcgacggtcgataatcgag

SEQ ID NO: 17717 - DNA, 928 bp, Diabrotica virgifera
  misc_feature (887)..(907): n is a, c, g, or t
gagcaggagatgttggacgatttcgagcgtaagctgagggatgtacagcagaactgcaagaaaaagattgatgagaaagaggaaattttacagatgtccctcacacattcacagaataaggacaaggagaccgaagaattgaccaaaaagatggaaagtctgacattactagaaaaagaactaaacgaactgagagaaaaaactagcgaccaaaacacattaatgaaaagtatgtacgacgagcacgaaaaaatgcagcaaaacgaagaaaacctcaaaaacgaagtcaaaaaactgagaaacatgattgatctcgaaaaagaaaacctacagcacatgcaacggctacatcaccaagacatcttagataaagagaggaaactgcaacaaactctaaacgagaagaaggtggagattgcaatctactgggaggaaaagctactgaacgagatttcaagactgaaggatgagctggagcaggtttacattgaagagaagattacggctattgagaacattaagaggaataaggatgagtgttttcaaaaggcgcaagcgcagtgggaaaagaaatacgcacagtatctaaatgaggttcacacactacaaaatgcactggaagagaaagataagttctacaaagatgaaattgtgaaacagcaatctataacagaccaagacatttttgaactaagaagattgatggataagctggatatgtcacatcacgacaaatatgagaagttaacccaaaaacatgaagcagaattagaacgaatgaaggaagaatatgaaactatggtggaagatagagaacaatattggaaatcagaaatagatacactgaactcaacgatagcaaacatgaggctacaagtagaggacgnnnnnnnnnnnnnnnnnnnnnttctaattcagagtcatcaaa

SEQ ID NO: 17718 - DNA, 143 bp, Diabrotica virgifera
atttttctctactctttcaaataataaaaatctctttttcggaaaaggtaagaaaaatttctctcacaagtaaattcgatcctggtattttcttttctcaagaaaattctttttcgacctcgggtacaggattattaattaat

SEQ ID NO: 17719 - DNA, 686 bp, Diabrotica virgifera
  misc_feature (2)..(17): n is a, c, g, or t
  misc_feature (19)..(61): n is a, c, g, or t
  misc_feature (69)..(182): n is a, c, g, or t
  misc_feature (192)..(685): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17720 - DNA, 515 bp, Diabrotica virgifera
  misc_feature (95)..(112): n is a, c, g, or t
cccacgcgtccggagtttttaactgatttttgtgtttatttttattgcaatttctaataaattataagatatcgattcacataataataatcaannnnnnnnnnnnnnnnnngtggaagaaggaaattttcaggtcaacggcgaagtatggttaactcacagaatttttaaccagaggttggagtgggttacccttatgggtatacccagaagggtaacaattatgaaactgaaacgcatattttggggtaattttgaggttatctctaaaccacaagttaactttactttgtgaaaccagccatattacaatcatgtagatggaatcccgcattcttttccgaatttccagaaggaaactaccaataataaaataaagtagataatgcaagaaagaacaaagccattatttaacatagctcaacaacttcgcatagaaaaagatgaggaaagggcacaacagaagtatgccagataaaagggagacacagagaagaggtggatttattcaattt

SEQ ID NO: 17721 - DNA, 488 bp, Diabrotica virgifera
aacctcttatacgtaagggtctacgaggtcagctcagcttgcagagaacaattcgctcgtaaaatagaaagcggagttttatgactgagacatccgatatgtttctggactcttggagttctatgaacgagaaatattttacattatgtttctcccaagactgtgcatacaggctgttgatcgagccgaatctgtactaaatgaatcatgcttcttctacgaataacgatacctgcagatcattgtgcgatcgtcggtcgatgttgttccatggcatctttgttaaaagctcacaaagaatgcgatacgtattccctagatattaggatccgcgatgcatcgggagtgttcgcttctaagatatagatcatgcttgtggagcatgctgagcctggtagcatcccgacttcgacttagggtgatctgaagatcattagagttcccccggtatcgatgtagacatctcctaagcaacgaaatgcaatcgc

SEQ ID NO: 17722 - DNA, 519 bp, Diabrotica virgifera
  misc_feature (299)..(327): n is a, c, g, or t
ggttgttagcaacacggatacagttgtacttaattcattagacttaaaattaaacgaggttactttaaaaggagataaatccctaaaacctggtcaagtagaattatgtgcggaagaagaaattgcgactttaaaatttccctcgttagtgaccccaggctcctacattttagatatagcatttacagatgaaattaacgactaaatgaaagggaaatactaaaatttatgtttgaaccaaaaaggtgagtaaaaattctgactgcaacgaaaaggctattcgacgtgaaagacttcgnnnnnnnnnnnnnnnnnnnnnnnnnnnnntgttgtataacataaaacttatagacagatcagttttaaactataaaaattgacaactcttcacgctagggcataagaaccacaatgtttcttaaatttcttcttttaaactataatctatgattacagaaacagcctaatttgagaaaacgtgataaatgacttagaggaatgaaaaagataattagattt

SEQ ID NO: 17723 - DNA, 863 bp, Diabrotica virgifera
  misc_feature (50)..(69): n is a, c, g, or t
  misc_feature (71)..(84): n is a, c, g, or t
  misc_feature (196)..(213): n is a, c, g, or t
  misc_feature (215)..(249): n is a, c, g, or t
  misc_feature (261)..(288): n is a, c, g, or t
  misc_feature (290)..(331): n is a, c, g, or t
  misc_feature (339)..(357): n is a, c, g, or t
  misc_feature (366)..(387): n is a, c, g, or t
  misc_feature (393)..(469): n is a, c, g, or t
  misc_feature (471)..(518): n is a, c, g, or t
  misc_feature (520)..(575): n is a, c, g, or t
  misc_feature (577)..(600): n is a, c, g, or t
  misc_feature (709)..(731): n is a, c, g, or t
ggtgcgcgggcgagaggagtaaatgataacatattttgatatattattgnnnnnnnnnnnnnnnnnnnngnnnnnnnnnnnnnngtttaaattattgaaattttttattagaagataaatttaaagaattgagaggtagtaatgatgataatagtaggattaaaaaattggatgtttagtgagaatatagaggtgnnnnnnnnnnnnnnnnnngnnnnnnnnnnnnnnnnnnnnnnnnnnnnnnnnnnngtgtattaaagnnnnnnnnnnnnnnnnnnnnnnnnnnnngnnnnnnnnnnnnnnnnnnnnnnnnnnnnnnnnnnnnnnnnnngttagtgnnnnnnnnnnnnnnnnnnnggaaggggnnnnnnnnnnnnnnnnnnnnnngattgnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnngnnnnnnnnnnnnnnnnnnnnnnnngtgattataagaagaaattaccttagggataacagcgtaatgttattggagagttcagagcgataatagagatggcgacctcgatgttggattaaagtgtataattggnnnnnnnnnnnnnnnnnnnnnnntgttcgacttttaagattttacatgatctgagtttagagcggtgtgagcgaggttggttgctatctttgattgattagtatattttagtacgaaaggaccaatatataaaataattgttatatgtagataaa

SEQ ID NO: 17724 - DNA, 695 bp, Diabrotica virgifera
gttatgtctttgccgtattgtatgcgtttaccatcgaactgaactggatatactcctaatatcttatgaatcggaagaagacaaaatacccgtctatgttgccttctttgattttttcgagagatcgagagtattatcattttcagtatcgatgtaggtcggctatggaacgtaagaatcaagaagcgggattgccgctatgtcggtaatgaggacgcgaatttatcatgaaatgcattatctcagtatgtcagtaggcgcatatcattgtccatctactgatgggccttagttggtactcgtagtgtctgatagcattcaactcagatctacatattccttggacagcggatttgtcaatttgagagctggtctttccgaatgagtttcactgattgacgttagttgtctctattgctatggcagctgacgctggggtaagagtgaccggacaactgccaagattcttcgtacaaatgatcttgatactcattttcggcaatgcattacatatttatgtttcttttgacaacatttacctctatactatagctgaacttcacagctcgcctatgttataatctcataaagacagcgtagctgaagtggcgcatctcgccccgatcatgttggatgtagtgtatagatgtgatattacatgatgtgtctttgctatcaggagatgacagtaactg

SEQ ID NO: 17725 - DNA, 137 bp, Diabrotica virgifera
  misc_feature (2)..(119): n is a, c, g, or t
  misc_feature (122)..(135): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnntt

SEQ ID NO: 17726 - DNA, 653 bp, Diabrotica virgifera
ataaatttgaaatcctattacataactccccgtctgatcgtcagactatttgttaccgcatataaaatacacttactatgagcaagaacttattaacatactatagctcaaggtcagcgcagcgcggaaagatattatttctcccgaattaggagaaccgtctatcttatgactgagcaataaccacacttttctaatgtcttttaactccacgcctgaggaatatcagaaatttttcttcatccgacacatgtatttgaagactccagccgaaaccactcgaatatgagacgttaaccgctgcatctattgaaatatgagcccgagatcatgtgtgacgtcgtaccatcgaggtcatggcaggcatgatataaatgaaaaaagagatgcagttcgtctttacccatacagacaaaattcatgcttccagcatcttgaatgtcctttcttaacgatatataccatgaatgtgaaacagcgaaagaatgatcgcatccgcacttctacctagtgtatgcagtcaacacgaagatataaccctccatatattaaagactatcctaagtaaccgagcgcaatcgctgcttcgatacaccatattcaccgaagaacaaccatatcaaagtcgatctgtgctctaaatgcttctctac

SEQ ID NO: 17727 - DNA, 936 bp, Diabrotica virgifera
tggaaagcaccgccaagttgattaattccagtgtggaaagcaaaggttttcagtgttttattcgttagaatcgtttttcgagatgaaattttacgtagaacacatcgtatcagtaatgtaaataagtaatgcattacacaagaagtttttcaaatgatctattcatccgtccagccagttctgttaaactatacataaacgtcactcaaggtcaaggtatgtgtcaggtgaaaaccctccaatagcgaatcagtttagactcaacttaccagagagcgtttcacgaggtaatctaactttactttctgtgtccggaacaccaacaactttaaattttgtacttccaattgttggccgcatagatggcctgcaatttgctaaaatctataaaaagtcttcttctgtgcaagtctctttcatctctgtgcatgatagcagatggtgactattctgatccgcgccacagtcgcagctatcgtcctcctgtactcacttttgtcttttatccctctcattcgttcgtggctgttcctggaaactgggtatccaccctcagcagttccgttgatctagtcacctctagtcggatctgtcgttccggctgccttctccattgtatatacatcaaccatacgacgaatatgaatactagggcaaacgctactattcccaatatttctggaatagataaatatttgcgcttggtttataaatatttgctcctcctccttgttttggttatttcccataactatttcttctgagcgtcctgtcgtctcagctatcccgctgtcgtctcagctgtccaggtttatagggccaggggcgccttgttaacgttggtagattgccatgatacgttgcaggggtggtatgtcgagttagaacactaactctaacttataactttatttatcgattacaacatcccatcac

SEQ ID NO: 17728 - DNA, 115 bp, Diabrotica virgifera
  misc_feature (7)..(25): n is a, c, g, or t
  misc_feature (29)..(52): n is a, c, g, or t
gattttnnnnnnnnnnnnnnnnnnnctcnnnnnnnnnnnnnnnnnnnnnnnntacagatagttaattacgtttcgtgggaggaaattttcattttctcaaagaaaaatttctttt

SEQ ID NO: 17729 - DNA, 721 bp, Diabrotica virgifera
  misc_feature (140)..(161): n is a, c, g, or t
  misc_feature (164)..(179): n is a, c, g, or t
gttgttctttgataagattaatcataatgcagatcgttcatccttgccgctgtccttattgggggcacgagggccaatctaggcggcttcgaaaaaagaaccagatttagggcgacccataacgaatcttacaacggtannnnnnnnnnnnnnnnnnnnnntgnnnnnnnnnnnnnnnncaaaaagaatcgaggaacacctagtgctaaatacgaaagtgaagaaaatgcctactacttgagtggtaacaaattcgccgattgaaccagagcgtgaattccaagctatggtgggccgcctgatggatagcaaggccaaacaatcctttattgctgaacacgtagacgatccctatgtccaagctggagaagaagatgattgaagagatggagacgtatttgatagtcaaagatgaaggcacagagtgaaatgatgctgagatttcagcaccaccgcatccctcgaaggccagctcgccatccacaagaatcaacgtgctcctctcactggacaagaattgccagactgtgacacatcttgaactgatgtctgtagcgggagagttgatgataagatgccttataactatgctagacgccatgaactctcttccgaatctagatatgcatacaccggaagagatgatcgattgaagaatgaagagagacagaccactctcttccataagctgaaacgtgatatctcgcctttgctgaagacg

SEQ ID NO: 17730 - DNA, 176 bp, Diabrotica virgifera
  misc_feature (2)..(48): n is a, c, g, or t
  misc_feature (55)..(167): n is a, c, g, or t
cnnnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgt

SEQ ID NO: 17731 - DNA, 903 bp, Diabrotica virgifera
  misc_feature (491)..(509): n is a, c, g, or t
  misc_feature (560)..(579): n is a, c, g, or t
  misc_feature (739)..(739): n is a, c, g, or t
cccacgcgtccgataaagttaagaaaatgaacatgtttaacagtttgtcttttaagaaatctcctattttcttttgggttttcctttgacaacaatgttttgcagccatatctctccaataatacgtcatttgatgatacaagaagagttcttgttatccgaaacagcctccccccaattgtttcggttaacggaggttttagtgtagatctgaaaatatatacaataacaaactttcagcagaatcttttacttgtttcaaaaaagttaaaatttggtttgtgagatctaaaactattaaaatgaattactaaaacgtaaatgaggtaaacaaaacaatatgagataaaatcgagcagatagttatgaataaacgaataaataggtaggaatatttttttcaaaattgtttttagtttataataattcgtattgtttttgaatgatattatggaagtgttaataatttattccaaccatgtattttactnnnnnnnnnnnnnnnnnnngaaaatatactacaaaattagaaagatgcaattaacataaaattttcatcnnnnnnnnnnnnnnnnnnnngtttatttctaaatcaattaacaaacaaatgccatcaaaatctcgagaaatcataaatatgtttatgtttaacaagaaacaagtttactgaaagagtatattacttcgtatttttcttcatgtatatttctggattagtggaagcgattcttagcaaaanggtatggttgtgttctacaagtttttataaaaaacaatacttaaaaagtaatatcgcgctattcaataccagcaaaacaagtggtaaaaaacaccttaactgtcatggaaatgtagtgggtatgtctgtgatagtttcagtggtccctttaagaatctatcttc

SEQ ID NO: 17732 - DNA, 861 bp, Diabrotica virgifera
gttgaatactgctatcacgcgagcacagagcttggtggctgttgtaggtgatcccattgctctttgttccttagggagatgcagtaaagtgtgggagaggtttattcagatctgtaacgatagcaatagcttgtttggaattacttggactcaattgaagttacaactggacggcatcgagttgaaaaagatctacaccctcaaccctctagcgcccgaattcattcctaggaaatacaaagaattaggcatggtaccgagcgtggccaaagtcgaagctagtcttcccaaagaagtagtcccacccccgccaccacccactaccctagtatcgcaaattcctcccgcagttatctcaccattccctatccaagacctgagattttttccccaactcctataccctccccagcaacctcgtcctttcctcttcaacctcattcctcctaccctgacgaacggcttcactcaacccatcccgatcgtcaatccttccttggtggttccaccacgtcagcaagtggtgacttctttaccaaaggctgtacccgttccccaaggagcgcagagtattcctgttcagagtccgagtaagccgcatgggaactcctcgcaggctgggagtaataaattgatacagttcatgaacaacgttcattttcccgaagccaatgttctgaatgattgcatcaatttgttgccgcagaatatgtcgctggcggatatgttgctgcagcctccaagtctacaggagcgatggtatacctatcttagagaaaccacaggtcccgaagccgcggaaaaattcaagtatctcctgcacaccacgaaccaaaaaaggtccaaagtattagacaaaaa

SEQ ID NO: 17733 - DNA, 999 bp, Diabrotica virgifera
  misc_feature (753)..(775): n is a, c, g, or t
cctttcgcgtccggggaaaattggaaaatatcgagacattaatttcccgtttcaatttttgtctgctgacttgttaggaccgtatccaaggtcgaaaaatggtaaccgataccttttagtggttgtagattggtttaccaagtttgtatttgtacatcccatgtcttcagcaacatctaagggtattgtcaagttcatagaaaaccaagtttttctcatttttggcgtccctcaaatttttgcagttgacaatggtccacaatttatttccaaagactttaaagaccttatgtccaaatataatgttcaaaagatctggtataacgctaggtattttccagagataaatcctactgaaagggtaaataaaaccattgttacagctattcgttcttttatccatgatgatcacaaagaatgggataaagaaatattcaaaatagcccaggcaatccgtcttgccaaacatgaagttacgaagttttctccatcttttctgaccttcgccagaaacatccctactgacgggtccttttttggtatcattgaggaaagagcggataatactttaaaaattaacaacgagttatttactcctaggcctgccgacgagttgtctcctctcttttcggaggtccagaaaaggttacgtcaggctcatgtcgaaaattctaagcgttacaatctccggaaaagagatgtacaatttcatgtaggtgatagagtttggaaaaagaattttgttcagtctannnnnnnnnnnnnnnnnnnnnnnaagttagctcctaaatttgtaccttgtattataaataaagtgatttctccattagtctacaaccttaaagatgttaatgttgtagatcttggaaactttcatgtgagaaatatcaagttagatggtaccaactctgatgatgatagttcggtaacttatttttttgggggaattaaatttttggccattaactcttgggtttttttgattttcatcaatctttg

SEQ ID NO: 17734 - DNA, 836 bp, Diabrotica virgifera
gcaacaagtgtgcggttaagctcggattttttacttgttttgatttgatatctaaccataaaaatatttacaattatcccttactttttttaataaattgttcagaatgatttattcatagtaagttgatgttgtcctcgaacaaacatccgtaatgcccgattcagaagtaaacacccatacatgtgcccaaaatgtgacctaggcttttggactaagagtgcttatgaggctcatcaaccagttcatatcctcaaaaaagcaaaacaacctgtaaagaagttccgttgtgatgtatgtgcaaaagagttcagcaaactatgtgatgtggagcgccatactcgtgttcatactggagaaaagccctgcatttgcaatatctgcaataaacgctttcagcaagcacacaatctcagtaagcatctgttgacccatttacacataaaaccgttctattgtgaaatttgtaacaaacaatttggaagaaacgatgtactgagaagacatttgttgacacattcagttgataaacctgtgaaatgttccgtttgtcatagaggttttatcaggcattcacagttactacaacatatgagaagaaaacataaacgccgtccagtagaagatgttggtgaatccaacgctgacccaaatgagagtgagtctagtgaaacaaaggatgatggttttgataatcaacctagtacttccaagtccgagaatgaaagtcatgacaaatgagtgtaatggtagtaaatgatctcttattatagttttaagtgaagaatgttggatattactggtgctgaaaatgacttgaagttgttttttttggg

SEQ ID NO: 17735 - DNA, 889 bp, Diabrotica virgifera
  misc_feature (9)..(31): n is a, c, g, or t
  misc_feature (104)..(121): n is a, c, g, or t
  misc_feature (182)..(218): n is a, c, g, or t
  misc_feature (223)..(255): n is a, c, g, or t
  misc_feature (264)..(349): n is a, c, g, or t
  misc_feature (354)..(445): n is a, c, g, or t
  misc_feature (447)..(459): n is a, c, g, or t
  misc_feature (481)..(684): n is a, c, g, or t
  misc_feature (693)..(884): n is a, c, g, or t
gtctctccnnnnnnnnnnnnnnnnnnnnnnngtacccgtcatgaaaaattctctatctctaacgatagttaattagtatcgtgagagaatatctttatttctcnnnnnnnnnnnnnnnnnncatttttcgtacctcgtgtatcagggattatctaattaataattcatcatcatttcatccnnnnnnnnnnnnnnnnnnnnnnnnnnnnnnnnnnnnncatcnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnncatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnngttattatttcatttttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattat

SEQ ID NO: 17736 - DNA, 916 bp, Diabrotica virgifera
  misc_feature (406)..(438): n is a, c, g, or t
  misc_feature (859)..(859): n is a, c, g, or t
  misc_feature (901)..(901): n is a, c, g, or t
agaactagtccttattcaattagtagtaaataagtgcacactagtaacaatactcgaatattaacaagaataaaattcatcaagtacgataattttaaaatcaacacaatggaagtaaaacaagaacaaaataatttttccgaagagaaatcgcctcatcgccagtgaatccgcccaaagtgaatttcgttatcctcgttaaaagtgaggtagaggaagactcagttaaaactcgaaaatatcgattatttcgggctatcggcaactcttcaaatcaatcgggtatcggacgttaccactcaagacatcgaaattagaggagcaggacaaggctgaacaagtacatcgggtgaaaatgttgtggaagttaaagaagaaattaagcaagaggttggggactatcgannnnnnnnnnnnnnnnnnnnnnnnnnnnnnnnntggtcacttacccttcggaagaccttaaagatgaaccaaaggaagaatggttcagatctggagaacaatagaatgggatgtattcaaatcaatacagaaacttccatataataaagagcaacttaagtatttgtccaaaaacgctttttcgaaaaaccatatggactgggagtaaaaccatatcaatggtgaaatttggctctaagtcattttctacaaacagaagcttggaaacgacatatggataaagagcaacttaagtatttggtccaaaaacgctttttcgaaaaaccatatggactgggagtaaaaccatatcaaggtgaaatttgctctaagtcattttctacaaacagaagcttgaaacgacatatggagaacgcatacaggagaaaaaccttatcatggcgaattttgttcngaagtcgttttccttctcaaataatttgaaagaacataaganaacgcacgggtatag

SEQ ID NO: 17737 - DNA, 159 bp, Diabrotica virgifera
  misc_feature (3)..(49): n is a, c, g, or t
  misc_feature (95)..(118): n is a, c, g, or t
  misc_feature (127)..(158): n is a, c, g, or t
atnnnnnnnnnnnnnnnnnnnnnnnnnnnnnnnnnnnnnnnnnnnnnnnattcaacgatagttaattagtatcgtgagagaatatcttcattttnnnnnnnnnnnnnnnnnnnnnnnncgtacctcnnnnnnnnnnnnnnnnnnnnnnnnnnnnnnnnt

SEQ ID NO: 17738 - DNA, 881 bp, Diabrotica virgifera
  misc_feature (648)..(648): n is a, c, g, or t
ctcttaacttcgcacgaaccacgtacaagcgaaccttccagaacaccgaaactttacaatttagtcgctatagagccaccaatccttctcatcaaccctcgtgaacgtgatctaacaaagctattcttctacaatcacagtatctatatcgtatcccgaacctcgcgtcttcttttcaatcagattttcgttcgtgatgtctctctcgaggtactcgcttaaaagttcagtggctcgctctagatctttttcggttatcttcaaatatcacagattgattattctttttcaaatagtacgcaaatacgtatcgtatacataagtgtctcgtcgacaccgacaaagtatcgtcgactcggctttttttagatattgcacttctatccagctcatcggttaagttgctgcatatcttccattttctccttcactgatgcgtatagtttgtgctcgaactttaaggactgcatgtggttcatgtagcggttacagtagaagaggtaacgctgaagagctgctctggatttttcttgagcgtcccgggctgatcttgcctcatcttcgtcatacctattacagttgtaccatgagcttccgtgtggctcccaaggtcccaagcaaacccagcaaaaatctgccttggcagtntttgattcttgcaaatcatatgattgcaaccaccgtctttttcgatagtagcgttacacttaggacactccttggtgttagcggcgacaaattgggagtttcagaatcatcatcacacttcttcttccatttcctcaaaagaagacattttgaacgggatcgtgccagctctcaccgcaagcaaagcagaaaacgttgccacaacggcagcccaactggtttttgaatctacg

SEQ ID NO: 17739 - DNA, 746 bp, Diabrotica virgifera
  misc_feature (125)..(140): n is a, c, g, or t
  misc_feature (219)..(238): n is a, c, g, or t
  misc_feature (285)..(306): n is a, c, g, or t
gttaaaacctactactatttttgtaatcaaagttcacgcagatagttcctttgctgatttccaagtaatgttgtgccagaatatgttttttttatccaagcaaatccttatttgtttgaccttgnnnnnnnnnnnnnnnntcaatttgtaattatatatttatgattttctaatgtcgaagagctagaaaattatcatttttattgtgaaacatgtagnnnnnnnnnnnnnnnnnnnncgcactgatattcgctcttcattatatctaatctttttaggacatcnnnnnnnnnnnnnnnnnnnnnnctgtatttataattaaatagttttatgttattaatattagatatttttaggcatgagctatagtaatacaaactttattactctttagtttttaaataatgaaacaccattaaaaattttcatatgtttaagatatgatattatctatctctatatattatgattactattttttataaacttttgattatgatatcaatttcaatgatgttaatttaggactgatgaccatattagtattagcagattgtgtatttaatacaaatatatagcttttacatacaacgaattctgtaacatttttctcacctgcgtagtacaagcttgtctttatgctattagatatatactctcgcctgccctctgattaattagaatggccgcgatattttgcatgagataaggcagcgtagtcattatgtgtgttattgacatctgga

SEQ ID NO: 17740 - DNA, 719 bp, Diabrotica virgifera
  misc_feature (364)..(387): n is a, c, g, or t
  misc_feature (464)..(481): n is a, c, g, or t
  misc_feature (490)..(518): n is a, c, g, or t
  misc_feature (530)..(552): n is a, c, g, or t
ggacatctagccctgcaggggagatctacctttcatctactgaacacttatcaagcttcagctagaaaccccgtctcgctgcccccactgatgcgatccccgaaactcgcccaaatcatacaaggcccgtcaccgcaaataaagtactcactgtgtatacagcataaaaagatataatatagctcaaaaataaagaacttgattgactcagaaatactttatatatttttcatcgaatgtcatgacattcgtgtcctaatatatctaaatgtttcatagatgaatcaaattcacctactaacaaaatacctacaatcatgcattactataccattcatatcaaacacgttctcagtgaagagannnnnnnnnnnnnnnnnnnnnnnncctatatctaaagaaccactaagactcaaaagtttcatattctaaaatatgttacgtactactgataaagactagcnnnnnnnnnnnnnnnnnntgtcttacnnnnnnnnnnnnnnnnnnnnnnnnnnnnnaaactatgaagnnnnnnnnnnnnnnnnnnnnnnncagaatcagtaacaacattcaggtttaataaaggaatacgaaaacatttttgacacctgataattaacatcatgtcatttaggattaaatataatgtctcgcctgaccaccgattaaattgaatggacgcgatatattgaccatgctaaagcagtataatcattagt

SEQ ID NO: 17741 - DNA, 726 bp, Diabrotica virgifera
  misc_feature (8)..(86): n is a, c, g, or t
  misc_feature (88)..(147): n is a, c, g, or t
  misc_feature (149)..(162): n is a, c, g, or t
  misc_feature (164)..(381): n is a, c, g, or t
  misc_feature (383)..(509): n is a, c, g, or t
  misc_feature (511)..(540): n is a, c, g, or t
  misc_feature (542)..(649): n is a, c, g, or t
  misc_feature (654)..(668): n is a, c, g, or t
  misc_feature (670)..(684): n is a, c, g, or t
  misc_feature (686)..(701): n is a, c, g, or t
caagtacnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcnnnnnnnnnnnnnnncnnnnnnnnnnnnnnnannnnnnnnnnnnnnnntaatgaccggatgcatgaatcacat

SEQ ID NO: 17742 - DNA, 87 bp, Diabrotica virgifera
aaatataaaatctatttttcccaagaatgaaagataagttgcttaatagtgtaatcgattgtcgtttgcagataatctttttctctc

SEQ ID NO: 17743 - DNA, 191 bp, Diabrotica virgifera
gggaaaagcatgggtacgccaggcagagtaccagggtccgggaaattcccggaggtcggacctcacggcaggtccggctcctacaccaacggcagggccaaccctcctaccggtacgaattccaaatctacatcaatggcccaaaacggaaataaattctcgggtaaccaaccggtaaggcggtaaaacaa

SEQ ID NO: 17744 - DNA, 230 bp, Diabrotica virgifera
  misc_feature (62)..(143): n is a, c, g, or t
cttgtatattattaacattacagattaagagacatgagctgtcaaatgtgatcccaataaannnnnnnnnnnnnnnnnnnnnnnnnnnnnnnnnnnnnnnnnnnnnnnnnnnnnnnnnnnnnnnnnnnnnnnnnnnnnnnnnncgtaaaacgatctaacgtattcattctatccatagacgtaaccatccactatataaagacatacctaagtaaccgaacgcaatcgct

SEQ ID NO: 17745 - DNA, 833 bp, Diabrotica virgifera
  misc_feature (35)..(52): n is a, c, g, or t
  misc_feature (93)..(110): n is a, c, g, or t
  misc_feature (126)..(138): n is a, c, g, or t
  misc_feature (141)..(155): n is a, c, g, or t
  misc_feature (167)..(236): n is a, c, g, or t
  misc_feature (248)..(518): n is a, c, g, or t
  misc_feature (520)..(823): n is a, c, g, or t
atttttcttctttagaacatcaaacatttttacgnnnnnnnnnnnnnnnnnncccacgaagttaatcgtaccgcgagagaatatcctcacttnnnnnnnnnnnnnnnnnncctttcgtacctcgcnnnnnnnnnnnnnacnnnnnnnnnnnnnnntacttaataacnnnnnnnnnnnnnnnnnnnnnnnnnnnnnnnnnnnnnnnnnnnnnnnnnnnnnnnnnnnnnnnnnnnnnntaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgagaagag

SEQ ID NO: 17746 - DNA, 130 bp, Diabrotica virgifera
  misc_feature (8)..(118): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgaaacgt

SEQ ID NO: 17747 - DNA, 911 bp, Diabrotica virgifera
gtgaatttgcgatgaaagatgtttataatttttatggaataaataatcttgatttgtgtattttaaagttttgatacgcgcagttttttccaaatttgaaaatcatcggcagatatagatgaagtatccgtaccaaattaagggaacaaatttggatgccatgtgactagtaatttgtccaattaatagatttcagtatgatctacaactgcttattgggattggtgttcactgcattgttcgacaaaggcctggctgaaatttacgctattaaatatgaatctcaattttatcacgaggaatttgctgataaaccagccctatttggaccgagtcttaaggatatagctttgaccggcatgttgatagaagcaaatcgctcagatggttgcgtacccatcgtcccaccacctaacatagataacgacgtagggaaatggatagcgttggtgagaaggtcctcaacggagtacaagaattgtaccttcgagatgaaggtccgcaacgcgcaggcggcaggatacaacgctgtcattgtctacaatgtcggctccgatgagcttatcccgatgggggccaacaactcgacaggcatttacatacctgctgtgttcgtcgctgagaaaagcggcttggctctgttagataaatatgccaacaacccagaatacttcattgttgttaatggagattcgccgtttgatttaccgactcatttactagtaccgttttctatcgctattggtatatgctttatagttatggttgtttttatgatatggaaatgtataaaagatagaagacgactaaggagaactagactgccgaaatctgtatcaagacaaatccccgctacacagttacagaagggcgatctcttcgatacatgtgcccatttgtttggacgatta

SEQ ID NO: 17748 - DNA, 868 bp, Diabrotica virgifera
  misc_feature (249)..(267): n is a, c, g, or t
  misc_feature (275)..(292): n is a, c, g, or t
  misc_feature (469)..(490): n is a, c, g, or t
  misc_feature (605)..(726): n is a, c, g, or t
  misc_feature (728)..(745): n is a, c, g, or t
  misc_feature (747)..(790): n is a, c, g, or t
  misc_feature (792)..(837): n is a, c, g, or t
atttctctctctctttcaaatcaatcaaaatctctccctcggtcaaacggaaatgacaaaaatccctctcttcaacgatcagttcaattcagtctccggtgtggcgaatcatcttccatcccttcatcaaatagacaaaaatttcatccctcccggtacctccggtgtaatccagggaattctctaaatctcaataaattcatcatcaatcctcatctcatcctcttcgaaatcctaaaaaagatgctnnnnnnnnnnnnnnnnnnncctccatnnnnnnnnnnnnnnnnnnctttcaaatcaatctctcctcggtaacggaaacgttatctcagtttttcaaatatcacctcaatttttctcagaaaaaaaattaaaatttcacctatctaacaataatatcttatcaattaaaataatctcttcatcactaactaaataactaaaataatttttcagggaaggagcnnnnnnnnnnnnnnnnnnnnnnaaaatttcaatttttcaaataaaaattcaggattaaaaaatttttcatattttcaaaataacgttattcattcattttcaatattaatcattttcatttttcataaattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnncnnnnnnnnnnnnnnnnnnnnnnnnnnnnnnnnnnnnnnnnnnnnannnnnnnnnnnnnnnnnnnnnnnnnnnnnnnnnnnnnnnnnnnnnnctcattgaaagttggaatgaaggggtggatg

SEQ ID NO: 17749 - DNA, 832 bp, Diabrotica virgifera
  misc_feature (41)..(60): n is a, c, g, or t
  misc_feature (116)..(136): n is a, c, g, or t
  misc_feature (146)..(158): n is a, c, g, or t
  misc_feature (160)..(174): n is a, c, g, or t
  misc_feature (181)..(262): n is a, c, g, or t
  misc_feature (273)..(823): n is a, c, g, or t
  misc_feature (826)..(826): n is a, c, g, or t
  misc_feature (828)..(828): n is a, c, g, or t
atttttctctatctcttaaaataataaaatctctctccccnnnnnnnnnnnnnnnnnnnnctctctttaacgatagttaatctcgtatccgtcgagagaaatctttctctttctcnnnnnnnnnnnnnnnnnnnnncgtacctccnnnnnnnnnnnnncnnnnnnnnnnnnnnncatcatnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtnanaagc

SEQ ID NO: 17750 - DNA, 593 bp, Diabrotica virgifera
  misc_feature (44)..(68): n is a, c, g, or t
  misc_feature (85)..(108): n is a, c, g, or t
  misc_feature (208)..(226): n is a, c, g, or t
  misc_feature (246)..(297): n is a, c, g, or t
  misc_feature (337)..(353): n is a, c, g, or t
  misc_feature (355)..(370): n is a, c, g, or t
  misc_feature (377)..(394): n is a, c, g, or t
  misc_feature (428)..(446): n is a, c, g, or t
cttattattgtgagacagtatttcattttaataaacgaaatagnnnnnnnnnnnnnnnnnnnnnnnnnaaaaatatcattacttnnnnnnnnnnnnnnnnnnnnnnnnaaatttaaaacaaggaaaatattagaatttttattgtacaatatatctttcaaatactttgtcttgtaaagaaatgatactcgtatgtaaggatctctcnnnnnnnnnnnnnnnnnnnttagctccattttattaacnnnnnnnnnnnnnnnnnnnnnnnnnnnnnnnnnnnnnnnnnnnnnnnnnnnncgatgagcttcagactccagtgttatgtacaatctcatcnnnnnnnnnnnnnnnnncnnnnnnnnnnnnnnnnttttccnnnnnnnnnnnnnnnnnnttgatctattattatttttagcttctataaatcnnnnnnnnnnnnnnnnnnntacactgatttagagtttgtcatgtgtgagaatattagtatgaaaacattgaatatttagaaagaatatatagaatgaataaagggatgccgcaacgttgttttcacgtgtataccgaaaacatgtctatttgaattaaatataaag

SEQ ID NO: 17751 - DNA, 932 bp, Diabrotica virgifera
  misc_feature (626)..(646): n is a, c, g, or t
ggccttaagctctcttttttcgaatccgtggtggtcgataagccgaagggtacagatacgattccgaacggaccagctcgagacgggcagctcccccgctccctcggcctcttcagtcgaggatcggaagggcaaacacatcgtggaccggtatcgctccgagaagggcactccgccgaaacggctcgtggtcgcttagacgtggtaaattttcgtggaagtatcggaagacgggcgttttcagtgttttatcgttagataaaatcgaacttccatcaagtaacggtcgaatccatcaattaattaatccagtgatcgcatcgccttaagtgacagatattaaggcggacactcgactcgtcatctacgttacatcgggaattcgcgtggctattacgttgcaatctttaaattttttttctctaacagaaatacaccaaaatagtgtttacctttatacgaataatcttcatcgatcgagacatttacactcacttattggtaacaacattatacgtacgcctcctaaaagtaggcaacatattatctcagccgcgtactaattttcgtgaactacatatttacaacgaaacatttacatattttaaacgaaagcagttaatagnnnnnnnnnnnnnnnnnnnnncatagaaagaaggtcttaagaaaaagtatagtggctatttctaactgggcatggaagggatattacccacttctgatgaaacttcatcatcgtgagtatagccatcgttacatggctcgttgaattatatgtatacctactattatttatacgatttatatgcaaacacttgctttgtctactagactacctacaatggttaaaaacgtcttccaggataaactcaacttgtataattttattcagttatttatcgaaatacaaacaacaaaacattgattatgat

SEQ ID NO: 17752 - DNA, 369 bp, Diabrotica virgifera
  misc_feature (114)..(132): n is a, c, g, or t
cggacgcgtgggccacaaagtggtagtcatgcttccggacggtaatctgatgataacgcaagtctctccagaagaatacgccagtctggagctggagtagattcagtgcagttnnnnnnnnnnnnnnnnnnntacattaaggatgtaccttttttacatttattcttttctttgatcttcgttatcgttcatatccttttagcatttaatctctcattctacagacgctgtggatacaaaacgaaatatttgaacttaattgttatatttgtaaagaaaacattgtattataatgaattgatttgtacatatttgtaatttatctatagattattaggtaagagattgccaataaaaagtttagtattt

SEQ ID NO: 17753 - DNA, 921 bp, Diabrotica virgifera
  misc_feature (244)..(264): n is a, c, g, or t
  misc_feature (407)..(421): n is a, c, g, or t
  misc_feature (423)..(443): n is a, c, g, or t
aagagacaaagaaaactcttaaaaccaaaatacatatctagccaaataacaagaaacaataacacttacctctacgttcgttcagcaaacctgttggcagttacctttgtctttccaagagaaaagaagattgtcggagaaataaaaaatgcaatattgttacattctagttatatttattaatagctaaatcatcaatttgttacttacaatcttcatgcaaatttaatagagcaataaaaannnnnnnnnnnnnnnnnnnnngagagtatcatacaaaaatatcaaaaatatccgagatggactcgtcggatttttcgcaaaactaacataaaacactgttaagtttttattattgataaaaaaactgggaattcctcaatagaaaatttcagcttccatcgttnnnnnnnnnnnnnnncnnnnnnnnnnnnnnnnnnnnncttatagtttggcctgctttcaccaagaacttcatagattgcaaaaacactttttaccgacatactggcaagtagatctctgacgaagaataacttgcaggcaaatatttgattacctcatattatttcattattgactggcatactatcatcaaataacactactggccaaagatactttgtttagcgagaatttccgatacaaacaactggattttattttgctcattccaatctacgttttaagacaaagttaaagaacagggatattattttgtgtaaacaaacaagtgaatgtttattctaatccaagagaactaaaatgttttcttaggatatgttttaaaggcaaatgataatcttatacaggatcgcataaagttactggtttctgaattaatggaaataaaaaaagatttttgaatcgtactcggtttagtaatgaagtatgacgcttttagtatgacgacataattat

SEQ ID NO: 17754 - DNA, 817 bp, Diabrotica virgifera
  misc_feature (5)..(802): n is a, c, g, or t
  misc_feature (807)..(807): n is a, c, g, or t
atttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattntttttgatta

SEQ ID NO: 17755 - DNA, 704 bp, Diabrotica virgifera
  misc_feature (249)..(274): n is a, c, g, or t
atgttaaagaatgacgtatctcttaacacttatcccgaaaatttccatttcgcgataactctgaatgacggacgatatagacttggtattatcttataaagaaaaaccctattttgttgtccttaagcaactagaactattaattacacttatatattcattattttcgaatcctgattattaacaaactatgatttttatcgtcaaaaaagtatcttcatcaattattatgtaacgaaaggacattcnnnnnnnnnnnnnnnnnnnnnnnnnncacataatttacattgatttattatcgatatatttataattatacatttttatgtgatctagtattacccatatcttaggaatgggcttaaatataaaagtttatgatgatattttccttagataaaaattagaactaaaaacctccttatctatatcacatcgtgtattcattaattgtcatcatcattacttagtttttattttttatcacttcttattatgacaatatataaatgctgctatcttattgtttgccaacgatgatgatcttaatatcaactttatgaatatttatgaaaactatataagatgaataaatacacttcttaaacattctcttctcctgtttattacttgcatgagcttttcgtattagatataaatgctcgcctgcccattgatcagctgcaatggccgcaccattttga

SEQ ID NO: 17756 - DNA, 139 bp, Diabrotica virgifera
  misc_feature (14)..(96): n is a, c, g, or t
  misc_feature (98)..(132): n is a, c, g, or t
aaatgaagggttgnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnggttttt

SEQ ID NO: 17757 - DNA, 936 bp, Diabrotica virgifera
  misc_feature (38)..(57): n is a, c, g, or t
  misc_feature (213)..(268): n is a, c, g, or t
  misc_feature (302)..(398): n is a, c, g, or t
  misc_feature (400)..(875): n is a, c, g, or t
  misc_feature (879)..(900): n is a, c, g, or t
  misc_feature (902)..(935): n is a, c, g, or t
atttttctctctcttaaaataataaaatctctctttcnnnnnnnnnnnnnnnnnnnntctctcttcacgatagttaatctcgtaccgtcgagagaatcatctctctcatccttccacaaaagaaaaatctctcacttcccgtacctccgtcgtatcagggatctactcaattaatcaattaatcatcatttatctactttcgaatctctcaannnnnnnnnnnnnnnnnnnnnnnnnnnnnnnnnnnnnnnnnnnnnnnnnnnnnnnncgtaatcgaaacgttattcgtttttcaaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgnnnnnnnnnnnnnnnnnnnnnngnnnnnnnnnnnnnnnnnnnnnnnnnnnnnnnnnng

SEQ ID NO: 17758 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17759 - DNA, 928 bp, Diabrotica virgifera
  misc_feature (198)..(218): n is a, c, g, or t
  misc_feature (228)..(260): n is a, c, g, or t
  misc_feature (270)..(825): n is a, c, g, or t
  misc_feature (827)..(827): n is a, c, g, or t
  misc_feature (834)..(887): n is a, c, g, or t
  misc_feature (889)..(919): n is a, c, g, or t
ttcacttcttctcaaaacaaaaacacttttacggaaaggtaagaaaatctccattcaatcatagttaatctcgtaccgcgagagaaatactctcactctctaaaagaaaaatcttcactctccgtacctcgcgtatccagggatctcactcaatctcaataattaatcatcatcttaactactttcgaatctctcaannnnnnnnnnnnnnnnnnnnncttttcatcnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanaagcttnnnnnnnnnnnnnnnnnnnnnnnnnnnnnnnnnnnnnnnnnnnnnnnnnnnnnngnnnnnnnnnnnnnnnnnnnnnnnnnnnnnnnaattatttt

SEQ ID NO: 17760 - DNA, 824 bp, Diabrotica virgifera
  misc_feature (198)..(214): n is a, c, g, or t
  misc_feature (772)..(772): n is a, c, g, or t
  misc_feature (804)..(822): n is a, c, g, or t
catctcgcgtccgcaggatgaaactattagttgctattgcctttttgggatatgttgctgctggctcttttggtcgctgccctggtcctgacatcgtgcccatccctggtggtttgagtggagatggaatcaccaccacatactgggactgttgtgctcaaacatgcgcccatcgccaaaatgttaaaactgacaacnnnnnnnnnnnnnnnnnatgtgcaatcgatggcactacgaacatcactatagatcaaaacggtatcgtttcaggatgtagagtaggaggacaggcattcgcatgcagtaatcaacagccgtacgtcgtaagtgacaccttggcactaggttggtcagctgcttctttcacaggtggtatagacaattccaaatgttgtagctgtttcttgttgtcctttaaggaccagctagctggaaaacagatgttggtccaacttgttaacagcggaactgacttggcttcaaaccacttcgatctccaaatacccggaggtggtgtaggtatctggaaccatggatgcgatgctcaatggggagctggcgaaaacggttggggtagaagatatgatggtgtttcttcccttgaagaatgttgtcttctaccagaagttttacaacctggatgcagattcaggttccagttcatggaaggcgtgtatagacccaatgttaccttccaagaagtacaatgtcctgccgagcttattgctgttactgcttgtggaaatttgaattattaagttatacttttcanagatgttctgtgatcgatctaatttttaatgnnnnnnnnnnnnnnnnnnnat

SEQ ID NO: 17761 - DNA, 703 bp, Diabrotica virgifera
  misc_feature (244)..(262): n is a, c, g, or t
aataatactatcgttacattacgttaatactactagtaaccttaggaataccaactggtacaaaacaatataattgtggtaattcttacactaggaacaaaataatcaacctcaaaatataggaattagtaaataatactttggaaaaattgtcattgttacgattgtcagtctaagacaacacacacagtcacattatttatgttatataatactacttaactgaaataattcagaaatgttnnnnnnnnnnnnnnnnnnnaaatccagtctttttggaagatatatagaaatcaaaatacaagtttactggtttccttaacatattttttctttttgaccagtgttcttttaaatatttcaaattaatacaaacaactaaaaaatatatcttagaattaaaaaaaacaatgtcagaagctaggcacaagtaccaggataattattttgcacctaaatttgtactggaacacgactgtaagtatgattttctacttattaatttttattcaaaggcagattattatgatatttaattatcattttgtttgaatctgatattccattcactcacggaaaaatagtgcagaacctccgaattttaaagaatcgcttgtattgacatgaaagttagctaacatatgttagctatgtgtatgtgaaaatgcatgtcaatcctgatgctgggtctttaagattcttt

SEQ ID NO: 17762 - DNA, 315 bp, Diabrotica virgifera
acaaaggatcatgaaatgagaacatatttatcataaatcagagcaagtgtcatatcataaaactcatatttttatcgagaaaaatatcttagacatatttttctcagccgagaaatgtcattagaagtataatagttgatatgatgtaaattgaataaacatataaattattatgatacactgagactatccaccttgtttgctgatgaaatgatttcttgaaccggctagaggtatcaatttgaaacacaatgatatcttagaactaacatagcgaataacggcctcgaactgcatgatcaggaagtatgactg

SEQ ID NO: 17763 - DNA, 251 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (241)..(245): n is a, c, g, or t
  misc_feature (248)..(250): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattannnnnaannna

SEQ ID NO: 17764 - DNA, 132 bp, Diabrotica virgifera
  misc_feature (7)..(25): n is a, c, g, or t
  misc_feature (34)..(78): n is a, c, g, or t
  misc_feature (89)..(125): n is a, c, g, or t
atttatnnnnnnnnnnnnnnnnnnncttttctcnnnnnnnnnnnnnnnnnnnnnnnnnnnnnnnnnnnnnnnnnnnnncgtgagagaannnnnnnnnnnnnnnnnnnnnnnnnnnnnnnnnnnnngtacctc

SEQ ID NO: 17765 - DNA, 906 bp, Diabrotica virgifera
  misc_feature (280)..(317): n is a, c, g, or t
  misc_feature (400)..(417): n is a, c, g, or t
  misc_feature (654)..(678): n is a, c, g, or t
  misc_feature (785)..(785): n is a, c, g, or t
  misc_feature (796)..(797): n is a, c, g, or t
  misc_feature (834)..(834): n is a, c, g, or t
aatctccactcctttctatcgtggcagtcttcctctcttagatttctttcagacatcgccttggagatgccctttattcacgtagttgctggtcttcctagttttcgtttttctgtgagggtctattctaacacttttttggtgattctcctttcgtccattcgtcttacgtgtccgtaccaaccttgctgttgtctttcgatgtcatctcttatttttctttctatttccatttgttgtctaatgttgtcgtttcttatgtgttatagtctagatcttnnnnnnnnnnnnnnnnnnnnnnnnnnnnnnnnnnnnnntaatttatctttgtacttgttggttaattgccagacttcagctccataggttaacactagttttaatattgtgttgtaaattnnnnnnnnnnnnnnnnnncttatattttcttgacacagtaccgaatttattgctcctatcacctgttttccctttactatagtttccttaatattttcttcgtttcgtcctgtactagttagatttatttccagatatatgtattcattgcagcttgtaattgtctcctgttccaggttcaggctctccgtttcttcccgttcgtatttttatttatgccattttaaatcgatgtattattttcgtaacattccnnnnnnnnnnnnnnnnnnnnnnnnngaccttttcctccaccacaaaccttacccaatctcatgcgcttatgtcgcacaaaaaagcagcagtcgacagagataaagtttaataagggcactgtgccaacattnaatgatatggnngtatgatagaataaacaaacttaatacatcttctctnaactgctcttcagtgtgagttattggtgtcgaccaggctgaatcacatgcagatacagtcatcatcccgtct

SEQ ID NO: 17766 - DNA, 165 bp, Diabrotica virgifera
  misc_feature (11)..(42): n is a, c, g, or t
  misc_feature (60)..(103): n is a, c, g, or t
  misc_feature (112)..(155): n is a, c, g, or t
taactgtcttnnnnnnnnnnnnnnnnnnnnnnnnnnnnnnnngtaaaaagcttagattannnnnnnnnnnnnnnnnnnnnnnnnnnnnnnnnnnnnnnnnnnngtgaagttnnnnnnnnnnnnnnnnnnnnnnnnnnnnnnnnnnnnnnnnnnnnaggtgattag

SEQ ID NO: 17767 - DNA, 967 bp, Diabrotica virgifera
  misc_feature (784)..(784): n is a, c, g, or t
  misc_feature (855)..(855): n is a, c, g, or t
  misc_feature (895)..(895): n is a, c, g, or t
aatgtgatatttaactagtgatttattttgtatttatcatatgttttataatttaacgaaaacgtatctttagactgtttgcaagagttgttcatccactgcatggacttttgggtaaaagacgtatagcaggttttacaaagcttcggtaattggacacatatttgacattaatcagtcaactgtcatacaacatactcatttttatttcaaggaaataatcttagaataagtattttttgcgtaaacatgttatatgacgtataatagataatatgatgtatattccatagacatatatattattatcatagactgagcctaccctccgcgcttcctggcgacaagatctcttggacaggtttgcggtatctctttctagcacattgtatcgagaaactaacatgaaactgagtgggggtataggcacggaaagggaggactactgtcgcagctttactatgcataagagtgaaacagcactgagccacaaaaaaaaagatggtgtcgtcacttcgcgcaacatgacactctatgataatgtgtgtgtctatggtatatcccagtggacatcctaagtcttgacgtcacaaaattgggagtagcttatatttggctccaggcaattctgtttgtgatgttaagcactcatagggaatttttaatttattgtttatgtggtttgtgtgacaaaataagacttttcatttgggtatttagttggagagacgtgccggttaagagatttttattcgtttttgcccaggtgagttaatttaattanatgattagaatgtaaacagttttgaggttatgtttatttttcatcactaaggaataaaaaacacctgagcnaaaacgaataaaaagtctcctagttgacacgtttctttgncggaatacctaaatggagtcttattttgccgcacaaagcacataaatgaaaaattccttatgaccatttgac

SEQ ID NO: 17768 - DNA, 521 bp, Diabrotica virgifera; identical to SEQ ID NO: 7280
  misc_feature (23)..(322): n is a, c, g, or t
  misc_feature (329)..(366): n is a, c, g, or t
  misc_feature (386)..(399): n is a, c, g, or t
  misc_feature (402)..(424): n is a, c, g, or t
  misc_feature (432)..(454): n is a, c, g, or t
  misc_feature (484)..(515): n is a, c, g, or t

SEQ ID NO: 17769 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17770 - DNA, 960 bp, Diabrotica virgifera
  misc_feature (19)..(44): n is a, c, g, or t
tcacaacaaccttttaatnnnnnnnnnnnnnnnnnnnnnnnnnncttttaaatattgcaagaataagtacaaagtacagcttaagtatttgccaaataaaattgtcaggtcttcagatcatacacaaaatggcaaacattcaaagcagcaaagttaaaatcatagtaaaatcatcttttaaaaataaacattttcttgggagaattttagaaagtaggtagatagatcatgttgaaaacgtttacaaaagaggagagagcaacaaggaagtgaggttagacgtcatttaaatggacgataaaatggcctcatataaatgacagttgacatgacaaatttctcgtattttgttcttccccacttttatattattttagtaccaagttaaaatacaagcttatgattgaaaataaaggagcaggaaaaatccaagccaagaaacaaaagtgctgcaggaaaaatagttgaatagattaccaaaaatggactaaaaacattaaattgttcacgtgactggactcttaattactaatcagtcttacatttttgattggttcttttgatttccatttatatatcgactgatttgttctaaacattttcgaaggttaaaataattgatgtgtaaaaaagatataaaattaattcagaaatgttgtttgttcattgtttatttctgctgaatatattgtagtaaatccatagcagttactattcccaagggcttttcaacagctcctttggaatcgagaactacaacataagattctttttccaaaattcttgagataagaccgatgcttgctgttttttgaactttaggataaattcgcaccacacatcgttccaccgtttcgttagattttatggtacctctaagtaggccctgcatcaaattctgtaacgttaacatccccaccatatttcctgcactatcaccgacaggtgtttgatctatcc

SEQ ID NO: 17771 - DNA, 942 bp, Diabrotica virgifera
  misc_feature (65)..(89): n is a, c, g, or t
  misc_feature (173)..(191): n is a, c, g, or t
  misc_feature (905)..(905): n is a, c, g, or t
  misc_feature (930)..(930): n is a, c, g, or t
gcaaaaatacttatattcctaatacataaaacatttactaattcactattatttgataaaattgnnnnnnnnnnnnnnnnnnnnnnnnnagccataaacctccaatagggtgtttcaaaatataaaatggatcgtatttcagaggcagttgggtcttactattcaacgttacnnnnnnnnnnnnnnnnnnntacgcaattcctagtttgatttgagtttgtgcgaatcgttgtcctaaacaagcacggggtccatctccgaagggaaaataggtatacctcttaacctgattgtctaaaaaccgttccggtttatatttgtccgggtcctcgaaatattttgggtccatttgcacagcaagcaatggcaccataacaacatctcccactttcatgttaactgtaagaggcttataatcagaatttgttggggtatacgtgtaatcctcagtgcacaccttgcttagcatgtataccacagaatttactcttagagattcacttaaacaagcatctaaatactgaagttcattgacactttcataggtaaactgatcattatttttcttataaatgtcagtaagttgctctcttagttttgtttgtacatctgggtttaatgcgaaatcatacagcaagaaggccaaaggcgaatataaaaatctcagaactgtgtccagtggtgaaggaaagccctcttgggacatagtaagaaatgtggaaattaagaagttactaaaggccatggaagagagtcgtccagatatgtggaaagacgatttaccaaccaaagaacatcttgagctcatattgtgggcttatagtccagatgcaagtaaaattaaaaagaatggtagtaattacgaagaaaatttagatctaaaaaccagatagctctgaagatgnagagatggacgacgacgatgatgantggagaggagag

SEQ ID NO: 17772 - DNA, 691 bp, Diabrotica virgifera
  misc_feature (490)..(507): n is a, c, g, or t
agttagtagtaggtttaattcataatgaaaccttcactctcttttgcatttaatgagccaaaagttatcagaatttaaataaattagaatcatattaattcctctacaaatggatatgatacaaatgagaagacttctagaaaaaatcagacggagattcctgtgccaaagggtaaattaaagaaagagcatctactcaatcaaatcaccctaaaattcagattctaagttcatcgcaagtttttgaacacaacaaaaggtaagaagaaataaacaaggaaccagcccgtttatagaaatttgaggactttacagcacaacgagagataaatatgaaagaactgtggtctaaaatactataagaattcattgaatatttacaacaactagaaaataatagaaatcaagatcttcaagaatatgataagaagtcttccaattcgcaagaacaattgaatatatactacttagatttataattgataagacnnnnnnnnnnnnnnnnnntataagagactagaatatgaaaaacaaatcctctataatagcatagatgaaagtataatgttacgatcagaattttcgagactttacaagaacatcgtacacaagatctcaagatgtcagagaacataacatctgaaggatcatcacgcacaacattttcatctactatactccttgacatcta

SEQ ID NO: 17773 - DNA, 402 bp, Diabrotica virgifera
  misc_feature (2)..(211): n is a, c, g, or t
  misc_feature (218)..(255): n is a, c, g, or t
  misc_feature (275)..(288): n is a, c, g, or t
  misc_feature (291)..(313): n is a, c, g, or t
  misc_feature (325)..(325): n is a, c, g, or t
  misc_feature (371)..(401): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatggtggatnnnnnnnnnnnnnnggnnnnnnnnnnnnnnnnnnnnnnntgttcgactttnaaattttacatgatctgagttaaaccggtgtgagcccaggtggttnnnnnnnnnnnnnnnnnnnnnnnnnnnnnnng

SEQ ID NO: 17774 - DNA, 591 bp, Diabrotica virgifera
  misc_feature (28)..(45): n is a, c, g, or t
  misc_feature (70)..(70): n is a, c, g, or t
  misc_feature (106)..(148): n is a, c, g, or t
  misc_feature (178)..(264): n is a, c, g, or t
  misc_feature (422)..(455): n is a, c, g, or t
  misc_feature (537)..(565): n is a, c, g, or t
ttgtgggtggtttttgtttttccctgtnnnnnnnnnnnnnnnnnnttgtgtgttgtgtgttgttgtgtgntttttttgttttgttgttttgggtttttgttgaggnnnnnnnnnnnnnnnnnnnnnnnnnnnnnnnnnnnnnnnnnnngtttgtttggatgaaatgttattagtttgnnnnnnnnnnnnnnnnnnnnnnnnnnnnnnnnnnnnnnnnnnnnnnnnnnnnnnnnnnnnnnnnnnnnnnnnnnnnnnnnnnnnnnngatagttttagggatgaggttaataataatagtttagtagaatttaattgttatataaaaattaggtttaatgattttaatagttgataatatgtgattatttattatgatatattattatgtttattgttgataaagtgtttattataatatagtgnnnnnnnnnnnnnnnnnnnnnnnnnnnnnnnnnntagtattagagaagtgtatatttagatgaaatatataggtttgataaaggaatttgttaaaagttttttgagttgattatgnnnnnnnnnnnnnnnnnnnnnnnnnnnnnggtgtcgtcagagcactgattatgtt

SEQ ID NO: 17775 - DNA, 903 bp, Diabrotica virgifera
  misc_feature (427)..(447): n is a, c, g, or t
  misc_feature (576)..(593): n is a, c, g, or t
  misc_feature (715)..(728): n is a, c, g, or t
  misc_feature (730)..(746): n is a, c, g, or t
  misc_feature (826)..(826): n is a, c, g, or t
  misc_feature (835)..(835): n is a, c, g, or t
  misc_feature (889)..(889): n is a, c, g, or t
cttaaagtttgactaattttttttaatatgttaagccgaaattgtgtaattctttcaagacatgttttaaatcagacggtaaatttatacgaaaagaattgttttcatcaaaatgctaaacatcgaatctatcttcacaaattggatggtaaaaatggttggcgttctatatcctggacaaaagtattttttaatgaccaatcttcagacgacctgaaaagcaaaaacaaaaaccttcagaataaaagtgataaaaagacaaagccagcactggaagtaatttcaccggaactgtctgcagttaaaaaagaaacaacagttgtactggaaaatgtcaaagaaaagagtcttcaatctgaaaatgaagaaaatcccaaaatattatctgcagattcaattaagaagttgaaagataaaattattgggnnnnnnnnnnnnnnnnnnnnnaaagcaaaatctccacctaagaaaagaaagaggattgatctgtctgctcaatccttggaaagaaacttcataacacctgtgaaggctatgtctgattttctcctaaagccatctgatctagaagtattnnnnnnnnnnnnnnnnnngtccccttatgagtctgaaccaccaataacagtctattggaggaaagatgtcgaagccaaagcattagaaatatggggaacacatgaaaatcttcatagggaacttttaaagagggatattnnnnnnnnnnnnnntnnnnnnnnnnnnnnnnntgtcaaaagaagacttagagatttccgacgagaaatgggaaaatctgcagatataatagaagatgatggtggattgatgngaagatctnggaaaagttgttcttacagcagtagttataaatggaacaaattttttatttaangtatgtgcatgggt

SEQ ID NO: 17776 - DNA, 909 bp, Diabrotica virgifera
  misc_feature (667)..(685): n is a, c, g, or t
  misc_feature (862)..(862): n is a, c, g, or t
caacaaatcacaaagatattggcaccctatatttcatttttggaatatgagcaggaatattaggtacatcactaagatgaattattcgaattgaattaggaataccaggatcatttattggagatgatcaaacatataatgttgtagttacagcccatgctttcatcataattttcttcatagttataccaatcataattggaggatttggaaattgattagtgcctttaataatcggagccccagatatagcattcccacgaataaacaatataagattttgactattacccccatcaattacattgttaattatgagtagaattgttgaaaatggagcagggaccggatgaactgtttaccccccattatcagcaaatatttcccataatggagcatcagtagatttagcaatcttttcacttcatctagcaggagtaagatcaattttaggagcagtaaattttatttcaacaattattaacatacgacctataggaataaatgcagaatgaatcccattatttgtatgatcagtaggaatcactgcactactattacttttatcattacctgtattagcaggtgccattactatattattaacagatcgaaattttaatacatcattttttgacccggcagggggtggagatccaattctatnnnnnnnnnnnnnnnnnnnctttggacacccagaagtatacattttaattctaccaggatttggactaatctcacatattgttagacaagaaagagggaaaaacgaagcatttggatcattaggaataatttatgccataataacaattgggctattaggatttattgtatgagcacatcatatattcacagtagngtatagatgtagatacacgagcatatttcacatcagctacaataaat

SEQ ID NO: 17777 - DNA, 987 bp, Diabrotica virgifera
  misc_feature (870)..(870): n is a, c, g, or t
cattttctaaatcccgaatcagagtttttaagtttgagtgtacattttttcgagcatgttttttcacaagaactttatcgtgatcgtgtttttgtgtatttggtctttagggtgtggagatgagaatattttggaacggaatagggaaaatactgcaaagcagcatcctgaactgtcaaaattagttaaaaattgggcaacaaaacttggaggagaattatggcactttggcgaccttgtaactcgacaaaatagagtaagagacagcttcaaagaaacaaatttggtagttgaagatggagaagccttacttcaaactatccatgaaaatatttcccacatgatgaaacagaaagttgatgcagtaaggagaataatggatcaagcagaacaaattgctcaagctcaaaaagaaaccgatattgacttcaattttccatttttcaatgccaaaaatttgaccaactctctggataatactactgaagaaactacaaaagaacctgaacctgaagaacttcaggatgattcatttatatctagtcgttatcaagatcagcaagatcagccctatagtcaaccattactccaacaggaagattttgatgaatatcaaagagatgaagatacggaatcatctgaggagccttcttctaaagatgaagatttacttgatgcagatttagaggtgactgataatacagaaaaagatccccaagctattttaaataaagcaccgatagataagtccaaattgccattaattagaaatagaaatttctacgatattcctgttaatatgaatgttagtgccgtccatgtacctagtaacgtatatgaaagagccaaagaagtgattgctggtattanatggtcagaagaattggataaacatttaatctaactatgaagtagatccaactttatcggtggcagtattttggaagctctactggatttttatgagacatatcctgccatgatttg

SEQ ID NO: 17778 - DNA, 748 bp, Diabrotica virgifera
  misc_feature (54)..(54): n is a, c, g, or t
  misc_feature (64)..(64): n is a, c, g, or t
  misc_feature (72)..(72): n is a, c, g, or t
  misc_feature (79)..(79): n is a, c, g, or t
  misc_feature (87)..(87): n is a, c, g, or t
  misc_feature (91)..(91): n is a, c, g, or t
  misc_feature (96)..(96): n is a, c, g, or t
  misc_feature (108)..(108): n is a, c, g, or t
  misc_feature (110)..(110): n is a, c, g, or t
  misc_feature (142)..(142): n is a, c, g, or t
  misc_feature (153)..(153): n is a, c, g, or t
  misc_feature (160)..(160): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (190)..(190): n is a, c, g, or t
  misc_feature (192)..(192): n is a, c, g, or t
  misc_feature (198)..(199): n is a, c, g, or t
  misc_feature (206)..(206): n is a, c, g, or t
  misc_feature (208)..(209): n is a, c, g, or t
  misc_feature (224)..(224): n is a, c, g, or t
  misc_feature (231)..(232): n is a, c, g, or t
  misc_feature (241)..(241): n is a, c, g, or t
  misc_feature (248)..(249): n is a, c, g, or t
  misc_feature (258)..(258): n is a, c, g, or t
  misc_feature (265)..(265): n is a, c, g, or t
  misc_feature (283)..(283): n is a, c, g, or t
  misc_feature (292)..(292): n is a, c, g, or t
  misc_feature (295)..(297): n is a, c, g, or t
  misc_feature (307)..(307): n is a, c, g, or t
  misc_feature (316)..(317): n is a, c, g, or t
  misc_feature (319)..(320): n is a, c, g, or t
  misc_feature (331)..(331): n is a, c, g, or t
  misc_feature (335)..(336): n is a, c, g, or t
  misc_feature (342)..(342): n is a, c, g, or t
  misc_feature (352)..(352): n is a, c, g, or t
  misc_feature (354)..(354): n is a, c, g, or t
  misc_feature (357)..(358): n is a, c, g, or t
  misc_feature (364)..(364): n is a, c, g, or t
  misc_feature (369)..(369): n is a, c, g, or t
  misc_feature (388)..(388): n is a, c, g, or t
  misc_feature (394)..(394): n is a, c, g, or t
  misc_feature (403)..(403): n is a, c, g, or t
  misc_feature (406)..(406): n is a, c, g, or t
  misc_feature (408)..(408): n is a, c, g, or t
  misc_feature (416)..(416): n is a, c, g, or t
  misc_feature (425)..(425): n is a, c, g, or t
  misc_feature (427)..(428): n is a, c, g, or t
  misc_feature (432)..(432): n is a, c, g, or t
  misc_feature (434)..(434): n is a, c, g, or t
  misc_feature (450)..(450): n is a, c, g, or t
  misc_feature (456)..(457): n is a, c, g, or t
  misc_feature (460)..(460): n is a, c, g, or t
  misc_feature (468)..(468): n is a, c, g, or t
  misc_feature (476)..(476): n is a, c, g, or t
  misc_feature (484)..(484): n is a, c, g, or t
  misc_feature (486)..(486): n is a, c, g, or t
  misc_feature (490)..(490): n is a, c, g, or t
  misc_feature (493)..(493): n is a, c, g, or t
  misc_feature (501)..(501): n is a, c, g, or t
  misc_feature (509)..(509): n is a, c, g, or t
  misc_feature (515)..(515): n is a, c, g, or t
  misc_feature (528)..(528): n is a, c, g, or t
  misc_feature (534)..(534): n is a, c, g, or t
  misc_feature (543)..(543): n is a, c, g, or t
  misc_feature (547)..(547): n is a, c, g, or t
  misc_feature (552)..(552): n is a, c, g, or t
  misc_feature (566)..(566): n is a, c, g, or t
  misc_feature (569)..(569): n is a, c, g, or t
  misc_feature (572)..(572): n is a, c, g, or t
  misc_feature (579)..(579): n is a, c, g, or t
  misc_feature (585)..(585): n is a, c, g, or t
  misc_feature (594)..(594): n is a, c, g, or t
  misc_feature (598)..(598): n is a, c, g, or t
  misc_feature (611)..(612): n is a, c, g, or t
  misc_feature (614)..(614): n is a, c, g, or t
  misc_feature (620)..(621): n is a, c, g, or t
  misc_feature (624)..(624): n is a, c, g, or t
  misc_feature (628)..(628): n is a, c, g, or t
  misc_feature (631)..(631): n is a, c, g, or t
  misc_feature (642)..(664): n is a, c, g, or t
  misc_feature (677)..(677): n is a, c, g, or t
  misc_feature (687)..(687): n is a, c, g, or t
  misc_feature (694)..(694): n is a, c, g, or t
  misc_feature (705)..(723): n is a, c, g, or t
  misc_feature (727)..(727): n is a, c, g, or t
  misc_feature (741)..(741): n is a, c, g, or t
cctccgggcggaaaattaagaagggattgtctagataccttttaaaaaatgatnttggtttaantgataaanaaatagntagaattnaagntatantgttagatagantnttagtgaaaattgaagaaggagttgaaagagngaaaaaggaanatgaaanaaggaaaanaanganaataattaagaaatnanaagaanntgatganannggtatatttgatganataaaannagaaggatnaatattnnaaagtgganatagganaattataagaaatagaanagtgataangannnataataaatnagggggagnntnntttggaattanagannaaggtnaatttatatnanaannaaaatntaaanagggtggagaaaatgaagntgattntttaataanagntnttagaaanttaagtaantnnaaananaagaaagtagtagagnaagaannaanagataatnatgttaanagttattnanatanaanagtttatnaaggtggnagtagnattggtggatatnaagaanaagaggtanaganagganatggtaataatganggnttngataatnaagaanaagagattnaaantggatatggtggnngnggtagnnatnattnttnaatatatagtnnnnnnnnnnnnnnnnnnnnnnntggatatggtagnaatagaaatngtggttnaggttaagatnnnnnnnnnnnnnnnnnnnaatntggatatggaggtnataatag

SEQ ID NO: 17779 - DNA, 485 bp, Diabrotica virgifera
  misc_feature (11)..(44): n is a, c, g, or t
  misc_feature (54)..(80): n is a, c, g, or t
ttatttacatnnnnnnnnnnnnnnnnnnnnnnnnnnnnnnnnnnttattaactnnnnnnnnnnnnnnnnnnnnnnnnnnnctataacaaatatatacggatagacgcttccaggagcatagtattacacatgttgattattatataactctaaaaccaattatcgttcacattatattgcggctcagagaaaccttaaagattatctagaatctgttcacaagataaattctttataaactgactaatataaaacatttacatgatacaacgacatatatcatatgtttataactctagtgtatttttacccatctttatataccccatatataggtgcaccaattccattctttctccggattctgacttgcctatcccccctaagtctaacgctgacccccccgccctacccactgctgcaccttggaggatcatgtctatttctgccgaagcttttctgatgctaaattctttatatttttc

SEQ ID NO: 17780 - DNA, 676 bp, Diabrotica virgifera
  misc_feature (6)..(25): n is a, c, g, or t
  misc_feature (125)..(147): n is a, c, g, or t
  misc_feature (300)..(366): n is a, c, g, or t
  misc_feature (455)..(482): n is a, c, g, or t
  misc_feature (586)..(630): n is a, c, g, or t
acaatnnnnnnnnnnnnnnnnnnnnactccatattatacttatggtcacaattaagggggtaggagaaaaatttcggctaccattcttattaaatgcattaattttttcgaatcctgaaaaaacnnnnnnnnnnnnnnnnnnnnnnnacacgcagaataaaagatatgtaacatatatgagatatctgcaattattactgagcgccgaaagtccctttagaataaacaataagtttcttttgaatcagatgtttatgattataaatcacactaaattttctcttatttttacacacctgnnnnnnnnnnnnnnnnnnnnnnnnnnnnnnnnnnnnnnnnnnnnnnnnnnnnnnnnnnnnnnnnnnngggtaagcttaaaaatataaacttattagattttaatttgaaaataaaaattacgatcatcaattttcatattttagaacatgttatgnnnnnnnnnnnnnnnnnnnnnnnnnnnngatttataaagatgtgattagaatataaattacttatttagaatttagaaaggatgataacattagtagtactgtattgtatatttagaaagaacatatagggnnnnnnnnnnnnnnnnnnnnnnnnnnnnnnnnnnnnnnnnnnnnngcatgtctatttgtattagatagactgtcccgcctgcccactgatt

SEQ ID NO: 17781 - DNA, 567 bp, Diabrotica virgifera
  misc_feature (24)..(42): n is a, c, g, or t
  misc_feature (102)..(120): n is a, c, g, or t
  misc_feature (227)..(247): n is a, c, g, or t
  misc_feature (302)..(331): n is a, c, g, or t
  misc_feature (336)..(362): n is a, c, g, or t
  misc_feature (389)..(418): n is a, c, g, or t
  misc_feature (423)..(447): n is a, c, g, or t
ccctaaggggccgatatatttatnnnnnnnnnnnnnnnnnnncctttttgaggaaaagtaaagaagaattttatttagagataggaaagaagaagtgagagnnnnnnnnnnnnnnnnnnntaaaagtatttttttgttacgtaagaataaaataattattaaagtaataagtatatttaaattagtttagaaaataaaagagatatttgaattcaaattgttattgnnnnnnnnnnnnnnnnnnnnngtggtgttgttgatatgtgattattgtttgtatataaatagaaagttgagaagannnnnnnnnnnnnnnnnnnnnnnnnnnnnnaatgnnnnnnnnnnnnnnnnnnnnnnnnnnnagaaagatatatatgagaggcataagnnnnnnnnnnnnnnnnnnnnnnnnnnnnnngatgnnnnnnnnnnnnnnnnnnnnnnnnngtaagagataaggataaattattagaatatgatttatatgataaattttttataaagagattaatatattatattgacaggataatatgagattatgatatgatgagaaaagaagtgtat

SEQ ID NO: 17782 - DNA, 750 bp, Diabrotica virgifera
  misc_feature (12)..(30): n is a, c, g, or t
  misc_feature (314)..(334): n is a, c, g, or t
  misc_feature (376)..(397): n is a, c, g, or t
  misc_feature (449)..(463): n is a, c, g, or t
  misc_feature (465)..(480): n is a, c, g, or t
  misc_feature (517)..(537): n is a, c, g, or t
  misc_feature (558)..(572): n is a, c, g, or t
  misc_feature (688)..(710): n is a, c, g, or t
gatctaaatatnnnnnnnnnnnnnnnnnnnctgtgcctattcggactaaaaaatatatattctgaagatacaaaccaacctgacttcacaccgtgtttaaagctcagatcatgtacaattttatatgtacaacagacttaatactatagctgctacacccattataaactttaacccaacgtctaggtcataatctttattatcgatttgaactctccgagaaaagtacgctgccatccctagcgtaatttattcttatgatcaaaaaaattggaatcataaaattatgtagtaatataataatataaagaaannnnnnnnnnnnnnnnnnnnnccccacctactgaaatttatgatataaataaatttagtacgnnnnnnnnnnnnnnnnnnnnnnataaaactctatagtggcttctcgccgtttaaaaagatttaagttttttaannnnnnnnnnnnnnncnnnnnnnnnnnnnnnnggacagattttttttcatccaacccttcgttccagtnnnnnnnnnnnnnnnnnnnnnttatgctaccttatctcgcannnnnnnnnnnnnnnattcaaattaatcaatgcgcgcagtcgaatgagaataaattcacgtactagcattcgctagcgctagaccgttgcagcccatttttaacattgacagtatgccggatttgaagctnnnnnnnnnnnnnnnnnnnnnnngtagatacttgaattttatgaatattattatgttgcacat

SEQ ID NO: 17783 - DNA, 97 bp, Diabrotica virgifera
  misc_feature (2)..(40): n is a, c, g, or t
  misc_feature (52)..(82): n is a, c, g, or t
annnnnnnnnnnnnnnnnnnnnnnnnnnnnnnnnnnnnnnacgcggtattgnnnnnnnnnnnnnnnnnnnnnnnnnnnnnnngttttattggaagct

SEQ ID NO: 17784 - DNA, 113 bp, Diabrotica virgifera
  misc_feature (40)..(80): n is a, c, g, or t
tattattaaacatgtctcatattttaatttgatgatatcnnnnnnnnnnnnnnnnnnnnnnnnnnnnnnnnnnnnnnnnngctagtaaaataataacattatattggatattt

SEQ ID NO: 17785 - DNA, 919 bp, Diabrotica virgifera
  misc_feature (44)..(916): n is a, c, g, or t
gcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcc

SEQ ID NO: 17786 - DNA, 483 bp, Diabrotica virgifera
caaaaagaaggaaaaaaggggagaagcccccttttaagggagactttatagactgaaattccatatgtcgcggaggaagcaaacgagacgaaaattacgcatactcttgatattggtcgctcgtacggtatgcttctgatgacaacgccacgagttataaatcacctatacactgattcagaaaagaatacagacttatgattcaaaacgaaatgtattaattactccgtcgctgaatgaggggcataggatatgaagtgaccacctgtttacatcaaggagagtaaccctggatatgcaacttaataatcatcacgaagaacttgaattatgtatcacaataagtacaatatgcggatgcgtgcatccaggagcattgtgcacgcagaagttgacaataaaaatctaagatcatttgacgttaccatcaccattgcggtactgagatgtctttaatgcccactagactcagcacaacaagac

SEQ ID NO: 17787 - DNA, 796 bp, Diabrotica virgifera
  misc_feature (7)..(751): n is a, c, g, or t
  misc_feature (761)..(791): n is a, c, g, or t
  misc_feature (795)..(795): n is a, c, g, or t
atattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagannnnnnnnnnnnnnnnnnnnnnnnnnnnnnntaang

SEQ ID NO: 17788 - DNA, 144 bp, Diabrotica virgifera
  misc_feature (2)..(99): n is a, c, g, or t
  misc_feature (106)..(143): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnnt

SEQ ID NO: 17789 - DNA, 978 bp, Diabrotica virgifera
  misc_feature (32)..(51): n is a, c, g, or t
  misc_feature (394)..(416): n is a, c, g, or t
  misc_feature (796)..(796): n is a, c, g, or t
  misc_feature (863)..(863): n is a, c, g, or t
ctgttcgacttttacacaagctgatagccccnnnnnnnnnnnnnnnnnnnnttatgaatttctttatccataaaaatagttaatattgtttaattaaagaaacatgactataatagtatttttaatagatacatcagcttctatgctgcaaaggacctatatagggggtcgtacgactcttctagatgtagcgaaatctgcagtagaaacttttgtaaaaattcgtcaaagaagtatggatagcaggaatgataggtatatgcttttaacatttgaagatacgccaaccaatataaaagcaggatggaaagaaaatttagctacatttatgaatgaattgaagaatttgcaagcatactctttgacgacaatggggctagcagtgaagcaggcnnnnnnnnnnnnnnnnnnnnnnngaatgacttcagggatagatacttatggacagggaagatgcccattttatttggaaactgctgtaattgtgttaattacagacggtggaaagttaactacagtaaatggagttcaggaagaatttaatttaccaatgaattcacccatcccaggatcagaaatgaccagggaaccttttagatgggatcaaagattatttgctctagtacttaggttgacaggtacccctgccgtagaaagagacacaggattggtgcctagtgatagtagtccaatagatgcaatgtgtgaagtaaccggaggtcgttcgtattgtataacatcacataggatgttgaatcaatgtattgatagcttagttcaaaaggtacaaaatggncgttgtgatcaactttgagaaaataggtccagaccctcctcctccccagtatgataaagaagatggntaaggatgatattcttaaaaaaacgaatatgctgagatgaataatgatcgaggtctgaatatgcctataaatacatcgtgccacaatttgtaggaaaatgatatatgttcctaaa

SEQ ID NO: 17790 - DNA, 80 bp, Diabrotica virgifera
  misc_feature (3)..(79): n is a, c, g, or t
gtnnnnnnnnnnnnnnnnnnnnnnnnnnnnnnnnnnnnnnnnnnnnnnnnnnnnnnnnnnnnnnnnnnnnnnnnnnnnna

SEQ ID NO: 17791 - DNA, 899 bp, Diabrotica virgifera
  misc_feature (61)..(78): n is a, c, g, or t
  misc_feature (772)..(772): n is a, c, g, or t
gtagaatttagaaatgagattgtgatatattttttgtgaaaataagtgttgttgtaattgnnnnnnnnnnnnnnnnnnattagtagtgtctgtgcttttcttcactgttaagtgatttgatatcaagtttataatttattctacgtgcatataacttaatttagggtgaataaatatgttaaaatgaaaggaaacaagatcaatgctaaaagctgaaagttaaacatatgtttctgtaaaaacgtaaacgatgtcttggatgaagagaagaggtccaagtacacctagccctgctccagcgcctgcagtacctatgtacaaccccaatcaacattccgcaacacaagagacacaatggcaaaaccaaccagtccaaaacaattggtatcaaggacaacaacatgcacagtatcaaccagtgccgaaacaagaaaataccaatccaccccagcagaattactggcaacaacaacaacacaatcctctctcatacaatcaaaacagtcagtataatcaacatcagtatcaaaatcagcaacacacgggatatgtccaaaataactctggatatgaacaacaacattatagtaatgtgcaatatagtcaattgaacaaccaaaataatgtttatggaactggaactcagagtggacagcaacagactggagaagacccttggaattggtcatggggggatgaagacaattcaaatgtgcagccaactccccaagcgaccatcactcctaaccaaacaggaggacaaaccgatggntcgtttggaaatctggatacatggaaatggcctgctcaggaggccgaaaaatcctgtcaagaatgaagaaacccacagatacgcatgagttatttcccaaaaattggtttaatggcttaaaatctct

SEQ ID NO: 17792 - DNA, 823 bp, Diabrotica virgifera
  misc_feature (5)..(22): n is a, c, g, or t
  misc_feature (56)..(78): n is a, c, g, or t
  misc_feature (304)..(324): n is a, c, g, or t
  misc_feature (403)..(422): n is a, c, g, or t
  misc_feature (487)..(535): n is a, c, g, or t
  misc_feature (668)..(668): n is a, c, g, or t
  misc_feature (675)..(695): n is a, c, g, or t
  misc_feature (822)..(822): n is a, c, g, or t
tgaannnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattgnggtattnnnnnnnnnnnnnnnnnnnnnagaagctttttcttttcaacgaaaaagattaagacctttaagaataacttcttcaattgaatgactacaatttaaccctccagctgaacacagatattcctgattgcccatattatcatccaattanc

SEQ ID NO: 17793 - DNA, 833 bp, Diabrotica virgifera
  misc_feature (79)..(98): n is a, c, g, or t
  misc_feature (471)..(491): n is a, c, g, or t
  misc_feature (771)..(771): n is a, c, g, or t
  misc_feature (788)..(788): n is a, c, g, or t
  misc_feature (792)..(792): n is a, c, g, or t
cgaaagtgtcctccttcatgtttactaatggcagataatttccggaaggtctagatggactaagtctagaatggacttnnnnnnnnnnnnnnnnnnnncaagttaaaaacatccactttggtcatagcaggagttaaccatcgttttacatacagttccaatggcacatcctctaagtagtcttacgctcggtttcttaatcagttaaagtggactttaaattttaagttggtacctttatcaatgcaattcatataggtaaatgtcaactttaaagtgaactttagttaatgttcagttgattacgaaaccgggcgtaagtcttcgtctgaagacaatgttattacaacgtctttaggtagtgtcaaatttccttctgtaaggttatcaccctcaatgtaaaccttcgtatttctttccatagacatttcgaatactaatattctcaaaatcatctagagatgccttacnnnnnnnnnnnnnnnnnnnnntactcccatacgcccattgtactcacatgagtacacctaatattagcaacaaataaatcacgttataattaaaattctggaaaatgaatcactctttactaaacttattacaaattaacgtaaacctcttgatggtaaaaagaagtaaatgagagaagctcactgtaaatttacaaagtcgatgtcgagaaaataaaaaacacatgtgctgacttcataaacaataaattaaacctaacaaaccggctgaatcatagtttcctgtaattactaagaattngcactattttattgtgnatgnaactggtatttcaaaatagcagctgtacttaaatgagtaca

SEQ ID NO: 17794 - DNA, 136 bp, Diabrotica virgifera
  misc_feature (7)..(44): n is a, c, g, or t
  misc_feature (49)..(49): n is a, c, g, or t
  misc_feature (62)..(63): n is a, c, g, or t
  misc_feature (82)..(100): n is a, c, g, or t
  misc_feature (103)..(103): n is a, c, g, or t
  misc_feature (108)..(108): n is a, c, g, or t
  misc_feature (114)..(135): n is a, c, g, or t
taacagnnnnnnnnnnnnnnnnnnnnnnnnnnnnnnnnnnnnnntgcgnacctcgatgttgnnattaaagtttataattggnnnnnnnnnnnnnnnnnnnaangtctngtcgannnnnnnnnnnnnnnnnnnnnna

SEQ ID NO: 17795 - DNA, 709 bp, Diabrotica virgifera
  misc_feature (438)..(461): n is a, c, g, or t
  misc_feature (607)..(626): n is a, c, g, or t
caaatagattatgaatcctatgaatggaagaagttagatgccaaatcagaagaaacaaagaaattagtagagcaatacttctcatggacaggtactagataagatgagaaagcaggcctttgcatctgtatgcctttttggagaagacaacaacagcacaatctccggtatctgggtatggagaggacaagaattagcttttaccttaagtcccgactggcaaatagattatgaatcctatgaatggaagaagttagatgccaaatcagaagaaacaaagaaattagtagagcaatacttctcatggacaggtactgacaaacaaggtagaaaattcaatcaaggaaaaatctttaaatgatctacatctatttaataaatcttacaaaatgctgtactgatcatgtgaagcaagagaaataaatcccaatgttttgnnnnnnnnnnnnnnnnnnnnnnnngtaattgttttgatcgaagcttattctttgggctttactccctgagtttataagacacttaaataaatttaataacaattaacatatgagatccaataagattaaagacaaattgaagaagataaaaaaagaatatttcatgatgnnnnnnnnnnnnnnnnnnnncttcaagccaccaagtccgttatctcacactattctcaaagaagaagtaacaaatagtcagtaatacaccattggggggcgcc

SEQ ID NO: 17796 - DNA, 851 bp, Diabrotica virgifera
  misc_feature (773)..(773): n is a, c, g, or t
attaataagagatgttttagtaagatattcctatgaactaataattgctacatatgtactgtttttttgtatatgaaggcaaaatatctagggttagtagttggtatattaagaaaaaactttgatagaaaaatttaagagtaaaataatatccagtatcatttaaaatttactgtttataaattctcatcaaatttagtgtttgaaaagttcaattttttacatatttaaaacaattcggggaaatcaataaaataaaacacccagacatgattcttatttaccaacataagagacgaaatgttaacccagaaatatgtacttatgcacacataattattataaaatggtatgtacctatataactaaaattgataaatttgatgaaaatttagaaaaaaagtagttttcagtgtttcatttagaaatgatattttatcaagcattagttgaatccatcaattacatgcttgcacttgaactgcttaatacatatataaaacgttttatggtacatttgttaaagaggatttattgtataaattaaacatatgacattaattttgtacaaaacagtgacttgtggtttctccatcactgaagcaatctgcaatcattaaactgtatagcaaaaatataagtaatatcactgttataggtaggtactatacagtgatgagcgcgccaataaccaacaaaacaacgcacaagatggaaaacacaatacattgtgaagcaaaaagagatggaaatcatcgatataaacgtataanataataacattacattaggtacatagttttacacctttatacgtatcggatcaatatgacaactctcactgtgacatg

SEQ ID NO: 17797 - DNA, 924 bp, Diabrotica virgifera
  misc_feature (705)..(705): n is a, c, g, or t
  misc_feature (713)..(713): n is a, c, g, or t
  misc_feature (838)..(838): n is a, c, g, or t
  misc_feature (844)..(844): n is a, c, g, or t
aatcgccaaagcggcttttgccgaggcttcaaccatcctctctacttgaatgcccaaatttgagttcttaatctcacaacttgaatgaatctcctcaaaccaaaacgcttccttccaaaaacccactccatttctctcattctaccctactcatccaatcaaccaataagaaaaacgttcaatccttccttctttcatcattgactaataaaaaaataactaagcttcctacacttattatcgaccaatagagaaaatcaaaatatattctaagcccaacctacttggtagggaatccttaaaaatcaattcgcattgccagcaaaccgttctaatattctcaagaaagatattggtgagtccacaattaacacctggcctctctgatactgatattagcacgtatgtgtatctaaactccaagattcgtggagccagttgatctttaactacaatgtaactcttttttacatcacaaactgaacgggcgagaaattaaacacaggaaatcgaatgtagatatgactacaacataatatagcgcctttcttttaacaaaacagataaactacaattccatattgaataattattctcacgtttttttcggaacagaaataaattccttgaatttactggcatatttatgaagcgatattcttatgtctacagggcgagacaaaaaggtgttgcagtacatttacngatttttnggtttctggatgaggcaaaaaatttgagttcttttgaaccgtttcatgcttccgcagaaattgcatcccccatcataatgcaagaactacgtgtacaagcaccccgttctctcccaagcgcattntctttngtcgactatagaagcatattctgtctcgattgaaaacacacagaccccatttatacacgtctagttaagtcaaaagttac

SEQ ID NO: 17798 - DNA, 115 bp, Diabrotica virgifera
  misc_feature (2)..(15): n is a, c, g, or t
  misc_feature (32)..(32): n is a, c, g, or t
  misc_feature (40)..(87): n is a, c, g, or t
cnnnnnnnnnnnnnnaagcttaatttttttanagacgagnnnnnnnnnnnnnnnnnnnnnnnnnnnnnnnnnnnnnnnnnnnnnnnncattatatcataattcatttaatcgcgt

SEQ ID NO: 17799 - DNA, 728 bp, Diabrotica virgifera
  misc_feature (3)..(16): n is a, c, g, or t
  misc_feature (21)..(518): n is a, c, g, or t
  misc_feature (535)..(572): n is a, c, g, or t
  misc_feature (611)..(630): n is a, c, g, or t
  misc_feature (637)..(660): n is a, c, g, or t
  misc_feature (697)..(718): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttaaggataacagnnnnnnnnnnnnnnnnnnnnnnnnnnnnnnnnnnnnnntgcgaactccatggtggattaaaggttataattggtggnnnnnnnnnnnnnnnnnnnntggtcgnnnnnnnnnnnnnnnnnnnnnnnnagtttaaaccggtgtgaggcaggttggtttctatccnnnnnnnnnnnnnnnnnnnnnngaacgaaagg

SEQ ID NO: 17800 - DNA, 154 bp, Diabrotica virgifera
  misc_feature (2)..(65): n is a, c, g, or t
  misc_feature (67)..(97): n is a, c, g, or t
  misc_feature (99)..(99): n is a, c, g, or t
  misc_feature (102)..(153): n is a, c, g, or t
gnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnngnggnnnnnnnnnnnnnnnnnnnnnnnnnnnnnnnnnnnnnnnnnnnnnnnnnnnng

SEQ ID NO: 17801 - DNA, 75 bp, Diabrotica virgifera
ctagttctttcaagatattatcacattcttgatcttcttcacaatttccactgaagaaaacaactacgtactcat

SEQ ID NO: 17802 - DNA, 327 bp, Diabrotica virgifera
  misc_feature (35)..(72): n is a, c, g, or t
  misc_feature (113)..(130): n is a, c, g, or t
  misc_feature (138)..(160): n is a, c, g, or t
  misc_feature (197)..(221): n is a, c, g, or t
  misc_feature (228)..(263): n is a, c, g, or t
gattataagaataaattaccttaccacataacagnnnnnnnnnnnnnnnnnnnnnnnnnnnnnnnnnnnnnntgcgacctcgatgttgcattaaagtttataattgctgtaannnnnnnnnnnnnnnnnntgttcgannnnnnnnnnnnnnnnnnnnnnnagtttaaaccgccgcgagccagcatgtattctatctnnnnnnnnnnnnnnnnnnnnnnnnngaaaggnnnnnnnnnnnnnnnnnnnnnnnnnnnnnnnnnnnntattcaaaagatatgaaccatgatgaaactcactttgatagagaaaaaacatcaaaaaggccga

SEQ ID NO: 17803 - DNA, 74 bp, Diabrotica virgifera
  misc_feature (28)..(28): n is a, c, g, or t
  misc_feature (40)..(40): n is a, c, g, or t
agaataattaccttagggataacagcgntattttattggnagagtcaaatcgataataaagattgcgacctcga

SEQ ID NO: 17804 - DNA, 522 bp, Diabrotica virgifera
gatacatacaaatggagaaatcgaataaagattccaatgctcctcctgaaaggactgggcgcgcggatgcacctattattatcatcatcttggaccctaataaagctgacgatgatgattctgaagaaaacatgactaacaccgaaaatttgaccgacgatgaagtcaataggcgtggacctcctttagacctacttctgtcactgacaaacaaaccatttgccttcccccctacaataaatatgatcaaaagtgtattctaaagcaccgctcagtattagtattaaaaccaacaacaccacctctacaccgtgtgtagttaaagcccagtcaacttaatccctttaaaaactctagtgataaaaccaatatcgaaaaatcagataatagtgatacacgagtaaatgaagacatgccgaagtttgtgcctttgtgagtacctgaaaaatcaacacaaaaaattacagaaacaaaacctcaacccgttgaaacgaaaatctccagtaattcttttgtattcgg

SEQ ID NO: 17805 - DNA, 240 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(226): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnattagataatattt

SEQ ID NO: 17806 - DNA, 883 bp, Diabrotica virgifera
ctggtctgttttctaccaatagtgatttgtaatgttcttcccatttcgttgttgttatagggtttatcacagtttcttctattttgctggttcttactttctttataaatctccaggcttctctagattttctccctccgatgtatgtgtcctgacatttgtcctcccatttttgatttttggcgtttatgacttcggttttgaatttgtcacgtgcttgccgatattcacttgttttattctcgttttctctgtcatttagccatttatggtatacttcctgtttatgttttttcatttcttctagctgatcattccaccagtaatttctaacttctggctttttccttgtgaagttatctttttcaaacataactctcacaatttcgacattttccggagttgtgattgaatgattattttttctctgtttgctagtacattgatctcaaaaggatttttgaatctctctctcctatggcgctacaatccaagtcgagagttggccaggatatacgtacctacctatttgttgttattatacgtcggtaagctcacatttcgaaggactcgactttataagacacatataaattctatatagcgttccctggactcaacgacatatttgaaataaaatgccgagacaagcttagagtggtctgaggggattttaaaatgctacagatattcgatggtaatatagggtaaaacatggattttgactattagcgttatgatctcaatggatttgataaaaagagttaagatcttacaacttcttgctactcaaagttacgctttataatgtagaggactatgaaatgaatactcatcttggtctaagaactagctgatactagcaaatctagtatttcttttt

SEQ ID NO: 17807 - DNA, 181 bp, Diabrotica virgifera
gccaccgcaatcagtcagtagatacatgtttaaaattcccaaggatttgtagccatttccgggctattaccattttgataatgttgcgatacaaaacggtcaagtcaacggtcagttactaaaatgatagtcagtgcgcgctttgactgttatttttcagttttcttgaatggaaaataaa

SEQ ID NO: 17808 - DNA, 710 bp, Diabrotica virgifera
  misc_feature (3)..(87): n is a, c, g, or t
  misc_feature (97)..(154): n is a, c, g, or t
  misc_feature (170)..(187): n is a, c, g, or t
  misc_feature (191)..(214): n is a, c, g, or t
  misc_feature (265)..(279): n is a, c, g, or t
  misc_feature (281)..(321): n is a, c, g, or t
  misc_feature (381)..(400): n is a, c, g, or t
  misc_feature (402)..(414): n is a, c, g, or t
  misc_feature (440)..(459): n is a, c, g, or t
  misc_feature (554)..(577): n is a, c, g, or t
  misc_feature (610)..(629): n is a, c, g, or t
  misc_feature (646)..(703): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnggcatcaggnnnnnnnnnnnnnnnnnnnnnnnnnnnnnnnnnnnnnnnnnnnnnnnnnnnnnnnnnncacattcttattgcannnnnnnnnnnnnnnnnnctcnnnnnnnnnnnnnnnnnnnnnnnnctcttacacatctctaattttttaacaaataaattaactttatttattatnnnnnnnnnnnnnnntnnnnnnnnnnnnnnnnnnnnnnnnnnnnnnnnnnnnnnnnnggctcactactaaaattttattaaaatgtaatttttaactaaaaatgaggattaaacacnnnnnnnnnnnnnnnnnnnncnnnnnnnnnnnnnatataccactatctgtactgtttacnnnnnnnnnnnnnnnnnnnntctttacactatttgaatttagaaacgctgatcatattagtattaagagattgtctgtttagtaatcacatataggatgtaatacaggaactcgnnnnnnnnnnnnnnnnnnnnnnnngaataacatgtccttttgtcttaaatatacacnnnnnnnnnnnnnnnnnnnngtttgaatgaccgcgcnnnnnnnnnnnnnnnnnnnnnnnnnnnnnnnnnnnnnnnnnnnnnnnnnnnnnnnnnncgatctg

SEQ ID NO: 17809 - DNA, 465 bp, Diabrotica virgifera
  misc_feature (24)..(60): n is a, c, g, or t
aacatcgttgacaaccatggcggnnnnnnnnnnnnnnnnnnnnnnnnnnnnnnnnnnnnngggcgaagcaccagctgccgctcctgcccccgccgaaaccaggtcctcctcaaggagttcctccaagaaagccgaaagggctgggtgcaatgtcttctagacggttttgtactgtgatttgtcggttgtcatagaagccccgaaacgattgtggaacaagcagatgaagacgtatcacggatcatgtcatggcagaggaggtcgtagatgacgtactcggcattgacgaggcgatttgcgagaggagaagagaaagattgtgataaagctgaagaacgacgtgtagcggtacgcgaagttgataaaggtcgcgataggtatggacctcttctacggaatattgtgcggttatggacatacattgagttatcggatgaagtgtcaaatgttggaggattgctgcaa

SEQ ID NO: 17810 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17811 - DNA, 898 bp, Diabrotica virgifera
ggcactaagtaataacttcaataaactcgtagtagagttcgaggcggccatagcaaataccctacccttggttaaggaatttttcccggatccctcagcttatgatgtgattgtttacaaattaagcaattataccgatcaagttactgcatattttaaccaaaatacagaaaacctgaaggcagccttggatagcattcctaagccagatctacctataacttcgcaggcttcaatcggggccctaattccaagttttgtagaagtatttaactatttaagccaggtgataattcaagttgttcaaaaagctccacctgttcctaactttttttctgttctattaagtgtgttcttcgattttgttaaatctttaacaaatttccccaaacttcttgccagtgacgtgttctccggtgctggtgcatttggcgatctcctagagattataggaaagaaaatcatcccaagtatagtacctggcttcaatatatcagccatagtttccggtattcccgatatagtacccagctggaaactttaagcttacaaagctttataggcctggatcccgcgtaccaaaaaagtttattaattgcggaaaataatagcttaacggtgtctggtctgacaaactttgaagcgtgggaacactggaacaggagaagttttagttgtggagcagattagaaatttggaacgtcagactgcgaaaacgtcccatttgttttttcggacagagcttccaattggtttgttgccatttcattgaactatcatgcaaaagtcagacgggtgtttatcactaactgagaagaacatgtcaaatgacaggaatcatgttggttagtaacagcagtctcatttttgcatgagaagttggtgaaggggtagcgag

SEQ ID NO: 17812 - DNA, 923 bp, Diabrotica virgifera
  misc_feature (207)..(231): n is a, c, g, or t
  misc_feature (257)..(279): n is a, c, g, or t
  misc_feature (284)..(304): n is a, c, g, or t
  misc_feature (407)..(429): n is a, c, g, or t
  misc_feature (436)..(472): n is a, c, g, or t
  misc_feature (792)..(792): n is a, c, g, or t
ctctggggggtatggaatagtaatggtgttaagcgtatagaggtcaaagtacatccaaatggggggttgcaaccccctaacccaccccggttacgcctatgaatatgagataaaatgattcctttgtaacaaaaaacacttgtatcgaaaaattattttaattgagcgttaaatcattttagaataatcaatttttaaataaacatnnnnnnnnnnnnnnnnnnnnnnnnngttttcaattattcgtagctacttgnnnnnnnnnnnnnnnnnnnnnnncctgnnnnnnnnnnnnnnnnnnnnngattgccggtacacaaatgtataaaaacaaaacttgtggtctttcttaactaattccctaagttattttaaaacattgacattttagtcgaataattataaannnnnnnnnnnnnnnnnnnnnnncaaatgnnnnnnnnnnnnnnnnnnnnnnnnnnnnnnnnnnnnngtgaacggattaaaagtatttttttcgttaacgcatcttttatttatatcaatgctactttatctttttgtctttttcgctgtcaactgcttcatcttttactttcattgctctttcttcctgctcgttttttatttatctataattcataatcagttatcgtcatctgtcagtttcggtgatagttttgatcactactgtcatctgtcactgtccacaatttttatttttgtctttttcgctattgactgcttcatctattacttagattgcttgtttctcttgctccaggcattttttgatgtatctataatccattntgtaataatcaattaacgttaacgtcacctgtcagtttcactgatagttttaatcactactgtcattttcacaatctttatttttgtattttcattattattgcttatctattacttggattctcgtcctc

SEQ ID NO: 17813 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnnggaaagga

SEQ ID NO: 17814 - DNA, 786 bp, Diabrotica virgifera
  misc_feature (702)..(702): n is a, c, g, or t
aaatatgcctgatgtttagaaattgtacttatatgaacatttactggagctattatagttccccgttttgattagcttactccttgataaacttcgttcatgttgtattgattcactaaatatgcttttgtatatccatctacaagataaaatgatatattcattgaataatgatctatttcacgagaaggtacttatcttgtcctacatactttacaaatgactaaagctgtacgctaaagaatactcctagttattacatcagaagtcttattttttatatcatttttttgaggattgtttgcatagagcattagcaccaactatctgatgtatgatactttgacctcctaaaatcatttaagtccttagccccttaacaattattttattatagattttaactcatttagcttcccacttgattggaatttgagcccatcataatctactatacaataatttttctcaagcacttctagacattaatttttacagaaacattactctctttattttactattttacactgatatgactatattgaatcaccttttggaaattctgactctctttatgaatcttcattttttattgctgcacactctcatggattacatgatattattgttgcaaccgtcctattaccttgatcaattcaacatgatttatatcattgttcatccacacatcacttctanttctcactcatatgttgatactgacattatgtgcatgaagcatcattattcttatatatttcgatttactgatgagattgatag

SEQ ID NO: 17815 - DNA, 107 bp, Diabrotica virgifera
  misc_feature (78)..(100): n is a, c, g, or t
taacagcgtaattttattggagagtcaaatcgataataaagattgcgacctcgatggtggattaagtttataattggnnnnnnnnnnnnnnnnnnnnnnntggtcga

SEQ ID NO: 17816 - DNA, 837 bp, Diabrotica virgifera
  misc_feature (7)..(492): n is a, c, g, or t
  misc_feature (494)..(508): n is a, c, g, or t
  misc_feature (515)..(703): n is a, c, g, or t
  misc_feature (710)..(759): n is a, c, g, or t
  misc_feature (763)..(817): n is a, c, g, or t
  misc_feature (831)..(831): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacatnnnnnnnnnnnnnnnnnnnnnnnnnnnnnnnnnnnnnnnnnnnnnnnnnntggnnnnnnnnnnnnnnnnnnnnnnnnnnnnnnnnnnnnnnnnnnnnnnnnnnnnnnngctggatgaagggntggatg

SEQ ID NO: 17817 - DNA, 644 bp, Diabrotica virgifera
aagaagagaaaaaggataaagataaatctgaatcagatattttcaatctggtaaaaacgccttctattgataaacttggcaggattcccaaaaaatcaaattctgcctctgtcgactctaaacctaaagacgatagggacgccaatgaagttaaaaagaagtccttctctgtcggtattaaaaaggatgcaactcccgaagagagaccgaagacagtgaaagtattcaattcaaagatgagatcgacgggtttggaagaagaagtgaagccggcgccatctcgagtagcagttaagaagcccacgactctagctacattgccgccaatccccctgaagagaagttccccgccgagggacatcagagaacccagcatccccccagagaagaagatcaaaatggacaaagtcgacattcccgatcgaccgggtgctattaaacttattccacctaaaccgaaaccaatcctccaagaaagcgacctcttcagcgacgccctcactgctgcgacgtcgaaaaaagaaccgaaaaagagaagacgcagattgagtagttcaaaggaaacgcccacgtcaccaactacatctccacaagaggatccgctcttatctcctagcactgctgcaccaccatcggcacctgca

SEQ ID NO: 17818 - DNA, 739 bp, Diabrotica virgifera
  misc_feature (387)..(401): n is a, c, g, or t
  misc_feature (404)..(416): n is a, c, g, or t
  misc_feature (601)..(619): n is a, c, g, or t
agtttctatttgttattttactagatcgaatcatctttcatatttcttggatgtggtctatttattgcttcaatagtatcttattatagtcgtagaacatatgagaggtgatttatttaaaactcgatttattttactagctggatattggttttttcttaataatagtagttattagccctaatttaatttcaatctttatatagggtgagatgcctcagctttagcttcttattggttagcctcttattatcagaatattacaagatttaatgctgtgatattagctgctttatctaatcgaactggcgccggagcattattgataggtattgcttgtatattaacttttgtcagatgacattctattttttatttatgacgcannnnnnnnnnnnnnngtnnnnnnnnnnnnncttgagtagacattttacctgctatcactagaagtgctcgaattcctttttcttcttgagtacctgcagcaatagctgctcctaccgctggttcttctttacgacattcttctactttaataacagctccgtgtttatttattaattcgtcttcgtttttcacttagagatgggataagaatacnnnnnnnnnnnnnnnnnnntatagcaatatttatgtctgtcctagaggctgattctgaatttgatgttatacctattattgtcttatctactttaagtgcattagggttaataataagaactttatctttaggagaata

SEQ ID NO: 17819 - DNA, 947 bp, Diabrotica virgifera
  misc_feature (879)..(879): n is a, c, g, or t
gctaattaactatacataaaatcatgcctattttaaaaatatactccctagatgatcaagatgaggcctctgtgatttctgcttttcctgaaggtgaacactcaataggaagagataaactaaactgtagagataaaagaatttccagaaatcatgcattgattactattacaaatagttccatcacattacattctacacactttaatccatcattttacaagcctcatggtggaaatagtatcaggttagtaaagaaggatgaatcagttaccataaatgatggagaccaatttgctaacctgatactatttccaccatgaggcctctgtgatttctgcttttcctgaaggtgaacactcaataggaagagataaactaaactgtagagataaaagaatttccagaaatcatgcattgattactattacaaatagttccatcacattacattctacacacgttaatccatcattttacaagcctcatggtggaaatagtatcaggttagtaaagaaggatgaatcagttaccataaatgatggagaccaatttgcttttttggcagatgcatattggtttaagacgagaattgagcaagatgaaattaatttagcttcaaatagcaataaaagaatccatgaggagagtgaaatccataacaaaaagaaagcaaaagtcgataatgttataaaaaatagtgaagaaagtagaaaattagcagttagtgacactattgataaaccagaaaataaagattcggattctgaaggaagtatagactttgctacttcactacaaaatgatgatgatatcccaatgaagagaatccaaagatgctactgaaaaacatacagtatagactttgctactcactgncaaatgacgatgatatcccaattgacaggatccaaagatactactgaaaacaatctagaaaaatcagc

SEQ ID NO: 17820 - DNA, 866 bp, Diabrotica virgifera
  misc_feature (5)..(842): n is a, c, g, or t
  misc_feature (851)..(851): n is a, c, g, or t
  misc_feature (857)..(857): n is a, c, g, or t
attannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgattaanaaatanatttaaact

SEQ ID NO: 17821 - DNA, 630 bp, Diabrotica virgifera
  misc_feature (8)..(8): n is a, c, g, or t
cccctcanagtccggtagtgagaatggctgccggaactcttccctttatcccgaaaatttcctggtcgatttatttgtgactgtcaagaaaaatgtcaaattctgagaaaaagaagacccttcggggagacaaatccactattgacaagagaacgagaaaaccagatggaccgtgagatacggaaatttgatacttatacaacagagacgtaaaacttttccaataaacaatactaagaaaaagacaacccattgtaaaggcaaaaaagtcttgaatgacttatatggtaatgagaaggtatctacaccttctacaaagactgcggttttgataaagaagaacaatattgatctactcaacgaacctttaattcaactcctaggtattatatatatataatgtatccaaatctattgacgaaatcatctaacaagacaatcatggatgaagacataaattttgtactctacttgaacggttatgatcatttcattggtctatgatagcactaagtagatgtggatacccacaccgtgtcaagctacgaagatttcgttcttcagcacgtcaaactccgattgctattgaattgattgggacgtggtcgactaactgatgaagaatcttac

SEQ ID NO: 17822 - DNA, 900 bp, Diabrotica virgifera
  misc_feature (848)..(848): n is a, c, g, or t
  misc_feature (856)..(856): n is a, c, g, or t
  misc_feature (889)..(889): n is a, c, g, or t
cttagatttagatttgatacgaagagtagataacatagatttaaacataacaaaaagtgcctttattaaacaaaatagtgatgtattcatcggattaggcaaatgtcctcaaaaatgtaaactaaaacttaaagataattgtgttcctcgtagctaaaccaccacgaagggtccctttagccattaaaaaaagattagaaaacacacttttagatttagaaaaacgtggcatcatatctaaatgtgagggtcctactcgagtggttgagcaatttagttatcgttgaaaagcctgataaaacgttaagaatctgtttggatcctaaagatttaaaccaagcgcttgaaaaggaatattgcttaatacctactattgaagagatatgcaataagttaaaaaacaaatgctatttttctgttttagactttaaagagggattctatcaagttcagctagatgaggagtccagtagagtttgtgcatttggaactccctttggaatttggaaatttgatagacttccatttggactaaatattgcccccgaattttttcaaagaattaacttagagaattttggtgatattgagggctgtcttatatattttgatgatcttttgatatttgctgatagtcttaaagaacatgatagaatccttaatgaagtattggaacgtgctagaaatattgggggtaaaatttaattctaataagatacaatatagaatggtctgaagtaaaatatttgggaaatacatttgataaaaatggtatgagacctgacttagataaaataaaagctattattaatttaaaagaacccaataataaaaaagagttacaaaanatattggngtatgatcaataatcatcgcagttttataccanacttatcggat

SEQ ID NO: 17823 - DNA, 162 bp, Diabrotica virgifera
ggttgtcaacttttcaggggcagccatgcatcagccaccgctgtccaccacggtagtaaagtcagaggtaaaatctgaatatgttgaagaagatgcagaacttccacaaacaaatataatagaaatagaaagaacagatgaggaaaacggagaggtgcaaac

SEQ ID NO: 17824 - DNA, 229 bp, Diabrotica virgifera
  misc_feature (10)..(189): n is a, c, g, or t
  misc_feature (202)..(227): n is a, c, g, or t
agaactagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaaagagctnnnnnnnnnnnnnnnnnnnnnnnnnnta

SEQ ID NO: 17825 - DNA, 843 bp, Diabrotica virgifera
cgatatctagcttcttgatagtacgagactgtgtatatagatcgtagctgagcttactgcaatcgcttgtcttaagcttaagatatgttgctgcaacccttcattactgccttattgacacttcatacgcgtgtgctattatttgatatttctcttacagacttagcttagatatatactaactcattcgtttttattttttgctagttgttatcttttctccacggacatttttctagtttcttatactgtcattattacctttaactctatgaatgcacatcatatgacctattaatcgtatattgctgaattcattcttaatgaaactttcaaatttattgattcttctgaataaacctgatacctgcgccagacctattaattattctcacttatgagtttgctgagtatgatcaacactctctctcagatgtgagacagatacaatacatgaacgcaattcatttcacttgatttctccataaatacatattgtatacaaatatttctagacataaataaatcaaccagctctagaattctgatgcgaccagtgtatcaatatgtcgtgttacctgttgaattgctgatgtaatgatgactactttatttagttttagaatataattgcttcttaccccactctgaacttctccacactattatattatatccaacacaccagatttttgctaccttacagtatgctactccgatgcgactcccatatacgtgttcttcgtccttcacgacacattgaaccatatctaccaagagctagtattcacctcctctatgatattaaatatgtactgatgagcgctagtctgttaatatata

SEQ ID NO: 17826 - DNA, 376 bp, Diabrotica virgifera
  misc_feature (52)..(69): n is a, c, g, or t
atttttctttgacaaattcgccgtacaacattttttcgtctgctcaggtgcnnnnnnnnnnnnnnnnnnccctatcatgtatagattggccctcccatcagtacaatgcatcgaggacgagacaaaccaacaattgataacaacaaaagatgaccaaatagacagtcttatatagggatttaacgtttaacacatccaacacaaaaccctcggcgaataatacagaataagacataatacacctcatgtaatagaagaacacgctgtagatgacttatttggtaatgacgaggcatcacacctatctacaaggagcaagaaattgaaaaaaaacagcaacgatatgctccacacacgtgcatacttatacaggtcc

SEQ ID NO: 17827 - DNA, 776 bp, Diabrotica virgifera
  misc_feature (7)..(117): n is a, c, g, or t
  misc_feature (130)..(491): n is a, c, g, or t
  misc_feature (501)..(546): n is a, c, g, or t
  misc_feature (556)..(614): n is a, c, g, or t
  misc_feature (629)..(644): n is a, c, g, or t
  misc_feature (646)..(686): n is a, c, g, or t
  misc_feature (691)..(742): n is a, c, g, or t
  misc_feature (746)..(775): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttattaannnnnnnnnnnnnnnnnnnnnnnnnnnnnnnnnnnnnnnnnnnnnngataaattgnnnnnnnnnnnnnnnnnnnnnnnnnnnnnnnnnnnnnnnnnnnnnnnnnnnnnnnnnnnctggaatggaagggnnnnnnnnnnnnnnnngnnnnnnnnnnnnnnnnnnnnnnnnnnnnnnnnnnnnnnnnnaagcnnnnnnnnnnnnnnnnnnnnnnnnnnnnnnnnnnnnnnnnnnnnnnnnnnnntagnnnnnnnnnnnnnnnnnnnnnnnnnnnnnnt

SEQ ID NO: 17828 - DNA, 910 bp, Diabrotica virgifera
  misc_feature (150)..(171): n is a, c, g, or t
  misc_feature (192)..(217): n is a, c, g, or t
  misc_feature (682)..(701): n is a, c, g, or t
  misc_feature (735)..(753): n is a, c, g, or t
  misc_feature (867)..(868): n is a, c, g, or t
atcttatccattaatttctaaaattgtatgattttgttagaaagtggtagaataacgctaaccaatttaggagtaacactgcaaagagactctctgaatgttttgttgctgttccgataaggaggactacggaaaaggtccgatggctgnnnnnnnnnnnnnnnnnnnnnngttggtgacggagcatgtggnnnnnnnnnnnnnnnnnnnnnnnnnngtaaagatcagttcccagaagtatacgtgcccactgtattcgaaaactatgtggcggatattgaagtagatggaaagcaggtagaactcgccttatgggataccgcaggtcaagaagattatgatcgtctgcggcccctttcatatccagacaccgatgtgattttaatgtgcttctcagtagactcccccgactcattagaaaacatcccagaaaaatggaccccagaggtaaaacacttttgtccaaatgtgccaattattctggtaggcaataagaaggatctgcgtaacgatcctactaccattaacgaacttaaaaagatgaaacaagaaccagtaaaacctcaagacggaagatccatggcagagaaaatcaatgcttttgcatatctagaatgttctgccaaaagtaaggagggtgtaagagaggtttttgaaaatgctacccgagctgcactgcaannnnnnnnnnnnnnnnnnnnccgttgtgtaatgttttgagccactacatattcnnnnnnnnnnnnnnnnnnncgttacgtgtgttaattaatttcaagggggcttctgcatgatgtattgactaacaaaataaacccctacttttctcttcagttctatttgttcaaactccttttctccatgtgnnacaatttaagtattaagttatattttcatatgtatttaaccc

SEQ ID NO: 17829 - DNA, 57 bp, Diabrotica virgifera
  misc_feature (19)..(19): n is a, c, g, or t
  misc_feature (30)..(47): n is a, c, g, or t
gctgatgctaatgtgaagntgagtttgacnnnnnnnnnnnnnnnnnncaattaattt

SEQ ID NO: 17830 - DNA, 784 bp, Diabrotica virgifera
  misc_feature (3)..(275): n is a, c, g, or t
  misc_feature (277)..(403): n is a, c, g, or t
  misc_feature (405)..(430): n is a, c, g, or t
  misc_feature (432)..(465): n is a, c, g, or t
  misc_feature (513)..(722): n is a, c, g, or t
gtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnncnnnnnnnnnnnnnnnnnnnnnnnnnnnnnnnnnntataaatttacattatttacatttagtaatgatgatccatatgtagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatgagatagaaactgcctctacttagtttataaagaattttatatgtgagctagtaagc

SEQ ID NO: 17831 - DNA, 833 bp, Diabrotica virgifera
  misc_feature (11)..(54): n is a, c, g, or t
  misc_feature (176)..(213): n is a, c, g, or t
  misc_feature (217)..(246): n is a, c, g, or t
  misc_feature (259)..(436): n is a, c, g, or t
  misc_feature (449)..(464): n is a, c, g, or t
  misc_feature (466)..(488): n is a, c, g, or t
  misc_feature (501)..(620): n is a, c, g, or t
  misc_feature (647)..(666): n is a, c, g, or t
  misc_feature (688)..(722): n is a, c, g, or t
  misc_feature (762)..(804): n is a, c, g, or t
  misc_feature (806)..(832): n is a, c, g, or t
atttctctttnnnnnnnnnnnnnnnnnnnnnnnnnnnnnnnnnnnnnnnnnnnncttcaacatagttaattagtatcgtgagagaatatctttctttttctaaaagaaaaatttcttttttgtacctcgtgtatcagggattatctaattaataattctcatcatttcatctctcnnnnnnnnnnnnnnnnnnnnnnnnnnnnnnnnnnnnnnttcnnnnnnnnnnnnnnnnnnnnnnnnnnnnnngaatcgaaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaaaatacnnnnnnnnnnnnnnnncnnnnnnnnnnnnnnnnnnnnnnnataaattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggttattaaaaacacgtctttttggnnnnnnnnnnnnnnnnnnnncgcccaccgattaatttgaacnnnnnnnnnnnnnnnnnnnnnnnnnnnnnnnnnnnatcattaagttttttcttggaaggctggaaggaaggggtnnnnnnnnnnnnnnnnnnnnnnnnnnnnnnnnnnnnnnnnnnncnnnnnnnnnnnnnnnnnnnnnnnnnnnc

SEQ ID NO: 17832 - DNA, 936 bp, Diabrotica virgifera
  misc_feature (537)..(557): n is a, c, g, or t
  misc_feature (889)..(890): n is a, c, g, or t
tgtttgcatatagaggggtcgattttgttcactaatatctttggaaaacggcattgtaggcggagggaaacggacttttctatgtgtgaacattgtaaatgtcagcacaataggtcccgacggcggccatgacactttggcagttaggagggggtacgattacggtttatcccaatagtcggaacgtaattgtgcacacctggtggcaatgccattagtgcttgcgagctcacgtgttccttaattacaacactggcaagaaatgtagttcctgcagctgcatctctaaaagctggtagatgggacagaaaactatattcgggacatgaactctatggtaaaactttgggaattttgggactgggaagaattggaaaagaagtcgccattagaatgcaagcttggggaatgacgacaatagggtacgatcccattgtaccagcatcagaagccaagaaatttaatgtggaggctttggaactggagcaaatttggcctcgagtagattatattacagttcacactcctcttataccnnnnnnnnnnnnnnnnnnnnntgaagcagtactcaacaaatgtaagaaaggagtaaagatcgttaacgtagcaagaggaggtatcattaatgaatcagatcttctaaaggccctaaaatcaggacagtgtggaggagcggctttagatgtatttgaacaagaacctcctaaagatccagtcactttagacttgatccaacacgaaaaagttgtagctactcctcacttgggtgctagcactgatgaagctcaagttagagtagccgtagaaatttcagaacaaataattgcattaaccggaagaaagtaagatatacatctacaccaggagtggtaaatagaaagcgtctggnntaatttgtcaaagtgattttgaatatcatatgtacagtacgtaaac

SEQ ID NO: 17833 - DNA, 356 bp, Diabrotica virgifera
gaaatgattcgtaagaacccgacaaagaaaactacatttttaatcagtaaagtgaaacaatcaattagcaagctcggttagatttgaatcttgttgttttaataatgtgataaatgttcaggtacgacactgattattaaagagctcctagagaataaagacaacacctacaactaagagcaaaacgcgatagagatcaaaataggtaaaagattgtctgtaaatggtattgtggttattattgtacaggtattgcaacaagagcgcgaattataatatgaaaattcagataccatgataatacctcaataaaaattttggttattaacgtatgtaaaagtagagtataatagagg

SEQ ID NO: 17834 - DNA, 939 bp, Diabrotica virgifera
  misc_feature (538)..(555): n is a, c, g, or t
  misc_feature (557)..(574): n is a, c, g, or t
  misc_feature (833)..(833): n is a, c, g, or t
  misc_feature (866)..(866): n is a, c, g, or t
  misc_feature (874)..(875): n is a, c, g, or t
acaaaactggtcaaaactttttggtggaattcattggctcatattgtcatcaccatgacaacgcaaatggttaaggattgtcaccattgacaactcgaaagataaaaacagtgcgaaaaagtaaatcccatttaaaatacattgttacttcacacacactttaaatccttcacgcactggctatctataatgacagttttcacaaactaaaaacttatacataatatgacatagagtagataaaagtaattttgctaatacttactgaataataaatcctttaattttgttttgactaatggttgtttatcacgctttccgaaataactgtagcaggatgctaattcgtccgttaataattcttttagaatcttatttgttttttgtttcacatctttcccaccaagcatagagaaataaccaatctaaaaataagtaatatttataaaaattttagttatttgcatacacttaatcaaatatttttatcaagatttctttttagccactattgtagtaagattttattttgagtgannnnnnnnnnnnnnnnnncnnnnnnnnnnnnnnnnnnagtaaaagcaaaacaaaaactgtatcaccttacatattgtagtattgcaatattttcgtaggtaatagtgtacaatggattatctgcttaaagaataaccatcggcacattcatcctgaaaaggatgggcaataccctaacattttaaggtgaagacatacaacagtttttgatttgcgttaacaatatacctaacggaagatacaaaagtttcgttacacatattggttggataacagtaaatacaaaatattttttngttaatggagatatctaaataattttcataagntttttaanngtcattactctacaacatcatcaaattcctcttcacttctaatattcctcaatggtattaaatc

SEQ ID NO: 17835 - DNA, 783 bp, Diabrotica virgifera
  misc_feature (5)..(512): n is a, c, g, or t
  misc_feature (519)..(556): n is a, c, g, or t
  misc_feature (576)..(589): n is a, c, g, or t
  misc_feature (592)..(614): n is a, c, g, or t
  misc_feature (622)..(644): n is a, c, g, or t
  misc_feature (674)..(705): n is a, c, g, or t
  misc_feature (712)..(748): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattatgatagaaatatctatatagtgtaacaaacc

SEQ ID NO: 17836 - DNA, 277 bp, Diabrotica virgifera
  misc_feature (12)..(31): n is a, c, g, or t
  misc_feature (40)..(140): n is a, c, g, or t
  misc_feature (142)..(247): n is a, c, g, or t
cgtctttttggnnnnnnnnnnnnnnnnnnnncgcccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcagtattaaattcatttatataataaa

SEQ ID NO: 17837 - DNA, 620 bp, Diabrotica virgifera
  misc_feature (272)..(301): n is a, c, g, or t
  misc_feature (303)..(321): n is a, c, g, or t
aattgcgaaaaggaatattatttatggagagaaagttggtagtgatagttaaagaccccatttatagcgaggaatttattttttgtactttttgatgagtggatatgatgtaaatagttatttatatattgttttcgaatttataacatattaacaaagtagtatttttgtggtatgatatatagaataaaggagttttttggaaagaaatgagtattcgaggtttacaaatatcgatggttttatgaaataaagtaattttgtttattgannnnnnnnnnnnnnnnnnnnnnnnnnnnnngnnnnnnnnnnnnnnnnnnncaccggtgagatttaaattaatattttattagaacttgattgttagttggtaatgcagttggagcaatttgcatattttaaatttggtgattgatgtatttttattcactatgatttgtattttttatgaagtttgtgataaaatgagagattgagttatttgaattgagtaatggtgtgaataatagtattgaagtattggatatgtaggaagaatatatagatttcataaaatcaagatagttaatttatttttgcctgctaattaaagaagtgtgtttatggaagaaatctgtata

SEQ ID NO: 17838 - DNA, 931 bp, Diabrotica virgifera
  misc_feature (253)..(271): n is a, c, g, or t
ggtaatagaaaaacggaaggcaagggatctatctacccacctattgtttgtagatttggagaaggcatacgatacggtacctttgaaaaaactgtttcaaacattgacgaaggtaggtctcagtagagagtatgtggatgctatcgcaaatatatacaaaaatgcaagaagtgtcgttaaagaaggaaactttatatatgaatcattccctatatcaaaggggcttaaacaaggatgttgtctgtctccgacnnnnnnnnnnnnnnnnnnncaatcatcgctagagcagtggaggaaacaagtatccggaatgggaatagacataggcagtgttaaatgtctaacaactttgttttttgcagatgatcaggtagtcgtagcgaatgatgaggaagacatggactacatgtttagaaaactaaagaaagaatatgaaatatggggacttaatatgaatatgtcaaagacagagtatcttaaaatatgggatgatgaagaagatccagagttagaaattagaaccacgaaaagatgtaatgaatataaatatctcggatctataatatctaaagaaggcactaccaaaagagacatcgaaaagagaacgcagcagggcaaaaaagcgggaaacattctgagctctctactgtggtctaaagatataaggcaagaaacgaaattgacaatctatcgtaccttggtagagcctattatgacttatgaggcagaagcttggcagatgacaaaaaaagataggaaaagaatagaagtagtagaaatggattatctaaggagagcgtgaggtatatctaaaaaaagatctcatcaggaatgaagatattagaaggaggacacatactgtatattccagtgtagataagattgcaactagacaactagtgtggtatgttcacgtgaaacgaatgaatga

SEQ ID NO: 17839 - DNA, 792 bp, Diabrotica virgifera
  misc_feature (2)..(549): n is a, c, g, or t
  misc_feature (556)..(593): n is a, c, g, or t
  misc_feature (629)..(651): n is a, c, g, or t
  misc_feature (659)..(681): n is a, c, g, or t
  misc_feature (752)..(781): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaaaggttataattggnnnnnnnnnnnnnnnnnnnnnnntgttcgannnnnnnnnnnnnnnnnnnnnnnagtttacaccgttgtgagccaggttggtttctatctttaagttattaatatattttactacgataggaccnnnnnnnnnnnnnnnnnnnnnnnnnnnnnngaatataaaaa

SEQ ID NO: 17840 - DNA, 891 bp, Diabrotica virgifera
cggacgcgtgggctaacgtgtaacgataaattaatataaaattgttaggaattttactacatcattgtgatttagtgacagtttcagagcatagatacttgatatctaatgtttaattatctcttacgcgttttttctaacgagtcaatcgtgcgtaattaactgttaagaatttatttatcctaaacgatttcaaaagctgtgattcgatagaaatttacataggacattgaacttgttagagatctgtggtgagaggtgaggcaatacatattgatctgtagctaccctactaattttatgtttaagtacattagttatacatgatatatgttaataaaatctattacaaaagtaaccgcatccattgttaagaacgaatttattttcaacatattattattgctgaatactcataatttctctcttaaagatttaaggaaatattaattcaaaaatggtaagtacctatctagatattcccttatatccatatttttaacatatctatttatagtatcatggtaaaacgatcttaaaaaatcgaagccgtcttttttatgatacctttttggaatatttaggctagatatattttattatgacttttttatctatgtttgtcttatttcatatgtgttgcacaaccatggctgttctccatactagtgtcatatctccagcccgctgactcatgcgaccggacagaaatctacgtacccgcatctttaataatcgtagtcagtctcatccaagacacgtgcatcgataactaccagaggatagtcatggccttaagaatgatgttaagaagtgcatcatgtgcgctgatctgttgagacgcatttacattacgaaaagcatctatagcagttactacaattgttaaat

SEQ ID NO: 17841 - DNA, 849 bp, Diabrotica virgifera
gaaaacaatggtaatgctgacactcaaaacgatgctgcacaaggtaacgaaaacggagctgctgccgaaaacaatggtaatgccgatgctgcccaaaatgatgctgcacaagctaatgaaaatggagctgctgcagaaaatagcggtaatactgatgctgcccaaggtaccgacaatgaagctactgcagaaaacagtggtaatgctgaccctgcccaaggtaccgacaatgaagctgctgcagaaaacagtggcaacgagaatggaacaggcgcggaaaataatgctaatgcagatgcccaaaccgacgccgcacaaggcagcaccaatgaagccaacgcagaaaataatgccaatgcagatgtccaaaatgatgctgcacaagctaatgaaaatggagctgctgcagaaaatagcggtaatgctgatgctgcccaaggtaccgataatggagccgctgcagaaaacactggtaatgctgaccctgcccaaggtaatgacaatggggctgctgcagaaaacagtggcaacgagaatggaacagcggcggagaataacgctaatgcagatgtacaaaatgatgctgcacaggtgaatgacaatggtgctgctgcagaaaacaatggtaatgctgacgccgcacaatctaatgacaacggagcagctgcagaaaataatactaatgctgatgctcaaaacgacgccgcacaaagtactgccaatgaagccaacgcagaaaataatgccaatgcagatgcccaaaatgatgctgcacaagctaatgaaaatggagctgttgcagaaaacaacggaaatgccgatgctgcccaaggtaccgacaatgaagct

SEQ ID NO: 17842 - DNA, 755 bp, Diabrotica virgifera
  misc_feature (677)..(708): n is a, c, g, or t
  misc_feature (724)..(724): n is a, c, g, or t
gcaattcttcgaagatcggtttggttatacttcggaacaagcaaatgatataagcagtattgtgtacattatctccggtgtagcttcgccgattttaggttttctagtcgataaatcaggtatgaatatatattggatattggtgggggtttctgggacaactctatcacacgttctactcggatttaccaacattagtccttatgttgctatagccatcatgggtttggcttactcaattttagccagtagtctgtggcctctggtatccttgatcatacctgagtaccagcttggaactgcatatggagtagctggttcgattcaaaatctgggattggccctctttaatatattttgtggtctaataattgacaaatttggatataccggcgtagaaatctttttcatagcaagtttaatagcggcttttatttcttcggtgggactcttattcctggatagaattgataatggactgctaaacaagactcctggaggaaggtcaaggcatcatatagaaagagaaagcaaaggggaacatccaggagggaaagttgatgttgttacttcttagtgattaaacagagataattaatggatatttattatttcaatggataagttattcaattttatcaattaaaagtaataagttttattaaaaatatgtatannnnnnnnnnnnnnnnnnnnnnnnnnnnnnnntgtttttgcatattanatggaaatgttaaaatatattttatcattac

SEQ ID NO: 17843 - DNA, 823 bp, Diabrotica virgifera
  misc_feature (81)..(102): n is a, c, g, or t
  misc_feature (160)..(182): n is a, c, g, or t
  misc_feature (221)..(233): n is a, c, g, or t
  misc_feature (235)..(248): n is a, c, g, or t
  misc_feature (291)..(343): n is a, c, g, or t
  misc_feature (392)..(420): n is a, c, g, or t
  misc_feature (431)..(484): n is a, c, g, or t
  misc_feature (489)..(539): n is a, c, g, or t
  misc_feature (566)..(580): n is a, c, g, or t
  misc_feature (582)..(651): n is a, c, g, or t
  misc_feature (693)..(713): n is a, c, g, or t
atttatgttagactactcacatattgtttagttagagtgagaccaaaattttatctaatgatagctaattagaattgtatnnnnnnnnnnnnnnnnnnnnnncatccaaatttatttctatgtgccctgtgcatcatcgattattatataaaagtcatcnnnnnnnnnnnnnnnnnnnnnnngagagctactgaattacaattgttattgtaaagataagnnnnnnnnnnnnncnnnnnnnnnnnnnngtggtattcgttcttacatatatctacttttttgagaaataannnnnnnnnnnnnnnnnnnnnnnnnnnnnnnnnnnnnnnnnnnnnnnnnnnnngtattacctatttttaggcctggagcttatgaataaagttttattatcnnnnnnnnnnnnnnnnnnnnnnnnnnnnngaaattttcgnnnnnnnnnnnnnnnnnnnnnnnnnnnnnnnnnnnnnnnnnnnnnnnnnnnnnntaagnnnnnnnnnnnnnnnnnnnnnnnnnnnnnnnnnnnnnnnnnnnnnnnnnnncattagctattaaacaattggatatgnnnnnnnnnnnnnnncnnnnnnnnnnnnnnnnnnnnnnnnnnnnnnnnnnnnnnnnnnnnnnnnnnnnnnnnnnnnnnnnnnnnnntgaggctcgcctgcccactggattaacttgaaggttcgcgannnnnnnnnnnnnnnnnnnnnccatagtcattactgttttttattgaaagctgtaatgaaggattgcctgcgaaagatactgtctttatgtagattatctagaagtatatttttaagttaccaagcttaaa

SEQ ID NO: 17844 - DNA, 685 bp, Diabrotica virgifera
  misc_feature (25)..(42): n is a, c, g, or t
  misc_feature (60)..(83): n is a, c, g, or t
  misc_feature (98)..(119): n is a, c, g, or t
  misc_feature (154)..(219): n is a, c, g, or t
  misc_feature (221)..(233): n is a, c, g, or t
  misc_feature (274)..(289): n is a, c, g, or t
  misc_feature (291)..(321): n is a, c, g, or t
  misc_feature (330)..(349): n is a, c, g, or t
  misc_feature (445)..(470): n is a, c, g, or t
cggacgcgtgcgtttttatttatcnnnnnnnnnnnnnnnnnngtttagaaaaagtctacnnnnnnnnnnnnnnnnnnnnnnnncttagcattgtgagnnnnnnnnnnnnnnnnnnnnnngacaaactcattttttgtaccttgtgaatcaggcnnnnnnnnnnnnnnnnnnnnnnnnnnnnnnnnnnnnnnnnnnnnnnnnnnnnnnnnnnnnnnnnnncnnnnnnnnnnnnncattttagataagtgttgtgaaacgcaatgctcattcgtcnnnnnnnnnnnnnnnncnnnnnnnnnnnnnnnnnnnnnnnnnnnnnnncagtatatnnnnnnnnnnnnnnnnnnnnattattaatctcaaacattcttaagaatgagcttataatcaaaattttattatagattgtaattcttaaaataacacttagcattaaaaattatcnnnnnnnnnnnnnnnnnnnnnnnnnnctttatatatcattatttctattttttataaatatcttattaaactatcaagttaaatcattcacatttagtcaagacgacaatattaggatacctaaattgaatatttaggataaatatataggatcaagaccggtattcgcccccgtctatttcacctgtgtattacaaacatggctgttcgccttactcataccgcctcgcctgcccactga

SEQ ID NO: 17845 - DNA, 906 bp, Diabrotica virgifera
  misc_feature (228)..(246): n is a, c, g, or t
cgaagattaatgcatttattaatatttacaaattaacaaacaatagaatacaatgatcgacggacatttaaaaataatcattattacaaaatatcaagataatgagtaggtacctatgtgaattacttattacaattatattaaaacctcttcaaaatgtattaaaatttactaaaacatatttaattagggacataattaacatacacattttttacgagtatccgnnnnnnnnnnnnnnnnnnncagatatgtacaaaaagtaaggtattacgaaccaaacctataacaagtgataaaaattttaagagcaagagagggaggaagcccaagttgattcgctgatttatttaaaagaatttgaagaccagcagagcaacttcaataaacatgaatctggtcatgtagtgctggccgttgttccaaatagttgtaaaaacgaaaatagaagtgttacttgccaatattcttatagaaaacagcttacaaaaaacataatcaaatcataggcctcaaaaaaggtcatagaaaagtagtttgataagaactagcacgcaatggttgccgtcgtaactgcccaattgaatgaaaatgaggcttacgggcgagaaatccttggattttgtccaatatatcatttattacacagctgacaatgcgtagtcttaactcacactttttaatataggtacgtaaattaagatcacacaataaacgacaaaggtccccaataaactgggagttcaagaggaaaaccatataatatatcagtcttgagataactcgacataggtggacggaaatattccaacgcttccattgcattctcccaaccaccaaccgtcgtctttgtgacggtacactgtgatgatatctcccgtttttatcagcagctcatcattcata

SEQ ID NO: 17846 - DNA, 268 bp, Diabrotica virgifera
  misc_feature (9)..(157): n is a, c, g, or t
  misc_feature (159)..(199): n is a, c, g, or t
gcccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnngagtattaatacgtttttctagtattaaactgagttatatgataaatttatttaactggggtgattacc

SEQ ID NO: 17847 - DNA, 257 bp, Diabrotica virgifera
  misc_feature (2)..(17): n is a, c, g, or t
  misc_feature (19)..(61): n is a, c, g, or t
  misc_feature (69)..(256): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 17848 - DNA, 264 bp, Diabrotica virgifera
ggcgagtaactaagatatcaagtgaatcctttgatatcgacatttttgtgaacagaaatccatagcgtttactacagcgctatatcaaacataaaaatttttttttcgctgcacactcccagagagagtcaaacacatagacaaaagagacgcaacaatagcctacaacatgggagcagatagatagagaaatatacacagagcagatagaaatcacgaaggacgctgagggagggccgaggattctctgatgagaaaaaccaa

SEQ ID NO: 17849 - DNA, 756 bp, Diabrotica virgifera
  misc_feature (7)..(506): n is a, c, g, or t
  misc_feature (518)..(540): n is a, c, g, or t
  misc_feature (551)..(582): n is a, c, g, or t
  misc_feature (585)..(629): n is a, c, g, or t
  misc_feature (636)..(734): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtctttttcnnnnnnnnnnnnnnnnnnnnnnncggcccactgnnnnnnnnnnnnnnnnnnnnnnnnnnnnnnnnggnnnnnnnnnnnnnnnnnnnnnnnnnnnnnnnnnnnnnnnnnnnnngaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcataacattattaataagt

SEQ ID NO: 17850 - DNA, 791 bp, Diabrotica virgifera
  misc_feature (2)..(17): n is a, c, g, or t
  misc_feature (19)..(60): n is a, c, g, or t
  misc_feature (68)..(180): n is a, c, g, or t
  misc_feature (190)..(651): n is a, c, g, or t
  misc_feature (657)..(685): n is a, c, g, or t
  misc_feature (687)..(753): n is a, c, g, or t
  misc_feature (759)..(759): n is a, c, g, or t
  misc_feature (763)..(763): n is a, c, g, or t
  misc_feature (769)..(769): n is a, c, g, or t
cnnnnnnnnnnnnnnnncnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnngcttanattnttttanaagacgagagacccttatagag

SEQ ID NO: 17851 - DNA, 430 bp, Diabrotica virgifera
cacggagaatcctatattggagaccaaggaggacacaagaagcatggaaagtcctcaaatgggataagaataagggtagatatcgtaacagtagtggcagacaaacattggattagactggcggaagaagacgatattttgattttaatgttcagctaatagcaagtgtttatattcttttttgtttattttgtactcgttcatgaacaggtcaccacagttttcaagttatatcatttacaacgtgggataccatttctcttaatcgctcgaacatcaatataaattttgttataactgtgtccataattaacatgccataatgttctaaattctttgcgatattaaatgtgcataaaaacaaacatgccatattatgttatttgtgtatattaaaagaaattaaccattgtgtatctaatacgtcaat

SEQ ID NO: 17852 - DNA, 732 bp, Diabrotica virgifera
  misc_feature (650)..(669): n is a, c, g, or t
ataaaatatatataacaaacttaatgattattatcagttatcaagaatattatatatgtggtatagaaatttatatagtattaattgagtatcatattattttataagaacagaccactacgtgaacctagtaaaatcaagaatcgacaaaaataaataatatagatcactattttggtagttcatataatttaagaaacaatagttattatcgtaaaacatctatttgagataatgaaattgaaaagaaatgttaatcagatgttatcaatatacaaaaaaaagaagaaatgaatctagagtaatctagtttacatacatttataagtaaagacatttatattatatagagtaaccataattacaatcagcagctcgaaatattacaacgatcagaactgaaaatattcctgacgatacacagcttaatcatcttcgtatacttccacatgtcatcatttattgttatatagaataattcctattcgatacgaccttcccaattattgcatagcctgaatgtattaagatacacgaccggtagtaatatgataattacgaagttggagatgaatacacaaatatgtagcggctacaatagccagtggcctacattcctctcatttgtctatcaacccctcctttctcgnnnnnnnnnnnnnnnnnnnncgctgagctctaaatagtttgatcccctcaggaattcgaaccatagctttacagcacctcgat

SEQ ID NO: 17853 - DNA, 67 bp, Diabrotica virgifera
  misc_feature (12)..(12): n is a, c, g, or t
tcttacgcgccncctgatcctgaaaagtgactgaagtatttttatcgatgcagccaaaggtggattg

SEQ ID NO: 17854 - DNA, 746 bp, Diabrotica virgifera
  misc_feature (2)..(44): n is a, c, g, or t
  misc_feature (54)..(162): n is a, c, g, or t
  misc_feature (179)..(201): n is a, c, g, or t
  misc_feature (205)..(228): n is a, c, g, or t
  misc_feature (230)..(333): n is a, c, g, or t
  misc_feature (360)..(360): n is a, c, g, or t
  misc_feature (365)..(378): n is a, c, g, or t
  misc_feature (380)..(395): n is a, c, g, or t
  misc_feature (397)..(411): n is a, c, g, or t
  misc_feature (415)..(444): n is a, c, g, or t
  misc_feature (456)..(468): n is a, c, g, or t
  misc_feature (470)..(503): n is a, c, g, or t
  misc_feature (511)..(529): n is a, c, g, or t
  misc_feature (551)..(568): n is a, c, g, or t
  misc_feature (587)..(587): n is a, c, g, or t
  misc_feature (591)..(591): n is a, c, g, or t
  misc_feature (655)..(673): n is a, c, g, or t
  misc_feature (677)..(711): n is a, c, g, or t
  misc_feature (714)..(727): n is a, c, g, or t
cnnnnnnnnnnnnnnnnnnnnnnnnnnnnnnnnnnnnnnnnnnngtacctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggaatggtattcgnnnnnnnnnnnnnnnnnnnnnnncagnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgataaaaatttttcataattttaaanatggnnnnnnnnnnnnnncnnnnnnnnnnnnnnnncnnnnnnnnnnnnnnnttcnnnnnnnnnnnnnnnnnnnnnnnnnnnnnntagaatggtggnnnnnnnnnnnnntnnnnnnnnnnnnnnnnnnnnnnnnnnnnnnnnnntataaacnnnnnnnnnnnnnnnnnnncaccctgttattaaaacatggnnnnnnnnnnnnnnnnnngtctcgctggcactggatnattngatgggcgcgtattttgacgtgctaggtagcataatcatagttttttattgaagctggatggannnnnnnnnnnnnnnnnnnggcnnnnnnnnnnnnnnnnnnnnnnnnnnnnnnnnnnnagnnnnnnnnnnnnnnagacgagagacctatagag

SEQ ID NO: 17855 - DNA, 835 bp, Diabrotica virgifera
cggacgcgtggtttaacgtgtaacgataaaaaatataaaactgcaagtatttttactacgtcatggtgatgttagtgacagtttcagagcatagatacttgataactaatgtttaattatctcttgcgcgttgttaccaaagagacaaacgtacgcaataatctgttgagaatttatttgtcctaaaaggtatcaaaaactgtgtttcgattgaaatttacatatgacattgaacttgttagtgatgtgtggaaagaggtgtggaagtaaagagtggtcagttgtttccctactaattttatgtttaagcacaatagttataatggaatatgtatataaaatcgaatacaaaagtaaccgcatccattgaaaagaactaatttattttcacaacatatttttttagctgaataccaggatttctctcttatagatttaaggaaagatgtaaataaaaatgataagtacctaactatacattcccatatatccagatatttaacagatcaatttatagtatcatgctaaaacgaacttagaaaatcgaaggcgtcttttttatgagccctttttgtaatatttaggctagatatattttattatgccttttttaatatgtcttcagattttatacgtgttgtactaccattgatgttctctctactatggtcatatttccaaccgagtgccacaaccgacctaacagaaatctacgtccacgcatctgtaataatcgtattgagactcatccaggacacgtgcatgcataactaccagatgatgttcatgttcttaagaatgatatttagagttgcatcatgtgcgttgatctata

SEQ ID NO: 17856 - DNA, 220 bp, Diabrotica virgifera
  misc_feature (2)..(91): n is a, c, g, or t
  misc_feature (97)..(167): n is a, c, g, or t
  misc_feature (169)..(203): n is a, c, g, or t
  misc_feature (211)..(211): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnngtgattanaaaataaag

SEQ ID NO: 17857 - DNA, 839 bp, Diabrotica virgifera
  misc_feature (91)..(113): n is a, c, g, or t
  misc_feature (128)..(173): n is a, c, g, or t
  misc_feature (185)..(220): n is a, c, g, or t
  misc_feature (251)..(285): n is a, c, g, or t
  misc_feature (287)..(301): n is a, c, g, or t
  misc_feature (327)..(376): n is a, c, g, or t
  misc_feature (436)..(457): n is a, c, g, or t
  misc_feature (613)..(625): n is a, c, g, or t
  misc_feature (627)..(664): n is a, c, g, or t
  misc_feature (783)..(802): n is a, c, g, or t
atctattttaagataataagatatttttcaatgaacgcacacaccgatttcatttaatgatagtcagttaccattgcgagagaatatttcnnnnnnnnnnnnnnnnnnnnnnncttttgtaccttggnnnnnnnnnnnnnnnnnnnnnnnnnnnnnnnnnnnnnnnnnnnnnncttaaaacagcnnnnnnnnnnnnnnnnnnnnnnnnnnnnnnnnnnnngaaataacctttttggaatgaaatgtcatannnnnnnnnnnnnnnnnnnnnnnnnnnnnnnnnnncnnnnnnnnnnnnnnngcaatatatctataagtaaatacttnnnnnnnnnnnnnnnnnnnnnnnnnnnnnnnnnnnnnnnnnnnnnnnnnnctattaaaatgtaacttttaaatagaacttaggattacacatgttcacatattaaaaccnnnnnnnnnnnnnnnnnnnnnngcatcatatatattttctataaatattttatgaacatagaaatttaaactatttagacttacaaatgatgataatactactattaaatgactgtatattccagtaacaacatactagcactaacaaaggacttcggcaacatttttctcacctgcnnnnnnnnnnnnnannnnnnnnnnnnnnnnnnnnnnnnnnnnnnnnnnnnnnctaagacggatgtccgcgcgattttgaccgtgctatagtatcttagtcattaagttttacattgaaggctgtggtgaaggcgtggatgaaacaaaactgtctttatacaagttatatcnnnnnnnnnnnnnnnnnnnncagcttacattcctctgcatggacgagtagaccctat

SEQ ID NO: 17858 - DNA, 786 bp, Diabrotica virgifera
  misc_feature (4)..(24): n is a, c, g, or t
  misc_feature (26)..(68): n is a, c, g, or t
  misc_feature (76)..(186): n is a, c, g, or t
  misc_feature (198)..(386): n is a, c, g, or t
  misc_feature (400)..(564): n is a, c, g, or t
  misc_feature (566)..(609): n is a, c, g, or t
  misc_feature (618)..(649): n is a, c, g, or t
  misc_feature (661)..(694): n is a, c, g, or t
  misc_feature (696)..(736): n is a, c, g, or t
  misc_feature (754)..(754): n is a, c, g, or t
  misc_feature (758)..(758): n is a, c, g, or t
  misc_feature (766)..(766): n is a, c, g, or t
  misc_feature (770)..(770): n is a, c, g, or t
atcnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttattcatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnggcccaccnnnnnnnnnnnnnnnnnnnnnnnnnnnnnnnnggctaaggtagnnnnnnnnnnnnnnnnnnnnnnnnnnnnnnnnnngnnnnnnnnnnnnnnnnnnnnnnnnnnnnnnnnnnnnnnnnnagaattctaatttttaangtanaagcttanattnttttaaagacgagagc

SEQ ID NO: 17859 - DNA, 218 bp, Diabrotica virgifera
  misc_feature (171)..(171): n is a, c, g, or t
  misc_feature (202)..(202): n is a, c, g, or t
cgtggaatggcatagttttcgacataaacgcgtttgaacttgaaagagggtcgaggagttgcaatttttgagcccaataacttttgattgaaaggtagaatagcggttctgcttaccgcatttaaaagttcaagtcaaattttatcggttttgattattttcattgctaanagttgatttttttattggttgacaaagctantaacacatagtggttt

SEQ ID NO: 17860 - DNA, 922 bp, Diabrotica virgifera
  misc_feature (22)..(39): n is a, c, g, or t
  misc_feature (262)..(282): n is a, c, g, or t
  misc_feature (346)..(369): n is a, c, g, or t
  misc_feature (449)..(469): n is a, c, g, or t
  misc_feature (471)..(486): n is a, c, g, or t
  misc_feature (489)..(506): n is a, c, g, or t
  misc_feature (509)..(539): n is a, c, g, or t
  misc_feature (580)..(628): n is a, c, g, or t
  misc_feature (657)..(670): n is a, c, g, or t
  misc_feature (672)..(691): n is a, c, g, or t
  misc_feature (693)..(728): n is a, c, g, or t
  misc_feature (752)..(771): n is a, c, g, or t
  misc_feature (823)..(842): n is a, c, g, or t
  misc_feature (866)..(883): n is a, c, g, or t
  misc_feature (888)..(921): n is a, c, g, or t
gcggtccgatttttctcttatnnnnnnnnnnnnnnnnnntctctctttcgtaaatgtaaagaaaaaaatttctctttcaacgatcggttaaattcgtattcgggggtgaaatctctctctttttcacaaaaggaaaaattctcaatttttcgtaccttcgggtatcaggggattaactaaattcaataaattatcatatcttcatctaacttttcgaaattttcaaaaggtgctcaaaaaaattcaaaaattttctaactcnnnnnnnnnnnnnnnnnnnnnaaatcaattttctttcggtaacggaaacggtatttcggtttttcaatctattctaattttctcnnnnnnnnnnnnnnnnnnnnnnnncaactaaacaataataatctatcaaattaaaataatttctatctttattatatttcaaataatttctcagggatcgagcnnnnnnnnnnnnnnnnnnnnntnnnnnnnnnnnnnnnnctnnnnnnnnnnnnnnnnnnggnnnnnnnnnnnnnnnnnnnnnnnnnnnnnnncggttaactaattcaactttcactcactaataactttaatnnnnnnnnnnnnnnnnnnnnnnnnnnnnnnnnnnnnnnnnnnnnnnnnncagtaatggatggataataattagtatcnnnnnnnnnnnnnncnnnnnnnnnnnnnnnnnnnngnnnnnnnnnnnnnnnnnnnnnnnnnnnnnnnnnnnncgtttataaaaacacgtcttttgnnnnnnnnnnnnnnnnnnnngccgcccaccgattaattggaagggccgggggtattttgaccgtgtaagggnnnnnnnnnnnnnnnnnnnncatggaaggtggaatgaaggggtnnnnnnnnnnnnnnnnnntcttnnnnnnnnnnnnnnnnnnnnnnnnnnnnnnnnnng

SEQ ID NO: 17861 - DNA, 875 bp, Diabrotica virgifera
cggacgcgtgggctgatccaaccaaaacaaaccccggcgtgcagtccccgattgcaacgaacgctagggcatctatgccatttcgtcgtaaccttctgtcaactgtgaaatgcgtgacagattgtgtttttttggaaaatgttgcagtaacagatgaaacgtcaggaagaaacaattacatgcaacgggctgtaagacctgaatgtaattacttatcacaaaaacgatagaactcaaaaacaaaacagttacatttgccgattttttagctgttctggtccacggactcaacctgatattttagaatttggcatttcttcaatatcgtctcgttatcttagcgtttttgttaagatatactgaaatattgaaccaatctgttttaaaacggaagaatactgtatttaggacacgttacagtttaattgacttgttttgtgaataggtgtttgtattttttgtatatgtgaattgtttttaaaacactaataaatgtacaaataaccgaaacttaacgtccaacagttgtctgacaatgtagagtagcgtttttatatataaactgattaaacttctgtagtatcattgaattctcccgacctacactcagaaatgtgaataacgcattatactgttactggtgacgtcaggctataatttttttaggttagatgcagagagtgacttgaacttaccaaatacagtcgaacccgcttattagaataccagttataggaatatcctggtttaaggaatagacatttgaggtcccgaaacgtttctactagcccccaatgatcggtttagtgatatcccggttttaggaatacgtttgcttggcaagaagctattcccatagcggatcgactgtattc

SEQ ID NO: 17862 - DNA, 606 bp, Diabrotica virgifera
  misc_feature (3)..(23): n is a, c, g, or t
  misc_feature (38)..(90): n is a, c, g, or t
  misc_feature (110)..(125): n is a, c, g, or t
  misc_feature (128)..(140): n is a, c, g, or t
  misc_feature (410)..(430): n is a, c, g, or t
gannnnnnnnnnnnnnnnnnnnnctagactgaatatcnnnnnnnnnnnnnnnnnnnnnnnnnnnnnnnnnnnnnnnnnnnnnnnnnnnnngtgaagaatatataagaggnnnnnnnnnnnnnnnncgnnnnnnnnnnnnngttgtaatatttgttttttcaatcataatattaattattaaaccttatttattttctagtttattagtacggagatgggagtagtttgtgtagtgtggtatttgtatttaaagatatgtaatattttgcgaaactaaatcaattgatttataatcaaagtatttataagtaaagaattccatattgttacagatgatttattttcagtggtggggtaccatatgagatattataaaaattaggtatttgaagagaagtggggatagatgnnnnnnnnnnnnnnnnnnnnngataagaaatgtgctcgagaataattttatatgtaagagaatactgaattaataagccaatgctatgtttttaaaaaggacaaatgatgatagatatgtagaaatacaggactgtatagttagcaacatcatagatctatctagaagaagaagacgtctacgtgattttaaacctg

SEQ ID NO: 17863 - DNA, 967 bp, Diabrotica virgifera
  misc_feature (69)..(950): n is a, c, g, or t
gccggttgacagacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccttcgacagatgac

SEQ ID NO: 17864 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17865 - DNA, 238 bp, Diabrotica virgifera
  misc_feature (148)..(165): n is a, c, g, or t
agcagtccggtactccgtacaaaactcgttggctaatatagtaaatttggccggcttttcccagtttgatatagttaagtcaggcgtacaagaccgggcttcgatggatgggaggtctattccgagttaatcgtggtacgctttagcnnnnnnnnnnnnnnnnnnaatttcgtaacaaattacaaaataggtcatgtgacaagaaaaagtatgaaccacaaccaataacaataaaaca

SEQ ID NO: 17866 - DNA, 369 bp, Diabrotica virgifera
cccaccccccgcgcgcgcggtgttctcttggtcgctccaccactgagatgtccttgagtgttggcaccgattgattcgaataacagccacttcaagagtgtagggtaatatccttctgacaactgagaaatgcctgatccttagcgattcgttggaataccgtttcttaactagtagaaatgtactgagtaattatttccttttaacgactaccaagacatgaaagttattaataatcttgaacaaaatataattgatgtccaaatgagtgttattagactcctattgaaaagcacctattcacgaaaacatgctgctaaatctttggtagtgacttcttcattatgaaatcctttctttttagtaata

SEQ ID NO: 17867 - DNA, 712 bp, Diabrotica virgifera
  misc_feature (176)..(199): n is a, c, g, or t
  misc_feature (290)..(308): n is a, c, g, or t
  misc_feature (349)..(378): n is a, c, g, or t
  misc_feature (403)..(432): n is a, c, g, or t
  misc_feature (484)..(528): n is a, c, g, or t
  misc_feature (683)..(711): n is a, c, g, or t
ccccgcgcgcccccacgcgcgcgctcttcctttattttcacttattaagatatcttttagtactagtcatgaaacgtctgattcaatgccagttaatgagaattgtgagagaccatctgacttttattaaataacaatctacttttcgtaccttgcgaatccgggcttattcagtnnnnnnnnnnnnnnnnnnnnnnnncaatttaaaagcgctcacaacatcaacatttttactgaaaactacatattttaaataacttttttgcaatgtaatgttattcgcctatcgnnnnnnnnnnnnnnnnnnncccaacattctaattatttattcacaacctatttacaatcnnnnnnnnnnnnnnnnnnnnnnnnnnnnnnctttagggatgaccttcctaatagnnnnnnnnnnnnnnnnnnnnnnnnnnnnnncaccaggaccaacaattatcatatcttacaacacgttagctatttattttcnnnnnnnnnnnnnnnnnnnnnnnnnnnnnnnnnnnnnnnnnnnnncctataaattatttcaatttagtaacgatgacaatatcaatattaaaaaactgcatatctactagaaatacataggtcgaatacaggaactcggcatctttgttctcacctgtttattagccacacgtcttttcgcttagatataaagactcgannnnnnnnnnnnnnnnnnnnnnnnnnnnnc

SEQ ID NO: 17868 - DNA, 610 bp, Diabrotica virgifera
  misc_feature (116)..(139): n is a, c, g, or t
gccccccccccccgccgctaatatgtaattggtcagagtagtacaatttgtataagtacgtggcaaaagattttactatttacaagactagtaatgattgtggtgtcgagaccgannnnnnnnnnnnnnnnnnnnnnnngttctttgcatggcgcggtatcctgcagttttaaactgaatctgatggttttatctatgcttgaacataagagaggttgcaacttacgcatctatgcattgctagttcgagtgcattcaattggtgtatctgtaggtgtaagatacgcacatctgcctatctatccgtcagaaagcaaagctgattgatgaactcatctgagatcataaacgtgattaagtcatataactcttatgtggcgtaaactaattgcggactgtgcacttagacttgaaacaaacttataaacgtaaagtgtacgaccaccatgacgctgtatgaagtacactgtcggcatatgatacgaggagtcgttatataccacgataagctgtagccctcacggggtaattacctcctaagttccatatacattctaaatttggaggggaagatgagcagatgcagaacggcgataatatagatctctgt

SEQ ID NO: 17869 - DNA, 726 bp, Diabrotica virgifera
  misc_feature (9)..(419): n is a, c, g, or t
  misc_feature (428)..(527): n is a, c, g, or t
  misc_feature (529)..(675): n is a, c, g, or t
  misc_feature (685)..(685): n is a, c, g, or t
  misc_feature (691)..(716): n is a, c, g, or t
tgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgattanaaatannnnnnnnnnnnnnnnnnnnnnnnnncaattaataa

SEQ ID NO: 17870 - DNA, 445 bp, Diabrotica virgifera
ccgctctttcgcgcccgcatactaaagatattctacactactcctttttagttttacctcgtatggttcgaaaaggagtacttctaataaagagtgactatattaagaaacttattaatgttgtacagatctatccccggggacctggtctgaattagtgattatataaccacgatttatttcgtcctgaaaagtagtcaagcatgaagattattgatgatctaataatctttacaaatgatttgtagatgctatgttgttatacctgatttgttaaatatgttttcgggaaaggaatgttgcttctcccttgtttatgcattatttcttaaggacactttgtttattaccattatctaatatcaataaaggtcgcgaatttaagagactgttataaaaacgacattgtttacaaatcacgaggatcaatattcatcttattata

SEQ ID NO: 17871 - DNA, 593 bp, Diabrotica virgifera
ggggggacgcccggggggcccgggccggaattcccgggccgccccccgcccccggccgacgcgaattcggtcagaagtcgtaagattttcattagtacgtaggcgatagattccctatttattagctcgtaatgagtgtggcgaccagagcgatttcttttcaaaagaacaaaaagtggtctttgcatggcgcagtgacctgcaatttaatatcagtatagaggtctttatcactgcttgaacgaaagagacggcgcgacttagctctctggattgcaaattcgaaccaattacactcgtgtgcttgtggtggaagatatctacctttcccgatctatccgatgcaaagcaaagcctgcttgatggccgcatcggagactatgtacgtgataaagtcacataactcttatgtggccctgactagttggcaactgtgacacttagacctagtaataaagtgatcaatgtaagcgtgtacgacaccatgaccagattgaaagatccgtctgcataagatacgaggagtcagtgatataccgacgtataagctgcagccctcacgagggtatatcctccaagatccatgtagcttc

SEQ ID NO: 17872 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17873 - DNA, 859 bp, Diabrotica virgifera
  misc_feature (185)..(217): n is a, c, g, or t
  misc_feature (221)..(244): n is a, c, g, or t
  misc_feature (275)..(288): n is a, c, g, or t
  misc_feature (290)..(326): n is a, c, g, or t
  misc_feature (328)..(348): n is a, c, g, or t
  misc_feature (355)..(383): n is a, c, g, or t
  misc_feature (400)..(462): n is a, c, g, or t
  misc_feature (466)..(734): n is a, c, g, or t
  misc_feature (736)..(767): n is a, c, g, or t
  misc_feature (771)..(810): n is a, c, g, or t
  misc_feature (812)..(858): n is a, c, g, or t
ttttcatttattttatgataataaaatattctttcacgtagaagtaatgaagaatttcatgtcacgataggtagttcggtatcgtgagagaatcatctttatcgtttcgtaaaagaaaaatttcatcttccgtacctcgtgtatcagggattcttaattaataatcatatcattcaccactctcnnnnnnnnnnnnnnnnnnnnnnnnnnnnnnnnntcgnnnnnnnnnnnnnnnnnnnnnnnncttcgtaacgaaacggtatctcgtttgttcnnnnnnnnnnnnnncnnnnnnnnnnnnnnnnnnnnnnnnnnnnnnnnnnnnncnnnnnnnnnnnnnnnnnnnnnattattnnnnnnnnnnnnnnnnnnnnnnnnnnnnngaaataaaattgtatcnnnnnnnnnnnnnnnnnnnnnnnnnnnnnnnnnnnnnnnnnnnnnnnnnnnnnnnnnnnnnnngttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnatgnnnnnnnnnnnnnnnnnnnnnnnnnnnnnnnnnnnnnnnncnnnnnnnnnnnnnnnnnnnnnnnnnnnnnnnnnnnnnnnnnnnnnnnt

SEQ ID NO: 17874 - DNA, 810 bp, Diabrotica virgifera
  misc_feature (2)..(16): n is a, c, g, or t
  misc_feature (18)..(31): n is a, c, g, or t
  misc_feature (33)..(60): n is a, c, g, or t
  misc_feature (68)..(147): n is a, c, g, or t
  misc_feature (149)..(180): n is a, c, g, or t
  misc_feature (189)..(551): n is a, c, g, or t
  misc_feature (553)..(809): n is a, c, g, or t
cnnnnnnnnnnnnnnncnnnnnnnnnnnnnncnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17875 - DNA, 819 bp, Diabrotica virgifera
  misc_feature (11)..(58): n is a, c, g, or t
  misc_feature (103)..(128): n is a, c, g, or t
  misc_feature (135)..(148): n is a, c, g, or t
  misc_feature (150)..(167): n is a, c, g, or t
  misc_feature (178)..(214): n is a, c, g, or t
  misc_feature (219)..(249): n is a, c, g, or t
  misc_feature (261)..(810): n is a, c, g, or t
tttatcttatnnnnnnnnnnnnnnnnnnnnnnnnnnnnnnnnnnnnnnnnnnnnnnnncttaacgatagttaattagtatcgtgagagaatatctttcttttnnnnnnnnnnnnnnnnnnnnnnnnnntacctcnnnnnnnnnnnnnncnnnnnnnnnnnnnnnnnntcatttatccnnnnnnnnnnnnnnnnnnnnnnnnnnnnnnnnnnnnncatcnnnnnnnnnnnnnnnnnnnnnnnnnnnnnnntaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaaagc

SEQ ID NO: 17876 - DNA, 683 bp, Diabrotica virgifera
cttaggaagtaagctaagacaatttagcaattacctcttccacttgttcctaatttgtgcagatgacgtatcactgtgtctagggtgcgctagtgctaattttgttatatgtgactaatggtggatcaccaccagtacaatactctgaaaattactacaaccttgccaatattgttgtacataaaggcatacatcattcatagacttacatggctgtcatccttatatgatataaattacgccacacttttatgtggactgactttcactattgagtccttatcagctaacagcaaatcattgtgcagtatgaagatagtgaatcatcaattactttatgagctcataatttgacaatcaaagaacagagtgaagccactatgacttccacatcatttgttttccatgaagattattaggattccgcgatacttctgcatattgcagttattgaattgtctaaagctttcattttaaatgactacattgcctgcataaaaatgccagaatatgcgaacattagcattaggtatgaagaacatgtagcatatatttgcctgatgaggaagaataaatgatgctgagcaatcaaacagcggtgaattactctaccgttattttaccattattccaaagataatgctgggagttctcatatttattgcaattaccatcgaaccgtc

SEQ ID NO: 17877 - DNA, 120 bp, Diabrotica virgifera
  misc_feature (2)..(39): n is a, c, g, or t
  misc_feature (47)..(59): n is a, c, g, or t
  misc_feature (62)..(91): n is a, c, g, or t
  misc_feature (93)..(105): n is a, c, g, or t
cnnnnnnnnnnnnnnnnnnnnnnnnnnnnnnnnnnnnnngaaaatgnnnnnnnnnnnnntcnnnnnnnnnnnnnnnnnnnnnnnnnnnnnncnnnnnnnnnnnnnatgtatattagaaat

SEQ ID NO: 17878 - DNA, 849 bp, Diabrotica virgifera
  misc_feature (544)..(568): n is a, c, g, or t
  misc_feature (734)..(734): n is a, c, g, or t
  misc_feature (846)..(846): n is a, c, g, or t
atcaattctaaatcactccgcggccggcttcgtctcagcccaattcgggtttctactagctcagttcgctagcttaaaccagggagtctcttagataagttctccgcaagactcactaaccggccggctcctcgttcgcttcacttccgtattagttcttccggccacctctccgccttcatcgcttcggagtgggaagtagatcgaatctcgcttcgccttcacgtcgaagaatcgaaccgtgtgcgccttcggtatcgcacagattattacaacttcgtgttttttcgtctcgtagtgtaaatcgaaccaaattaggttcttctacaagccacggtaaaaatcgaatctagcactttcgtccacaacacattttcggaactatcggcactttcgcgtggttattagaagtttggttggaaagattcataaactccacttctcgtctaacgtcggagttcatcgcaaatttctttacgattgttaagtattctttcatcgtaaaacgaaaagatattgaagtagctattaattatactttcgnnnnnnnnnnnnnnnnnnnnnnnnnctctttacactggaacaaaaatctttcgtgttcacgaaaataggttaagaattggatatttattaattccgttttggttggcgagctcttatactaataaaccaagaatggaaggtggtctaaaaagtcgaatttaactttttaagctggttgtttatttttattnttacgggtgttttagttaagcgaagtgaaaagtggtggtcacttattctgggataatgaaaacttagtaattttaacataaacactgtttctagcatgacaaactgaataanatt

SEQ ID NO: 17879 - DNA, 666 bp, Diabrotica virgifera
  misc_feature (2)..(82): n is a, c, g, or t
  misc_feature (84)..(256): n is a, c, g, or t
  misc_feature (258)..(467): n is a, c, g, or t
  misc_feature (531)..(544): n is a, c, g, or t
  misc_feature (547)..(569): n is a, c, g, or t
  misc_feature (577)..(599): n is a, c, g, or t
  misc_feature (629)..(652): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgaaattttattgtagagttcaaatcgataataaagattgcgacctcgatgatggatnnnnnnnnnnnnnnggnnnnnnnnnnnnnnnnnnnnnnntgttcgannnnnnnnnnnnnnnnnnnnnnnagtttagaccggtgtgagccaggttgattnnnnnnnnnnnnnnnnnnnnnnnncttagtacgatagg

SEQ ID NO: 17880 - DNA, 866 bp, Diabrotica virgifera
  misc_feature (5)..(20): n is a, c, g, or t
  misc_feature (22)..(36): n is a, c, g, or t
  misc_feature (38)..(64): n is a, c, g, or t
  misc_feature (72)..(85): n is a, c, g, or t
  misc_feature (87)..(108): n is a, c, g, or t
  misc_feature (113)..(150): n is a, c, g, or t
  misc_feature (154)..(178): n is a, c, g, or t
  misc_feature (195)..(327): n is a, c, g, or t
  misc_feature (329)..(756): n is a, c, g, or t
  misc_feature (765)..(765): n is a, c, g, or t
  misc_feature (775)..(776): n is a, c, g, or t
  misc_feature (788)..(853): n is a, c, g, or t
  misc_feature (859)..(859): n is a, c, g, or t
  misc_feature (861)..(861): n is a, c, g, or t
  misc_feature (863)..(863): n is a, c, g, or t
taacnnnnnnnnnnnnnnnncnnnnnnnnnnnnnnncnnnnnnnnnnnnnnnnnnnnnnnnnnngtacctcnnnnnnnnnnnnnncnnnnnnnnnnnnnnnnnnnnnnctccnnnnnnnnnnnnnnnnnnnnnnnnnnnnnnnnnnnnnntccnnnnnnnnnnnnnnnnnnnnnnnnnctctctaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcttanatttttttannagacgagaaacnnnnnnnnnnnnnnnnnnnnnnnnnnnnnnnnnnnnnnnnnnnnnnnnnnnnnnnnnnnnnnnnnnatttantngnggg

SEQ ID NO: 17881 - DNA, 242 bp, Diabrotica virgifera
tatttattatctgcgaacttacatcgtcttgacaattatcacattttattgcttggataaatgaatgtatataatttttctggtctgcccaggccaacgtttttatttatctctccttttttaagatataaattaaactcatttcttaacaaatgatgctgaactcaatattattgtattatttgtattaaacattttcaagtatgagttaagcccgtagcttttattaatatttacttttt

SEQ ID NO: 17882 - DNA, 617 bp, Diabrotica virgifera
ccccctcgcgggcccgccaagagagcagagcgagaggggcccctttaaggcgagcgcaagacgagcgacagaagcaacacagccaaacaggggaacgcaaacccgaaacagagcaagtcaaggggacgcccacgaccgagagaacaagagacacacaacaaacaaagaaccccacagcgcgaccacacaagcgaaaacggacaaagaggaccacaagaaaggaaagacgagaaagacaacaagccaacgcacggcagaggagacggccaccgacaggacacagcggaaggaaaaaaaggaaagccgaccaagaagacgcagcagcacccacaaccaacgcagaactaaaaagaagaacagaccaacagcgaaggggcagcaaaacaaaacgactgcaactacgaaaccagaagagacgaaacaggcaacacccacccgaacgaaaagaacggcagcaaagaatgtgataaaaaattagatgacatctttggagagagtctgaacgacgatcccattagaagactatatgatatggagatgtccttatgaagagaagaccctaatcaaggggatcagcaacaaacggcgacctaggcatcagatccgaaaaccatgta

SEQ ID NO: 17883 - DNA, 863 bp, Diabrotica virgifera
  misc_feature (49)..(68): n is a, c, g, or t
  misc_feature (83)..(98): n is a, c, g, or t
  misc_feature (100)..(115): n is a, c, g, or t
  misc_feature (127)..(166): n is a, c, g, or t
  misc_feature (170)..(202): n is a, c, g, or t
  misc_feature (211)..(344): n is a, c, g, or t
  misc_feature (346)..(405): n is a, c, g, or t
  misc_feature (407)..(582): n is a, c, g, or t
  misc_feature (584)..(604): n is a, c, g, or t
  misc_feature (608)..(629): n is a, c, g, or t
  misc_feature (637)..(650): n is a, c, g, or t
  misc_feature (652)..(669): n is a, c, g, or t
  misc_feature (682)..(714): n is a, c, g, or t
  misc_feature (716)..(739): n is a, c, g, or t
  misc_feature (748)..(748): n is a, c, g, or t
  misc_feature (750)..(774): n is a, c, g, or t
  misc_feature (787)..(787): n is a, c, g, or t
  misc_feature (797)..(797): n is a, c, g, or t
  misc_feature (810)..(845): n is a, c, g, or t
  misc_feature (851)..(852): n is a, c, g, or t
atcttaacgatagttaattagtatcgtgagagaatatctttcatctttnnnnnnnnnnnnnnnnnnnncttttcgtacctcgnnnnnnnnnnnnnnnncnnnnnnnnnnnnnnnntcatttcattcnnnnnnnnnnnnnnnnnnnnnnnnnnnnnnnnnnnnnnnnatcnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnntggnnnnnnnnnnnnnnnnnnnnnngcccacgnnnnnnnnnnnnnnannnnnnnnnnnnnnnnnnggctaaggtagcnnnnnnnnnnnnnnnnnnnnnnnnnnnnnnnnngnnnnnnnnnnnnnnnnnnnnnnnnctttatttnannnnnnnnnnnnnnnnnnnnnnnnngttaaaagcttanatttttttanaagacgagagacnnnnnnnnnnnnnnnnnnnnnnnnnnnnnnnnnnnngtattnnaattattatat

SEQ ID NO: 17884 - DNA, 957 bp, Diabrotica virgifera
  misc_feature (7)..(26): n is a, c, g, or t
  misc_feature (241)..(262): n is a, c, g, or t
  misc_feature (452)..(484): n is a, c, g, or t
  misc_feature (604)..(604): n is a, c, g, or t
  misc_feature (679)..(679): n is a, c, g, or t
  misc_feature (813)..(813): n is a, c, g, or t
gacgggnnnnnnnnnnnnnnnnnnnngtaaagtttagtgtctacccgaaaataaataaatatcgtctattaaaaacaataacacgtggatcgtttggcctagtttcgtttaccgttacagtagttcgccttaagtactcgcccaatcaacagacccttacgacaaattagctcgatcatcggttcaataaatcggtaacaacgaaacaaaagggactcgtagccttcgacaaactatattnnnnnnnnnnnnnnnnnnnnnngtacttcgaaatacaccttcaagtttatcccaggagagaagaaagtattttcgtgataaagaacgtgacatcctaaaaaagaggatgcaggaactaacgtccaacatcggagaccttcgtttcgccccaaaaggaaaagttttttcgaacaatttatatatgacagcttcaaggaagtctcgcacttttnnnnnnnnnnnnnnnnnnnnnnnnnnnnnnnnnctttctttttcgaccagatccagtgaatggccgaaacaaactggttcaactcagaaaatccaaatttggggaaattggtttctctgggaatattcagacctggcatcaggccttaataanaacagttttgtgctctgattatgggagtagtcaaaaaatggttttgccgaagccttgacacagaactggcccagnccgatgggtggcttcaaaaaacttaacgaagacttctttagttacgctagtaaaccctggctcaggctgtgctttctacatcaactcattggttactgactggttcaatacttcgcgtcgtacttctttagtcngtaataaacttgagttttttaattagaaactctgctatcaaaattttgttggtgatctatggtacgaaaactacataaacataataatttctaatggtcttttttaacgggagttagtaatttgtgacgtttgataatctgcta

SEQ ID NO: 17885 - DNA, 69 bp, Diabrotica virgifera; identical to SEQ ID NO: 12478
  misc_feature (2)..(18): n is a, c, g, or t
  misc_feature (20)..(68): n is a, c, g, or t

SEQ ID NO: 17886 - DNA, 835 bp, Diabrotica virgifera
  misc_feature (354)..(383): n is a, c, g, or t
attattaattatgttaataattattgttatattaattgattatagactccacagactttttaacgacccaaacaaagttgacattgacagtgattaattatttgataatgatcattcttgattggcgttcgaacaaccggcccttagggttgcaaatgtgtggtggttcaagttggaccatctctgaggagtaaatgtttctgaaatgagtgtgatataataatgtatgaatgtttcctaaaaaaacgtagattccccctacaagattggagtattgtttttttttctaagattactataaggcatttattaatgtactttcacagtaccatctgtttccaatcagtttatacnnnnnnnnnnnnnnnnnnnnnnnnnnnnnngtatatttcatggcggagatgccgtgagtgccattatttctattatgcgggctagtcagttggtaaaatatcagtatttatatcagaaagtacagtttttgttactatatatcaccctgtacgtcaatattcaaacttcaataaattgtgcggtgtttttgagttgaggcaactttgcagttaacatgttttccttcacactcgatactacattataatttatatcaacatttggaaaatatttgatattttgcaaatgactagccggtatttcgtacgtccaaggtggtacggccgttaccaatggttatggcccgtacaggattggtcgtatacaaggaattataacattgttaaaaaatttggttataacatcgttttttactacaagcaagttggcattgggtaaaaatagtgatggaaatttatgtaccaagtgtgctttaatttct

SEQ ID NO: 17887 - DNA, 638 bp, Diabrotica virgifera
  misc_feature (10)..(36): n is a, c, g, or t
  misc_feature (52)..(81): n is a, c, g, or t
  misc_feature (83)..(103): n is a, c, g, or t
  misc_feature (141)..(153): n is a, c, g, or t
  misc_feature (155)..(174): n is a, c, g, or t
  misc_feature (179)..(191): n is a, c, g, or t
  misc_feature (194)..(228): n is a, c, g, or t
  misc_feature (242)..(258): n is a, c, g, or t
  misc_feature (260)..(346): n is a, c, g, or t
  misc_feature (348)..(398): n is a, c, g, or t
  misc_feature (431)..(458): n is a, c, g, or t
  misc_feature (484)..(516): n is a, c, g, or t
ggtatcaggnnnnnnnnnnnnnnnnnnnnnnnnnnncattattctcagatcnnnnnnnnnnnnnnnnnnnnnnnnnnnnnngnnnnnnnnnnnnnnnnnnnnntattgtgtatggcattgttgtttgcctatatctaattnnnnnnnnnnnnngnnnnnnnnnnnnnnnnnnnnctatnnnnnnnnnnnnnccnnnnnnnnnnnnnnnnnnnnnnnnnnnnnnnnnnncagcgaggttatannnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnngatcgatgataatattatcattaatcgattgtnnnnnnnnnnnnnnnnnnnnnnnnnnnngaaccgaattcatgtttcgttcttgnnnnnnnnnnnnnnnnnnnnnnnnnnnnnnnnnaatctctcagccctcgactgcccgcagattcgtttgaatgtgaccgggcatgttagccgagctaaagtatcataatcgttagtctttttattgacagctgcaatgaagtgtcgcatgtaaat

SEQ ID NO: 17888 - DNA, 743 bp, Diabrotica virgifera
  misc_feature (107)..(121): n is a, c, g, or t
  misc_feature (184)..(210): n is a, c, g, or t
  misc_feature (319)..(334): n is a, c, g, or t
actagttctaggcaactttcgttgtatagagattttcactaagtcaattcttttcgagttatttgtgagtgagtattttcacttttcaacaaaataaccccgttttnnnnnnnnnnnnnnnaattaaaaactaattattttatcgaaaaaatactcttagcaaaaatatagcttacaagaaagnnnnnnnnnnnnnnnnnnnnnnnnnnngaaggctgcaaaacccagtagaaagcagagttgtagctaatgaaaagtaggttcccattcctcaaatcccaaatcgaacatttcgacgcgaaataaccaaaaaatcaannnnnnnnnnnnnnnnactcattacaacttttttaaagtttttaaaagaagctatatttttttaacttcaaaagtaagttaaaaataatgttggtccctttttttggtaaaaaaatcatgtaaaccaccgcctaattagcatctcaaatgaaattaatcgttaccgcttcaccacaagtttcatcggttcaaagtgcttatttttgaaaaggctgtagataaaaggccgaaagggctgaacgagtcactaatcatgagtgaatgcaaaatttaaacatccatgtcttccaatttttgtcttacaggaaaacaaaacatccaaaatattcagaaaagcaaaatctacatttttttactgcttgagatatgttggatcactaatgaactttataggtattcgtaaacagaaaatttttttcagagtg

SEQ ID NO: 17889 - DNA, 89 bp, Diabrotica virgifera
  misc_feature (3)..(43): n is a, c, g, or t
ctnnnnnnnnnnnnnnnnnnnnnnnnnnnnnnnnnnnnnnnnnttttttttgatttatagaataaattaccctagggataacagcgtaa

SEQ ID NO: 17890 - DNA, 839 bp, Diabrotica virgifera
  misc_feature (738)..(738): n is a, c, g, or t
  misc_feature (763)..(763): n is a, c, g, or t
  misc_feature (801)..(801): n is a, c, g, or t
  misc_feature (811)..(812): n is a, c, g, or t
tttcggaggttcttaaattctacaggactctagagaggaagtcgacaagcaacgtagacgtggttttactagttggaatcttcttcttcttcttattcgcgccgtcttttttcgaaggttggcgatcaaaatggcaattgtagctttggaaactcgctcgcacgaaatatttctgcatatgaacatatcgcagaaatatgaatctgagtgttaacatcttacaatttaattgaatctgagtgttaacatagttttgagggtttcttttcaattctctgcttatttttaaatcttctagtactagtagattcattttagtatagttattattaggatcatacatatactatgtatgatctactatctctttggggactaaagttatgattcgatgcatgcaaatgatgaccagagctagatttatcgatctttgacagatgttctttaatacgtttattcaaaggtcgcatcgttctacccacgtatgtcaaaggacagtcctcacaggacaatttatatatgcaaattttagaagttttgttaattttgtctttagtatgagaaaaaatagatttgatattttctttacatttaaatgaaagttttaagttaggaatgttatttaagattttagctatattttctgaaggataacctatgtatgatatagatctatacataactgccgaattggaattgtcggtggatatagcaataaaaagaagaaatcttctgttngaaaggatgattagaagatctaggngtagtatggtcagtctgagttgggtttcaaagactganaaacttattnngtctctattctagtcagtgttaggtct

SEQ ID NO: 17891 - DNA, 524 bp, Diabrotica virgifera
  misc_feature (259)..(284): n is a, c, g, or t
tatactttatatggatgaacaaattatttcttggtacctagagcattcgggattattacctcactattcacatactatatctatctgtcgaatctcacgaccgcctcaaaagaattacaaatcttctccttgtttcactgaatactttccattcttctcatggaatgtcaagttatacgttattctagatataacactatatgaagacataggttacacctctttcttacgaaatgatgaagcattaactattatcacnnnnnnnnnnnnnnnnnnnnnnnnnngatgagttatagatgcagattttattaccatttagattttaactataagttagaattatcgagctcatcgttcaaactgcgaaagtcgtgatgatcatgttttatcattcactatcgttaatgtattcatcactataagatacatgtataaaccgatgaaatttagacgtgaaaaccgatatcagcatcaccaaaatgtagatgtctatgtgcctaaaagcaagacctactcgtaactgg

SEQ ID NO: 17892 - DNA, 55 bp, Diabrotica virgifera
cgacctcactataagggaaaggtggaacgcccgcaggaccggcccgaaaccccgg

SEQ ID NO: 17893 - DNA, 706 bp, Diabrotica virgifera
  misc_feature (315)..(347): n is a, c, g, or t
  misc_feature (456)..(474): n is a, c, g, or t
  misc_feature (498)..(515): n is a, c, g, or t
  misc_feature (517)..(574): n is a, c, g, or t
  misc_feature (600)..(622): n is a, c, g, or t
  misc_feature (624)..(660): n is a, c, g, or t
  misc_feature (679)..(700): n is a, c, g, or t
gaaattctaaaaaggtggctcaaaaaaatctcaaaaattttctaattcggtaaaaatcaaatacatctctaaaataaatctctctttcgtaaatcggaaaacgttcaatctcggttctttcaaataataatcctaaatctctcctaagaaaataaaatctcaaaatttaatcctaataaacaaatcaatatcctcaatcaaatctcaaaataatcctttaatatctaatctaaataatctcaaaataatcttctcatggggaaggaggctctaaaaaaataaaaatcttctatctcaaaaaattctcaaatcttnnnnnnnnnnnnnnnnnnnnnnnnnnnnnnnnnctctttcataattttcaaaaataacggtcatctaacctaactcttaacatcaataataactttctaactccttaataaaattttcttcatctcaaaaataatcaaatcnnnnnnnnnnnnnnnnnnncagtaaggaggataataattcagnnnnnnnnnnnnnnnnnncnnnnnnnnnnnnnnnnnnnnnnnnnnnnnnnnnnnnnnnnnnnnnnnnnnnnnnnnnngttaataaaaacatggtcttcttggnnnnnnnnnnnnnnnnnnnnnnngnnnnnnnnnnnnnnnnnnnnnnnnnnnnnnnnnnnnngggtaaggtagcaaatcannnnnnnnnnnnnnnnnnnnnnggaatg

SEQ ID NO: 17894 - DNA, 729 bp, Diabrotica virgifera
  misc_feature (565)..(592): n is a, c, g, or t
aatcataagagttttccccgaaaagagttttcaccgttttttggttgtttcgcgttgaaattttcgatttggggtttgacgagggagaacctacttctcattagctcgcaactctcgcttcaactcgggtcaacggacttcatcgcatacaccatttaatttacttttttgtaagctatattttcgctaggaatatttttttcgataaaatacttactttttcagttatttgccaaaaaccgcccaaaagcattgtgtttttgtgttaaagatgaacatattcactcgcagaggactcgaaaagtgttgacttagtgaaggaactctggaacagaagttgcttggaattggtcattttgtccaattcctgacttattttaaatgtatatttgcacccccgataaggatgtatggaggggatgtggaattgtaaactttttcgtatataatagtggacagtttcaattatctgttcccaaatttttatccttcctttattttttttggaggttttcgtaaagttttgtgttccttgatcgggctattatagtagtttttaaatacnnnnnnnnnnnnnnnnnnnnnnnnnnnntacaatttatacaatttataaatacatttttttaaagctataattatattgtgaatcaaattgtgtacaaaatgaaaacacaatttttactataaattggtagcaaccaacgatgtaaagatgtaatcacactgaac

SEQ ID NO: 17895 - DNA, 143 bp, Diabrotica virgifera
  misc_feature (9)..(30): n is a, c, g, or t
  misc_feature (41)..(84): n is a, c, g, or t
  misc_feature (113)..(136): n is a, c, g, or t
tttttatcnnnnnnnnnnnnnnnnnnnnnnctctctctccnnnnnnnnnnnnnnnnnnnnnnnnnnnnnnnnnnnnnnnnnnnnccgtgagagaatcatctctctcatctttnnnnnnnnnnnnnnnnnnnnnnnngtacctc

SEQ ID NO: 17896 - DNA, 267 bp, Diabrotica virgifera
  misc_feature (2)..(31): n is a, c, g, or t
  misc_feature (60)..(89): n is a, c, g, or t
  misc_feature (91)..(110): n is a, c, g, or t
  misc_feature (112)..(157): n is a, c, g, or t
  misc_feature (176)..(197): n is a, c, g, or t
  misc_feature (208)..(220): n is a, c, g, or t
  misc_feature (222)..(247): n is a, c, g, or t
  misc_feature (249)..(265): n is a, c, g, or t
cnnnnnnnnnnnnnnnnnnnnnnnnnnnnnngcgcgtcattttgaccgtgctaaagtatnnnnnnnnnnnnnnnnnnnnnnnnnnnnnntnnnnnnnnnnnnnnnnnnnncnnnnnnnnnnnnnnnnnnnnnnnnnnnnnnnnnnnnnnnnnnnnnngaagcttagattcttattnnnnnnnnnnnnnnnnnnnnnntgtatataacnnnnnnnnnnnnnannnnnnnnnnnnnnnnnnnnnnnnnncnnnnnnnnnnnnnnnnncg

SEQ ID NO: 17897 - DNA, 954 bp, Diabrotica virgifera
  misc_feature (201)..(219): n is a, c, g, or t
  misc_feature (572)..(624): n is a, c, g, or t
  misc_feature (847)..(847): n is a, c, g, or t
  misc_feature (862)..(862): n is a, c, g, or t
  misc_feature (875)..(875): n is a, c, g, or t
  misc_feature (895)..(895): n is a, c, g, or t
  misc_feature (939)..(939): n is a, c, g, or t
caagtattctctcatgacttttgatgtaaaataattggggaagcgggaattcggcagtttacagttttacattgagtttcctatggccctttttacgattcaccacccggtataagataaaatgtgtactatttgtcttattatttcataataacacaaataatacacatatatacacaataacacacattcaatgatcgnnnnnnnnnnnnnnnnnnnggaatgtaaactcttgtgacgtaaagtcaaaaatataagtctccccaccaccgtcggacaagacaaccgtaataaagtctaataaccgtgtcacaatccagtaaaaaaaattgatagcaaaacggacatctatccataaaatagtttcctacttccctataacgtggtattctacgtgcaatatgagcaaattggactaaaaaaccaaataccgatatattatgcagctttaaaacaccattcaaaaccaaatgtgtgctgttaggtacaaaactgtcaaattctatgaatgacgtttgatagaaaaaggcgcatgcgcagtatatgcatattcggaatatgatatcgcttgnnnnnnnnnnnnnnnnnnnnnnnnnnnnnnnnnnnnnnnnnnnnnnnnnnnnntctttttatgaattatgtagatttttaaagattgtgcaaagttttcacagaataaatgtgcaaaattgatataaataaaatatgattgctcagagtagtgtcaatttacagtgcattggtactgtataattggtgtcaaaaatggggatagtaagtccctaatgtatttaaaaatggtatcacatattattattgtaaattaagatagtgcaaaggaaatggnaggtatgatcctaanggaagaaatatanaagactgctgacatttttgngaatcaaacacagtgcttttgtacccttttacctttacatacanttgctttgatattta

SEQ ID NO: 17898 - DNA, 637 bp, Diabrotica virgifera
  misc_feature (47)..(61): n is a, c, g, or t
  misc_feature (64)..(78): n is a, c, g, or t
  misc_feature (88)..(111): n is a, c, g, or t
  misc_feature (116)..(131): n is a, c, g, or t
  misc_feature (136)..(153): n is a, c, g, or t
  misc_feature (203)..(223): n is a, c, g, or t
  misc_feature (247)..(278): n is a, c, g, or t
  misc_feature (280)..(292): n is a, c, g, or t
  misc_feature (311)..(326): n is a, c, g, or t
  misc_feature (328)..(358): n is a, c, g, or t
  misc_feature (364)..(384): n is a, c, g, or t
  misc_feature (429)..(451): n is a, c, g, or t
  misc_feature (489)..(507): n is a, c, g, or t
cccgccagtcccgccgccgcccctcccgtccgccgcccactcatccnnnnnnnnnnnnnnnccnnnnnnnnnnnnnnntgaagaatcnnnnnnnnnnnnnnnnnnnnnnnngttgnnnnnnnnnnnnnnnnttcgnnnnnnnnnnnnnnnnnncttctgtaccttgagtatcaggacctattacttcataattatatctttcnnnnnnnnnnnnnnnnnnnnnctcgaaaattaaaattctcattgnnnnnnnnnnnnnnnnnnnnnnnnnnnnnnnngnnnnnnnnnnnnnctcttgaactagacccacnnnnnnnnnnnnnnnncnnnnnnnnnnnnnnnnnnnnnnnnnnnnnnntaaacnnnnnnnnnnnnnnnnnnnnncttatttttagcgatgagctcaaaaacaaaattttattactatcnnnnnnnnnnnnnnnnnnnnnnnccaacacctcccatactttaaaatatgtcatccattcnnnnnnnnnnnnnnnnnnncttattctttataaacttcttattaaaacatacatctaaactattcaaactcagaaatgacgataatcactagtaccaaaaaatcgtatatccagtaaaaacacacaggattagcaaaggaacccgacaa

SEQ ID NO: 17899 - DNA, 373 bp, Diabrotica virgifera
  misc_feature (2)..(372): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 17900 - DNA, 740 bp, Diabrotica virgifera
ctctacgcgtccggtgacataactcattcaaaatccataaaaaagtttcaaaatgagtttaggagttcgtaaaatattttcagtaggctcaaaattagtaagaccaagtgtccagattgttggtcaaagatgttgctctagcggctctaaagatggatatttctatgtaaacgacaaagaacccagtatggagtttggggctatcacagatcgtgctgcccaaacaatgttctttactgaattattcagaggatttggtgttactttggctcacattttcaaagaaccagcaactataaactatccctttgaaaagggacctctcagtcctagattcagaggtgagcatgccttgagaaggtacccctctggtgaagaacgttgcatcgcctgcaagttgtgtgaggccatctgtcctgcccaggcaatcacaattgaagcagaagaacgcgcagatggctctagaagaaccactaggtatgatattgacatgacaaaatgtatttactgtggtttttgccaagaggcttgtccagtcgatgctatagtagaaggtcccaactttgagttctctactgagactcatgaagaacttctctataataaagaaaagttattaaacaatggcgacaaatgggagtctgaaatagccagtaatattcatgctgaccatttatatcgttgaaaatatatagaaaattgtaaaaagttgtagaatatatcttattaactaggaaaaa

SEQ ID NO: 17901 - DNA, 731 bp, Diabrotica virgifera
  misc_feature (628)..(658): n is a, c, g, or t
cttctagcgtccggactgatatttagcttcgttttgccattccttgggtctgtcttgcaatgttggctgttcttctgggttatctcttctctttttgaagataaccgcttgggtcttatctggatttattgctattttccattggatactccattcttctattgtgtccaatgccgtctgtatatttcttacagctttatctaggttcatgtgttttgcaacgattgcagtgtcgtctgcataaaggctgattaatattccgggtgttcttggaacatctgctgtatatatgctatagagaaggggtgataaaaccgccccctgtggtactccagcttccggcattccgtgttctgatagaactggtcctatccggatcctgaacttccggtcggttaggtacgaggagatgagtttcgtcatggccccgctgtatgcataatctctcattttgtatgtcagtccttcatgccacactctatcaaaggctttgcttacatccagaaaggctgctcccgtacattgttggtatagctccattttcccggcccatttttatttcccgggaatcgtaagtcggtaatttggatttctcggaaattcccggtaatcggtagatttaaaaatnnnnnnnnnnnnnnnnnnnnnnnnnnnnnnnatgcaattagtatatgaacttataaatatgattccatatgaaaaaatttgtagaaaaattcaacaattaaaaa

SEQ ID NO: 17902 - DNA, 238 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(116): n is a, c, g, or t
  misc_feature (162)..(193): n is a, c, g, or t
  misc_feature (209)..(229): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgagtttaaaccggtgtgagccagtttggttnnnnnnnnnnnnnnnnnnnnnnnnnnnnnnnngaaaggaccaatatannnnnnnnnnnnnnnnnnnnngataatatt

SEQ ID NO: 17903 - DNA, 970 bp, Diabrotica virgifera
  misc_feature (25)..(44): n is a, c, g, or t
  misc_feature (55)..(92): n is a, c, g, or t
  misc_feature (120)..(137): n is a, c, g, or t
  misc_feature (153)..(166): n is a, c, g, or t
  misc_feature (168)..(184): n is a, c, g, or t
  misc_feature (195)..(234): n is a, c, g, or t
  misc_feature (238)..(268): n is a, c, g, or t
  misc_feature (281)..(333): n is a, c, g, or t
  misc_feature (404)..(425): n is a, c, g, or t
  misc_feature (429)..(453): n is a, c, g, or t
  misc_feature (560)..(585): n is a, c, g, or t
  misc_feature (600)..(625): n is a, c, g, or t
  misc_feature (627)..(687): n is a, c, g, or t
  misc_feature (702)..(881): n is a, c, g, or t
  misc_feature (886)..(898): n is a, c, g, or t
  misc_feature (901)..(928): n is a, c, g, or t
  misc_feature (937)..(958): n is a, c, g, or t
cctccccgccgcccgatttcactcnnnnnnnnnnnnnnnnnnnnccccgtccccnnnnnnnnnnnnnnnnnnnnnnnnnnnnnnnnnnnnnnccgtgagagaatatctttcatcttctcnnnnnnnnnnnnnnnnnncatttttcgtacctcnnnnnnnnnnnnnncnnnnnnnnnnnnnnnnntcatttattcnnnnnnnnnnnnnnnnnnnnnnnnnnnnnnnnnnnnnnnnatcnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnctcaacaatatcatcttatcaattaaatatttttatcatctaatctaatattaaatatcttttagggatcnnnnnnnnnnnnnnnnnnnnnnctcnnnnnnnnnnnnnnnnnnnnnnnnncaggattcaaaaattctctcatcatctttcaaaatatcggttatctcatcctcaccctcatcatcatccatctcaatcttctcatttttcatcaaatttttctctcnnnnnnnnnnnnnnnnnnnnnnnnnncaaatttagtaatcnnnnnnnnnnnnnnnnnnnnnnnnnncnnnnnnnnnnnnnnnnnnnnnnnnnnnnnnnnnnnnnnnnnnnnnnnnnnnnnnnnnnnnngttattaaaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcnnnnnnnnnnnnnctnnnnnnnnnnnnnnnnnnnnnnnnnnnncattattcnnnnnnnnnnnnnnnnnnnnnntcatttatatag

SEQ ID NO: 17904 - DNA, 939 bp, Diabrotica virgifera
  misc_feature (346)..(364): n is a, c, g, or t
  misc_feature (827)..(827): n is a, c, g, or t
  misc_feature (862)..(862): n is a, c, g, or t
  misc_feature (873)..(874): n is a, c, g, or t
  misc_feature (878)..(879): n is a, c, g, or t
aattttaatcgtggaatagtaagtcccttattaatgggtgcgaccttagatttagctatatcaaaagaaacgaaaggttggcctgaaggtgataaacatcgaaagtacaagacagcgcagtaacctttctcgctagcgtcaccaaaacagtgaacttctaagcgtgaaatatcgtcaattaataaacgacgaggtaaataatttactcaaatatcgtcaaggtattttttccacaaacggataatttcttttgatggagcataatcccaaccaatcttttgggtccatattctttgaataaggtgtttaattagaaacgtcattggagataaaaatccaagaggannnnnnnnnnnnnnnnnnntggacaaaagatgacgttttgtacaagaagagtctaaaacttgaactttaaaaccaaatgtatcatgtatccgaagaagcgtcccattccaaccctaatactttaagtgtttgggacgaaatatcatcattaaatgtaagaggttttatggctaaatctgatacagctaatcctttcaataaatcaggtacattactggaccattttttcaactcaaaacctcctttggcaagtaaagcaataagttcgtctcttagtgctaaggcattttcgaaactaggacaagaagaaaccatatcattaacgtaggtttcagttttaagtgcctcggctgctagaggaaacgagtccccgtcatcattagccaactgatgtagacatctaatagcaagataaggagagcaagagagacgataaacaattctgttgatacgaaaatctcgaacaggttcagaattattantacgccaaagtactctttgataaatctgttgagtnagattaattannattnngtcatacattttagaaatatcggccgtaattacataaacatgcaatcgaaaaatcatcaa

SEQ ID NO: 17905 - DNA, 968 bp, Diabrotica virgifera
  misc_feature (7)..(75): n is a, c, g, or t
  misc_feature (100)..(123): n is a, c, g, or t
  misc_feature (131)..(245): n is a, c, g, or t
  misc_feature (255)..(806): n is a, c, g, or t
  misc_feature (816)..(963): n is a, c, g, or t
atttatnnnnnnnnnnnnnnnnnnnnnnnnnnnnnnnnnnnnnnnnnnnnnnnnnnnnnnnnnnnnnnnnnnnnncgtgagagaatatctttatttctcnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttata

SEQ ID NO: 17906 - DNA, 669 bp, Diabrotica virgifera
acatcactcacgcaccgggttgtgatcatgtaacatcgtactggcctgccaatactccgaataagttaaaaaacgcgagatgcctagcaccccggctatggacccttctttggagtcatgcaactcgcgtttgttatcattttcagatcattgcaggccgcctatgatgactaaatgaatcagaaaccgcgattgccgctatgctcggtcatgacgccgcgaacttatgatgaaatagcttatctcactagacatggtcggattcattgtcgtctacggcctggtcatagctgtactcggtctctgaataacatccaagatagctctacatattcattgcacagtggttatgtccatttgaatgctggtctttgcctaatgagtttcataattgacgttagttgtcgctattgcactggcagctttcgatgctgtaaaactgaccggacagctgccataatgcttcgtacaaatgatcttgatactcgttttcggcatagtattacatctttatgtttccttcctcgacatatacctctatactataactgaccttcacagctcgcctatgatatcatctcctaaagacagcgaagctgaagtggcccatctcgccccgatcatgttggttgtaatgtctacatgtaataatacaagctgtagtcttcg

SEQ ID NO: 17907 - DNA, 828 bp, Diabrotica virgifera
  misc_feature (390)..(405): n is a, c, g, or t
ctttcccacgactgttctgctagaaaatagaggaactttattcttctggtcgatttcgactcgtaaatgggaacggtaacctcttgctccccgaatgaacgcgataccggcgagaccatttccctttgctttgacagcttacaaaatatctacgtacgttctgacgaattctctagaacaccgccgagaaaaatactttagaactatgagagattatacattagtattattatacttcaacttattcccgaatgcaagaccaatcacgagtatccaaaaaatataagaataagtatgtttaccaaatcctttactatattattttaatgattaatttgcgctgagacatagataatttgatgaatgatccacaaactacttactcgtatnnnnnnnnnnnnnnnngcaagtcactataaaatttcagccctcgtagcataaagtagagtgtaacttcaaagatattgcttttgttgtatattcacatactttttagacatcacaactataaatactgttgactctccagtgattaaaatgatttttttgtgataacctttttccctgtagtgaagcctggcctcattattaatatgactacattcaatagatactgctgctctgacatagagtgatgaatgcgtgcatgagggtaattgatttgactacagctatgagtgtattataattatattgaatatactcgactattgatctatagtattttttgtacgaataactatgggatgctattaaatacaaatggaccaattgcagtatgtgtcgaccgtactgaagactgcaagctgaccaacgcgtgcatgcttg

SEQ ID NO: 17908 - DNA, 174 bp, Diabrotica virgifera
  misc_feature (2)..(46): n is a, c, g, or t
  misc_feature (53)..(165): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgt

SEQ ID NO: 17909 - DNA, 305 bp, Diabrotica virgifera
  misc_feature (119)..(235): n is a, c, g, or t
  misc_feature (237)..(253): n is a, c, g, or t
  misc_feature (255)..(299): n is a, c, g, or t
caaacgtttctaacagtgtggcctttcttttctatttccatttttataagattttcgtccatcgagtaacgcacgtccttaagtgtcaatcgcacgcttcgtcttcgcatcgtaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnncnnnnnnnnnnnnnnnnnnnnnnnnnnnnnnnnnnnnnnnnnnnnntacctc

SEQ ID NO: 17910 - DNA, 820 bp, Diabrotica virgifera
  misc_feature (4)..(16): n is a, c, g, or t
  misc_feature (18)..(44): n is a, c, g, or t
  misc_feature (54)..(129): n is a, c, g, or t
  misc_feature (133)..(162): n is a, c, g, or t
  misc_feature (173)..(338): n is a, c, g, or t
  misc_feature (340)..(450): n is a, c, g, or t
  misc_feature (470)..(498): n is a, c, g, or t
  misc_feature (501)..(515): n is a, c, g, or t
  misc_feature (517)..(535): n is a, c, g, or t
  misc_feature (537)..(568): n is a, c, g, or t
  misc_feature (570)..(648): n is a, c, g, or t
  misc_feature (668)..(739): n is a, c, g, or t
  misc_feature (745)..(816): n is a, c, g, or t
cggnnnnnnnnnnnnncnnnnnnnnnnnnnnnnnnnnnnnnnnnggacctcggnnnnnnnnnnnnnnnnnnnnnnnnnnnnnnnnnnnnnnnnnnnnnnnnnnnnnnnnnnnnnnnnnnnnnnnnnnnnttcnnnnnnnnnnnnnnnnnnnnnnnnnnnnnngaaggaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtaatattaggattaannnnnnnnnnnnnnnnnnnnnnnnnnnnnagnnnnnnnnnnnnnnncnnnnnnnnnnnnnnnnnnngnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnttgaagctggatgaaggggnnnnnnnnnnnnnnnnnnnnnnnnnnnnnnnnnnnnnnnnnnnnnnnnnnnnnnnnnnnnnnnnnnnnnnnnacgagnnnnnnnnnnnnnnnnnnnnnnnnnnnnnnnnnnnnnnnnnnnnnnnnnnnnnnnnnnnnnnnnnnnnnnnngggg

SEQ ID NO: 17911 - DNA, 132 bp, Diabrotica virgifera
  misc_feature (7)..(44): n is a, c, g, or t
  misc_feature (61)..(61): n is a, c, g, or t
  misc_feature (64)..(77): n is a, c, g, or t
  misc_feature (79)..(96): n is a, c, g, or t
taacagnnnnnnnnnnnnnnnnnnnnnnnnnnnnnnnnnnnnnntgcgacctcgatggtgnatnnnnnnnnnnnnnngnnnnnnnnnnnnnnnnnnaaagtctgttcgacttttaaattttttcatgatctg

SEQ ID NO: 17912 - DNA, 818 bp, Diabrotica virgifera
  misc_feature (2)..(45): n is a, c, g, or t
  misc_feature (50)..(102): n is a, c, g, or t
  misc_feature (104)..(133): n is a, c, g, or t
  misc_feature (140)..(399): n is a, c, g, or t
  misc_feature (407)..(528): n is a, c, g, or t
  misc_feature (530)..(585): n is a, c, g, or t
  misc_feature (588)..(606): n is a, c, g, or t
  misc_feature (608)..(703): n is a, c, g, or t
  misc_feature (723)..(779): n is a, c, g, or t
cnnnnnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnncnnnnnnnnnnnnnnnnnnnnnnnnnnnnnntttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnntcnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaggcttggatgatnnnnnnnnnnnnnnnnnnnnnnnnnnnnnnnnnnnnnnnnnnnnnnnnnnnnnnnnntattgttttaaaagacgagaggaccctatagacgtgtat

SEQ ID NO: 17913 - DNA, 705 bp, Diabrotica virgifera
caaaggttctacgctgtggagtcatcaaagaagagtacgatcagctgtaaatttgggcactacatcaggatctattggaaaaagtatcagtattatgttcagaacagtgcaacaaaatggaatcttattctatgctacaagtaacaaatattacacctcaatagaaattacaaacggccaagttctatacatcagtaaattatcttccatggttaatatgacagatattcgtgtcattaatgatggtgcttggcataatcttacgctgtatactcacggaagaagtattagaataattttggatgatgaaaagtttggtgatgaacttgatacagccggtgttcacgacttcttagatccatacttaacatatctttctattggaggtgcttctccagaatattactacgcgcatgacacttctccacatttctttgagggttgcttggtaaatttcactgtaaataacgaaattcaaccttttaatggatcaggaaccatattctcggaagtatattataaaggaagagtaatgaaagaatgcaaaggttctattggtgttggtgcagcagcagctcctgatcctcttagtattggaataactctagttattgttttctttgtcgttttacttgttgccatattagtctcttttgtagctttccgactgagaaaacaatataaagaaaaaaggtagtgcttcaa

SEQ ID NO: 17914 - DNA, 942 bp, Diabrotica virgifera
  misc_feature (102)..(938): n is a, c, g, or t
acataaagaccttcttccctgaatattctaggacatgcttcacgaaggttgttgaatgatccagaagtggtatcgacaaatcacatgttactttgagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttt

SEQ ID NO: 17915 - DNA, 363 bp, Diabrotica virgifera
  misc_feature (23)..(45): n is a, c, g, or t
  misc_feature (61)..(88): n is a, c, g, or t
  misc_feature (128)..(145): n is a, c, g, or t
  misc_feature (159)..(186): n is a, c, g, or t
  misc_feature (205)..(243): n is a, c, g, or t
  misc_feature (248)..(280): n is a, c, g, or t
  misc_feature (329)..(349): n is a, c, g, or t
cctcccccgacccccgccccgcnnnnnnnnnnnnnnnnnnnnnnncaccctctccccctcnnnnnnnnnnnnnnnnnnnnnnnnnnnngatagttaattcgtattctgagagaataattttctctttnnnnnnnnnnnnnnnnnnctttccgtacctcnnnnnnnnnnnnnnnnnnnnnnnnnnnncatcatcatcttcttcatnnnnnnnnnnnnnnnnnnnnnnnnnnnnnnnnnnnnnnnttcgnnnnnnnnnnnnnnnnnnnnnnnnnnnnnnnnntaatggaaacggtatttcgtttttcaaaatctcattctaaattttttcnnnnnnnnnnnnnnnnnnnnncatttcttcaacaa

SEQ ID NO: 17916 - DNA, 513 bp, Diabrotica virgifera
  misc_feature (75)..(97): n is a, c, g, or t
  misc_feature (115)..(140): n is a, c, g, or t
  misc_feature (145)..(163): n is a, c, g, or t
  misc_feature (192)..(206): n is a, c, g, or t
  misc_feature (208)..(274): n is a, c, g, or t
  misc_feature (276)..(292): n is a, c, g, or t
  misc_feature (298)..(368): n is a, c, g, or t
  misc_feature (378)..(468): n is a, c, g, or t
atagtgagagtggatgtaataaatataaaagttgatatttaaaaattgatgttgtgtatgagtgattatgaaatnnnnnnnnnnnnnnnnnnnnnnnatgaatttaatagtttgnnnnnnnnnnnnnnnnnnnnnnnnnnttggnnnnnnnnnnnnnnnnnnnatgtttttggaatggtaatgttgtttgannnnnnnnnnnnnnngnnnnnnnnnnnnnnnnnnnnnnnnnnnnnnnnnnnnnnnnnnnnnnnnnnnnnnnnnnnnnnnnnnngnnnnnnnnnnnnnnnnnggaggnnnnnnnnnnnnnnnnnnnnnnnnnnnnnnnnnnnnnnnnnnnnnnnnnnnnnnnnnnnnnnnnnnnnnnnaaagaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagtaatattaatagaatgtatatttaaaaaaatgatataggt

SEQ ID NO: 17917 - DNA, 96 bp, Diabrotica virgifera
  misc_feature (2)..(37): n is a, c, g, or t
  misc_feature (43)..(43): n is a, c, g, or t
annnnnnnnnnnnnnnnnnnnnnnnnnnnnnnnnnnnagtgtnaaaaagtaaaaaatatcccacgaagatgaatccggctgccccaaatatcctat

SEQ ID NO: 17918 - DNA, 851 bp, Diabrotica virgifera
  misc_feature (774)..(774): n is a, c, g, or t
  misc_feature (805)..(805): n is a, c, g, or t
  misc_feature (817)..(817): n is a, c, g, or t
ccctgttagttaacacactacctatgaaagaaatatggaattgtatgaaattgaatgcttttattaaatcgttttctgtgatatttatttcggacctcaagatagaagggacagaaaggtgggaagtggctagtctcagctgtgataatattgtagtttgtgccactcagactgagaaaatgaaagtaaaattctcagtttctgctgttcagtttgacaatcagttgtattctcgagagtcttacgactttcccgttttattggtgggacaagatgtgaaagagtcaaacaaaatgcctactttaaacattcctatagaaaatttattgcaaaattccgatgaggaggctttgttagtagttgatttagcattagaaacgtggagggataaatatgtaatgagcaacactacaggagtgaagtcgttacaaattgttattaatccaatttcatgttttgtggaagatggatatttgactagattaatggactatttttacgttttcataccaacaaaattaattatgtggcccgataaaaaattacctttaaaactaaatgggacttctggatcggtaagtgtaccagagattgttagttggcagtgtgcgatactagcgaggcctttaacagtaagaaatttaaacatagctccaatatctctcctactgtctatacattcgtctataaaaatgtatatagcactagaccaatctccattgcagtttggaaaattcgaaagaaagagggttttcaccacaccctacagattgngccatgcgatgactatgcattatctttctgnagcgatatttgntgctggatgggtagttagttctttagaacttatt

SEQ ID NO: 17919 - DNA, 280 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (242)..(242): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattagnagacatgagctatgaaaaaagtctttccatgatatatg

SEQ ID NO: 17920 - DNA, 98 bp, Diabrotica virgifera
  misc_feature (2)..(45): n is a, c, g, or t
  misc_feature (48)..(91): n is a, c, g, or t
cnnnnnnnnnnnnnnnnnnnnnnnnnnnnnnnnnnnnnnnnnnnnccnnnnnnnnnnnnnnnnnnnnnnnnnnnnnnnnnnnnnnnnnnnngtacctc

SEQ ID NO: 17921 - DNA, 803 bp, Diabrotica virgifera
  misc_feature (2)..(44): n is a, c, g, or t
  misc_feature (52)..(623): n is a, c, g, or t
  misc_feature (625)..(670): n is a, c, g, or t
  misc_feature (673)..(754): n is a, c, g, or t
  misc_feature (771)..(771): n is a, c, g, or t
  misc_feature (775)..(793): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnncgagaaagaccctatangagnnnnnnnnnnnnnnnnnnnggtttttttt

SEQ ID NO: 17922 - DNA, 647 bp, Diabrotica virgifera
  misc_feature (298)..(314): n is a, c, g, or t
atccactagtttgctgcgatgatgatgatcgcttctgttgtctcctcttccacgtcctttcctgtgaaagccgacaggcctttggaaaggtccacaaatggaataccttgcaccatttgacatatagcatttttaatattagcaggaaaaaagagtcttccgttctttgtggtgccatagctaccgttacttaaaactcccatagacactaatttgctgctgagcgcgactaagagccaatcgcacatatgagcgactgctgctatggcagaacacataacgtaagattctttttttnnnnnnnnnnnnnnnnngcctctcgtttgaacggcgaaaaccaatacatttctgacttattcaccatactggagagcttctacggagagtacctatttgatgacaacaacaacgacagcatgataatcatcagatgactagctgcatgagcggtttccccaaatgattactttgcttacgttttctattggtacaccaactttgcctataatctgcgcttgtgatctgtgttgatccatgtgatatatgtgtgtgttttcttttgtatcggatcaagagtattttgaacatattagaccattgcagatggcagaattaccgacgagtaaaacgtgattaacttttttgta

SEQ ID NO: 17923 - DNA, 890 bp, Diabrotica virgifera
  misc_feature (541)..(558): n is a, c, g, or t
  misc_feature (683)..(683): n is a, c, g, or t
  misc_feature (799)..(799): n is a, c, g, or t
  misc_feature (804)..(804): n is a, c, g, or t
ctttgtccggtaaagttttaaataaatgtttgtgaaagtgtatctatcatctcatttctgtagcctttggaaaaattttaacagaaaactaatgcaactgtatgaaagttttagttcaggagaaaagaaagaatatggcatagaagccaataataaggaaagatgttgtcccaatgtaaccccaaagaggaatcaatgatgattgtccccccgattggtacccgtaagtaagaaagtatccagtaagtacccataggtgaaatagaggatttatttcaaacggcgtccctttttgttaaatagtagaaagatcctctagtcagagtaagtacccttatgtatttagttatggtagtgtagtcatcttaacaccccttcaccctccctaacgaatctacgacctagctcccgcacaacaaatgagctgccgtcccgcaacgaggctttatgtgtctgcttcttcttctttagccccattcttaccccccagtatctctatagatagtctttccttgttcccatatgagcagacatgtaaaannnnnnnnnnnnnnnnnnacgtgtggggctcaaaacgcttcaaatgtcgcccaacgtgtgaggccgattcatttttctgcctccttcagtatccagtagttgtcttgtccagttgaatgcttcaaatggccccggcaacgtgnggcctgtactttttttggcctccctcagaccccatttgcatgttcccactaccatatccctttagcctcctttcggtctcatttgtactacaactgttaggcagtgcccgtcttgngtagncgatctcagtttgtggtgcaggtgtttccgataacatggaagctcgactcgtgtcatgttttgtatgcccattgttacaagtctag

SEQ ID NO: 17924 - DNA, 489 bp, Diabrotica virgifera
  misc_feature (254)..(293): n is a, c, g, or t
  misc_feature (305)..(328): n is a, c, g, or t
  misc_feature (437)..(466): n is a, c, g, or t
ttcctcgcgtccgagaaaagaagaaacaatgaaagtagacagttttaattaacccacttcagcagagataaaagacgagtatgccgaaggtaatttcgagccacgaccaacatctgaatggagtgttcatgttaaagttccaacttcaagagaaaatcttcatcgaataattatgtgaaactgttcaaaacagctgaaagagtgaacgtatgtgccaaaaacaaaatctgactatggctctttgataagttgtnnnnnnnnnnnnnnnnnnnnnnnnnnnnnnnnnnnnnnnngaactttattannnnnnnnnnnnnnnnnnnnnnnntattctcatattattaatattaaacgttatatattatgctgtttgtaatatttattgaatgaaattttacttctacggaataacaagtatcaaaatctttggttactgnnnnnnnnnnnnnnnnnnnnnnnnnnnnnnaagtgttcgagatcttataatct

SEQ ID NO: 17925 - DNA, 342 bp, Diabrotica virgifera
  misc_feature (299)..(319): n is a, c, g, or t
cttccacaggtgtggagaatggattttcggttccttttattccgtggggtcctggaataagcatttttacgaatatatactctacatgacgaatatccagaaggatacgtggatcaagtatggatattggatggctgtaggtataattatctactttgcttatggattgtggcacagtacggaacgtgatagaagcaaggatgacgaacagtcaaaggccatcaaccgtagtgacagttgttcatcatagtcgaataccaaatataataagaaattcagtattttcttgtattagaacnnnnnnnnnnnnnnnnnnnnnactaaacatgtattgttttcatt

SEQ ID NO: 17926 - DNA, 236 bp, Diabrotica virgifera
  misc_feature (2)..(29): n is a, c, g, or t
  misc_feature (31)..(55): n is a, c, g, or t
  misc_feature (66)..(146): n is a, c, g, or t
  misc_feature (160)..(182): n is a, c, g, or t
  misc_feature (186)..(227): n is a, c, g, or t
cnnnnnnnnnnnnnnnnnnnnnnnnnnnncnnnnnnnnnnnnnnnnnnnnnnnnngtgagggttgnnnnnnnnnnnnnnnnnnnnnnnnnnnnnnnnnnnnnnnnnnnnnnnnnnnnnnnnnnnnnnnnnnnnnnnnnnnnnnnnncgaagaccctattnnnnnnnnnnnnnnnnnnnnnnngtgnnnnnnnnnnnnnnnnnnnnnnnnnnnnnnnnnnnnnnnnnngggggggat

SEQ ID NO: 17927 - DNA, 762 bp, Diabrotica virgifera
  misc_feature (37)..(54): n is a, c, g, or t
  misc_feature (115)..(141): n is a, c, g, or t
  misc_feature (148)..(179): n is a, c, g, or t
  misc_feature (181)..(260): n is a, c, g, or t
  misc_feature (273)..(752): n is a, c, g, or t
  misc_feature (760)..(760): n is a, c, g, or t
atttctctcttcaaataataaaatcatctctctctcnnnnnnnnnnnnnnnnnnctctctcatctctcaacatagttaattagtatccgtcgagagaatcatcttctcattttcnnnnnnnnnnnnnnnnnnnnnnnnnnntacctcnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnntaatgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagctngg

SEQ ID NO: 17928 - DNA, 547 bp, Diabrotica virgifera
  misc_feature (2)..(352): n is a, c, g, or t
  misc_feature (359)..(396): n is a, c, g, or t
  misc_feature (416)..(429): n is a, c, g, or t
  misc_feature (432)..(454): n is a, c, g, or t
  misc_feature (462)..(483): n is a, c, g, or t
  misc_feature (510)..(510): n is a, c, g, or t
  misc_feature (516)..(542): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagttaaaccggtgtgagccaggttggnttctannnnnnnnnnnnnnnnnnnnnnnnnnngaaag

SEQ ID NO: 17929 - DNA, 804 bp, Diabrotica virgifera
  misc_feature (130)..(159): n is a, c, g, or t
  misc_feature (237)..(255): n is a, c, g, or t
  misc_feature (328)..(343): n is a, c, g, or t
  misc_feature (345)..(357): n is a, c, g, or t
  misc_feature (360)..(376): n is a, c, g, or t
  misc_feature (463)..(484): n is a, c, g, or t
  misc_feature (486)..(525): n is a, c, g, or t
  misc_feature (527)..(581): n is a, c, g, or t
  misc_feature (610)..(636): n is a, c, g, or t
  misc_feature (638)..(762): n is a, c, g, or t
  misc_feature (764)..(779): n is a, c, g, or t
  misc_feature (786)..(786): n is a, c, g, or t
cttaacgatagttaattagtatccgtgagagaatatctcttctttctcacaaaagaaaaattcatctttccgtacctccgtgtatcagggattatctaattaataattcatcatcatctctcctccctcnnnnnnnnnnnnnnnnnnnnnnnnnnnnnnccaccgtaaaataaatatcttcaaataattctcctcgtaacgaaacgttactcgttttcaaatatcatctaatttccnnnnnnnnnnnnnnnnnnnctccctccaacaatatacttacaattaaatactcccacactactaatattaaataactcctcgggacgagctnnnnnnnnnnnnnnnncnnnnnnnnnnnnnctnnnnnnnnnnnnnnnnngattcaaaaatttttcactctttcaaaatcacgttatctctcctcactttctcacactctctactttcacttttcacaaatttttcnnnnnnnnnnnnnnnnnnnnnncnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnncaccgttattaaaaacacgtctttttggnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnagcttanatttttttaaagacgaga

SEQ ID NO: 17930 - DNA, 278 bp, Diabrotica virgifera
  misc_feature (13)..(30): n is a, c, g, or t
  misc_feature (43)..(62): n is a, c, g, or t
  misc_feature (122)..(145): n is a, c, g, or t
  misc_feature (153)..(184): n is a, c, g, or t
  misc_feature (207)..(266): n is a, c, g, or t
tttttatcttatnnnnnnnnnnnnnnnnnnatctctctctccnnnnnnnnnnnnnnnnnnnnttcatctctaacggatagttaattagtatccgtgagagaaatcatctctctcatctcttnnnnnnnnnnnnnnnnnnnnnnnngtacctcnnnnnnnnnnnnnnnnnnnnnnnnnnnnnnnntcatcttattattttcgtatttnnnnnnnnnnnnnnnnnnnnnnnnnnnnnnnnnnnnnnnnnnnnnnnnnnnnnnnnnnnntaatgaaatcgt

SEQ ID NO: 17931 - DNA, 836 bp, Diabrotica virgifera
  misc_feature (444)..(472): n is a, c, g, or t
  misc_feature (513)..(532): n is a, c, g, or t
  misc_feature (600)..(626): n is a, c, g, or t
  misc_feature (725)..(747): n is a, c, g, or t
  misc_feature (757)..(757): n is a, c, g, or t
  misc_feature (809)..(828): n is a, c, g, or t
cggacgcgtgggagaacccaagaaagaagttacatacgtgtatccaaccgcgttgagaatgacgactttgaggagaagaaggtcgtggatagtattgttactattagtactgatgatggtgtaactaaactagatatctgcaagactgtttgtaaataaaagggatatatttttaaggttatgcatttctgtattggaatgcaaatatacggcatcagttcgtaacatctacatttcgtaactatacatattcgtaacgctataattcgtaacgccaacatgtagttttttaacaaacttagcgttaggtactcaatgtataaagtgaatgtattttgcataaatattttcctacattaaaagtagtagtactttttttacgaccactgctttttcaatatatttcacacatattttgcatatatttttgtaaatatgacagcnnnnnnnnnnnnnnnnnnnnnnnnnnnnnctgaattatcactttaaaatagaaaaagtactgttagaggnnnnnnnnnnnnnnnnnnnngcgtaggcgtaaaatttcgcgccagtgtgttatgaatgcatttatttttttcgaatcctaagaagacnnnnnnnnnnnnnnnnnnnnnnnnnnnctgagggccgaaagtcttttaaaataaccaaaaagtttcttttgaatgagatatttgaaattaaaaattacgctagattttttcttttttcacccctgnnnnnnnnnnnnnnnnnnnnnnngaagttttcnaagactttcgggtctcggtaggtaataatgcaatctttcattctgcgtttannnnnnnnnnnnnnnnnnnntttaggct

SEQ ID NO: 17932 - DNA, 744 bp, Diabrotica virgifera
  misc_feature (124)..(147): n is a, c, g, or t
  misc_feature (149)..(361): n is a, c, g, or t
  misc_feature (363)..(392): n is a, c, g, or t
  misc_feature (394)..(525): n is a, c, g, or t
  misc_feature (533)..(556): n is a, c, g, or t
  misc_feature (558)..(615): n is a, c, g, or t
  misc_feature (623)..(673): n is a, c, g, or t
  misc_feature (681)..(728): n is a, c, g, or t
gcacacgtaatttaagtatttatttaagaattgtctgcaaataattaattataagatggctaaagccccagctgtaggtattgatttaggaaccacatactcctgtgaattagtgtaccttgannnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatattnnnnnnnnnnnnnnnnnnnnnnnncnnnnnnnnnnnnnnnnnnnnnnnnnnnnnnnnnnnnnnnnnnnnnnnnnnnnnnnnnngacatgannnnnnnnnnnnnnnnnnnnnnnnnnnnnnnnnnnnnnnnnnnnnnnnnnnacgcggannnnnnnnnnnnnnnnnnnnnnnnnnnnnnnnnnnnnnnnnnnnnnnnatggaatgaaggaatg

SEQ ID NO: 17933 - DNA, 210 bp, Diabrotica virgifera
  misc_feature (4)..(206): n is a, c, g, or t
gttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacct

SEQ ID NO: 17934 - DNA, 126 bp, Diabrotica virgifera
  misc_feature (10)..(50): n is a, c, g, or t
  misc_feature (76)..(119): n is a, c, g, or t
atttcttttnnnnnnnnnnnnnnnnnnnnnnnnnnnnnnnnnnnnnnnnnctctcaacatagttaattcgtatccnnnnnnnnnnnnnnnnnnnnnnnnnnnnnnnnnnnnnnnnnnnngtacctc

SEQ ID NO: 17935 - DNA, 331 bp, Diabrotica virgifera
  misc_feature (32)..(51): n is a, c, g, or t
  misc_feature (72)..(90): n is a, c, g, or t
  misc_feature (122)..(139): n is a, c, g, or t
  misc_feature (186)..(211): n is a, c, g, or t
  misc_feature (213)..(227): n is a, c, g, or t
taataaaatactttccccctacctcaaaaagnnnnnnnnnnnnnnnnnnnnctatatagaggtgtgagagcnnnnnnnnnnnnnnnnnnngataaatttattgtatgcaccttgggaatcannnnnnnnnnnnnnnnnnctatatacttatcatttcccattttacaagagctatacgatttgaannnnnnnnnnnnnnnnnnnnnnnnnncnnnnnnnnnnnnnnngaatggtcattccgttttaatcatacccatttttatataaaacaacttcaggtaattaattaagaaattctttataaataaatactctactataataaagacta

SEQ ID NO: 17936 - DNA, 763 bp, Diabrotica virgifera
  misc_feature (11)..(31): n is a, c, g, or t
  misc_feature (378)..(523): n is a, c, g, or t
  misc_feature (542)..(563): n is a, c, g, or t
  misc_feature (598)..(631): n is a, c, g, or t
gcgaagtgagnnnnnnnnnnnnnnnnnnnnngttgcctcttggaattcttgcagtgtcacttttactctttttcacgatgtgtgaagcgggaactttaggattctatacagctgctactgatgttccgttagatatatggttaaaacgccttacgagtaccactcctcaaaatgaagctgcagcagacacattatttcatccagattgcaaaactgatcgtgactgtaaaattttttgcagacaatatataacaaaaacatcgtcatatagcaaacaacactgtaatgaaggactgtgtgattgtttttagaactcttatgtaatagttatcacgaagtattgttaaagcattagagaatataatttttttcgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaacaacgagaatagannnnnnnnnnnnnnnnnnnnnnggggggcggcttttaaaaaatcccctttttctccnnnnnnnnnnnnnnnnnnnnnnnnnnnnnnnnnnggcccttaacattatttgcgcgggctgttttttaaaaagggagggggaaagaaacgggggatgaaacacaatttttgtggtgggaaccccccccttttccgcgggaggggaaaaagaaaaagggcccccccc

SEQ ID NO: 17937 - DNA, 902 bp, Diabrotica virgifera
  misc_feature (62)..(82): n is a, c, g, or t
  misc_feature (143)..(155): n is a, c, g, or t
  misc_feature (157)..(172): n is a, c, g, or t
  misc_feature (217)..(243): n is a, c, g, or t
  misc_feature (655)..(688): n is a, c, g, or t
aacagaacgtatattgttattgaaaagtctgtatgtgttcaaaaatttagtaattgtaatannnnnnnnnnnnnnnnnnnnngtagactccattattcaattttatttatctatataggtgtgattttatattatcaaagtcnnnnnnnnnnnnncnnnnnnnnnnnnnnnnccatacaatcacttacgatgaaatattggcttaaaactgcacaannnnnnnnnnnnnnnnnnnnnnnnnnncacctccataggccataaaaattctattaatattctgtagaaaaaagtgtggtaaaaataaattacaacaatatattatggaatgaaacaaatccagtgcaatggcatgtaaagtaaaatgtactggaaaattcctaactttttaaacagttcagttgtttttaatggacttttacacaaattgagcattgatacatgagcattgactttagtctttatatcacaaattgtacatatccatttatcatttccctacgtttaatagacttgtttccatttataaattggatttgttataaaatttgtgtctgttaaatttattccaaacagattacggagacgtcccataaataatcgtatccattttgttagaacaataaatatgcattaaaatcatttattttacacgctnnnnnnnnnnnnnnnnnnnnnnnnnnnnnnnnnncatgcaactaaaagaagacctttgctttaccaagcgaaaaaaaattgcactataaagtgcaaaataattaacaaaattaaactgtttaaattttaattagacagggtacccagaaactctgccgacaagcgaagacgggagattcctcagataattttaagacatttttaccccaattcatctagtccgaaaatgcttcctaaaggagctagag

SEQ ID NO: 17938 - DNA, 50 bp, Diabrotica virgifera
  misc_feature (3)..(24): n is a, c, g, or t
gtnnnnnnnnnnnnnnnnnnnnnngacgagaaacccctatagagttttat

SEQ ID NO: 17939 - DNA, 964 bp, Diabrotica virgifera
  misc_feature (725)..(739): n is a, c, g, or t
  misc_feature (783)..(783): n is a, c, g, or t
  misc_feature (841)..(841): n is a, c, g, or t
atcaaaaagtattttctaaagttttcggaaggattacatcttttttatcagtatggaagacccgaaggataaccgtatcctctacaaattggtacttactggaggtccatgtggaggcaaaacaacaggccaggcaagactgtgtaccttcttcgaaaatctaggatggaaggttttccgagtacctgaaacagcttcagtccttctgggcggaggcatcaagtttgcagacctagatgaaagagagagtgtgaaattccaggaaaatttattgaaaagtatgctgcaaattgaagataccttttttgaacttggaaaaacctgcaaacgaaactgtcttataatttgtgataggggggctatggatgcttcagcatttgttgccaaagaaacatgggagactatcatgagaggtaacgcctggaataatgtagaattaagggataacagatataaccaaataatacacatggtaacagcagcgaagggtgcggaagaattttattccacagaggatcacaactgtcgctcagaaggcgtggaactagccagagaacttgataccaaagcagccgctgcctgggttggccacccgtacttcgacgtcatcgacaactccacggacttcgagggaaaaatcagaaggatgatcgtatcagtgtgccataaaatcggcttggataccggtgacagattactgaaaaactcaagaaaacacaagtttnnnnnnnnnnnnnnnttaccggacgacctgctctttcctccatttcaggacttcgaagntgtgcataactatctacaatctaattcgcctaatcaagttagattaaggaagagaggnccagaaggtcactacagttacattcacactgtgcgcagacaaaatcatcctggggggacaagttatcgaaggtaaaaacgcagatagctcatcgtgactacatcaatttaattgacacaaaag

SEQ ID NO: 17940 - DNA, 894 bp, Diabrotica virgifera
  misc_feature (265)..(286): n is a, c, g, or t
  misc_feature (294)..(317): n is a, c, g, or t
cgcttaccaaacttgaaataccaaatatttgataaaaatatgttatggggtgctggtagatccccacgtggcaggtgccgggttaattgttcttctttccaattaagctatcctttcttgttccttctcttaatttcctttttttttgtccaatttgtaaaattttatttgatccattaattagagaaatacactgaaataactcagccgtgcacttcgctagtttacagtgctccaatgtttgtgagaagggtgactttagcgnnnnnnnnnnnnnnnnnnnnnngctacagnnnnnnnnnnnnnnnnnnnnnnnncttatatttaatcttatatttatttataaggtttttttcaatagtctgaatttttcaatagtcaagtcagtttttttctaaaatttatattttcggggttatttaaagaaacatctaatttcgcagttcatttgtttaataaaaaattaagtgcccacttctagagtagacctttttaatatgttgtttattaaacatttcttagggccatcggtacataattcgcaaatattttaaggctatccctactttttctgtctttacacgacaaattacgtgtagtaaaattgtcactggtatggatatgtaaactttacttgacaatttcatcattaactgtaaagatggcttttgaatgttcttggataacttttactagtataattaattgccttaattgttaattcagttaattaatatgaatatttcatatttccgaccaatagaaagctacagaaataccaattaaattgatcatttttgataatatcccatcatcaagtatattacatcagatgcccttcgttgctgtgaaaaatacattcagggacattaatgacaatcactgttttaaaac

SEQ ID NO: 17941 - DNA, 614 bp, Diabrotica virgifera
  misc_feature (135)..(156): n is a, c, g, or t
  misc_feature (545)..(568): n is a, c, g, or t
  misc_feature (571)..(587): n is a, c, g, or t
atattcctatttttctcccagaatcgtcgatttctcgaaccttgtgtgtcagggataattagctaatattaatatattccttattcttcgactccaagcgagctcgccaattagacttgttatggtttcacacgnnnnnnnnnnnnnnnnnnnnnngcgagatgttattcggttttagatatatctaagtttctaagaaatacattaaatttattcatcaacaacatatttatagctaaatgttttgtatactataaatatcaaccatcttgagagacgagcttccaactacaattatattaatattctaatctttcttcaaaaatcaccattaccaactttcatattttaacatactgtacttatttattttcctatattcttatgcattcttctttatagactttttatctagaatataaatataacttatcccaaatttatgtatcgatgcccagaatagtattaccaactccgacatttactgacaatatatatccctagtatgggaactcggctgcatttttctcgcctgtttattaagnnnnnnnnnnnnnnnnnnnnnnnncgnnnnnnnnnnnnnnnnncattgattcgaatggccgcgttgtttt

SEQ ID NO: 17942 - DNA, 888 bp, Diabrotica virgifera
  misc_feature (15)..(38): n is a, c, g, or t
  misc_feature (839)..(839): n is a, c, g, or t
gtccgagaagaaaannnnnnnnnnnnnnnnnnnnnnnngtcaagtcattaagataaaatttcgttaatcgattgtctataaatctcggcattcattcgttgaccactttcttatttaaacattcgtacaatcgtctagagaaatcgcagttattccgattatcggaaagggaggttagcacaagttcgtcttattcacgttgccgcaacttcaaacgccgctcgcagctcgaagcaaaacgagccgagaagccagctagaccaaaaacgttcgccatttatcgttggaatccagacaaacctcgacactcaaaccttatatcgcaagagtacacagttgatttgaattcttcgtggacctatcggttctagatgctctcattaaaattaaaaacgaggtagaccctactttaacctttagaagatcttcgtcgtgaaggcatttgtggatcttcgtgctatcgaatatcggtggtgtaaataccttagcctgtatcagcaaaattgagacatccagtaagtccacaaagatttatccactcgcctcatatgtatcgtagtaaaagacttggtgcctgatatgaataacttctatcgacaatataaatcaattgaaccatggttgcaaagaagcgatgacagccaaaagaaaaacactgaatatttgcagagtgtagaagatagacagaagttggatggtttatatgaatgcattttatgtgcatgttgttctacttcttgtccaagttattggtggaatggtgataaatatttaggccctgcttgttaatgcaggcttaccgtttggatattgattccagagatgaagcaaacaataanagatttggataaaatgagggatccatcttcagcttatcgttgtcatact

SEQ ID NO: 17943 - DNA, 229 bp, Diabrotica virgifera
  misc_feature (5)..(50): n is a, c, g, or t
  misc_feature (54)..(127): n is a, c, g, or t
catgnnnnnnnnnnnnnnnnnnnnnnnnnnnnnnnnnnnnnnnnnnnnnngacnnnnnnnnnnnnnnnnnnnnnnnnnnnnnnnnnnnnnnnnnnnnnnnnnnnnnnnnnnnnnnnnnnnnnnnnnnaccttatggataacagcgtaattttattgcagagttcatatcgataataaagattgcgacctcgatgttggattattgtttataattgatgtagcagctata

SEQ ID NO: 17944 - DNA, 637 bp, Diabrotica virgifera
  misc_feature (384)..(401): n is a, c, g, or t
  misc_feature (470)..(487): n is a, c, g, or t
cgtacgcgtgagaattggacatatttcgccgttaaatgattttcaaatttttcttcacaagatgcgccccctagagctcaacccagaaacttgaaggatgtttccagagatttgtattgaacacttttactaattaattttttctcctgaaggtgagtaatgaatgccttctgatgtacgagcgaaagatcagtttgatgcacacccgctacagactggtgctcacagattcacctaaatgagagtgttgaaaacaattaatctaatacatattctcctcgaatggtcacataactcagaaaatataaacaaattttatgataatcttaatatattaaaaactccacttcccgtctacctgaacaattagatattttctgaacnnnnnnnnnnnnnnnnnncaatttacgaacatatcaaaaattgtaaatatagattgtaaaaagaaaatttaccctgtatttaagacnnnnnnnnnnnnnnnnnnaggtatgcttggtaaaacacaacaaatatgatcgttctgtggatatgttgaaatacatctggtatatgtaaaatattataggatattaatatggaaacaattaaagatgagagaagaaaagtttttaactatacatgaacatacttctta

SEQ ID NO: 17945 - DNA, 471 bp, Diabrotica virgifera
  misc_feature (4)..(30): n is a, c, g, or t
  misc_feature (60)..(91): n is a, c, g, or t
  misc_feature (98)..(220): n is a, c, g, or t
ttannnnnnnnnnnnnnnnnnnnnnnnnnnagtttaaaccggtgagagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcaaaatgatcgaggattattaccggatgaaacatcaggcaaatgctattaaaaggtgctacaaaaatagatttccttacgatgagaatataccacatctgatgggggaaatccctgaggtttgaccctgtttattaccatgtaaataaaaccccataactcccgtgagagtataaggaaaaatgaccacccggatgtatctaccaatatattctgataacctgtatgtctagtagggactatccccat

SEQ ID NO: 17946 - DNA, 209 bp, Diabrotica virgifera
  misc_feature (7)..(44): n is a, c, g, or t
  misc_feature (64)..(77): n is a, c, g, or t
  misc_feature (80)..(93): n is a, c, g, or t
  misc_feature (110)..(131): n is a, c, g, or t
  misc_feature (161)..(176): n is a, c, g, or t
  misc_feature (178)..(191): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnaattaagtctgttcgannnnnnnnnnnnnnnnnnnnnnagtttaaaccggtgtgagccaggttggttnnnnnnnnnnnnnnnnannnnnnnnnnnnnngaaaggaccaatatataa

SEQ ID NO: 17947 - DNA, 344 bp, Diabrotica virgifera
  misc_feature (34)..(57): n is a, c, g, or t
  misc_feature (80)..(110): n is a, c, g, or t
  misc_feature (126)..(157): n is a, c, g, or t
  misc_feature (176)..(254): n is a, c, g, or t
  misc_feature (275)..(304): n is a, c, g, or t
aatgacatgttattcgatatctaatatttctagnnnnnnnnnnnnnnnnnnnnnnnncattatatatataatataaaacnnnnnnnnnnnnnnnnnnnnnnnnnnnnnnnattgagcttcacaatnnnnnnnnnnnnnnnnnnnnnnnnnnnnnnnnaactagtatgaaattttcnnnnnnnnnnnnnnnnnnnnnnnnnnnnnnnnnnnnnnnnnnnnnnnnnnnnnnnnnnnnnnnnnnnnnnnnnnnnnnnctaaattacttatttgtagcnnnnnnnnnnnnnnnnnnnnnnnnnnnnnnactatctagttacaatatataggtataataaatgaattcg

SEQ ID NO: 17948 - DNA, 942 bp, Diabrotica virgifera
  misc_feature (862)..(862): n is a, c, g, or t
  misc_feature (879)..(879): n is a, c, g, or t
ctttgcgacattttttgttttttgactttttacaagtctcgacatgtctagaatcagacaataatgactttgtttatcatttgttataagcaaaaggttcacgtgagtgggatggcgattacttgtaaaatgcaatggtccaactatttcatattgccttttattatttacgaaattggattccagcccataaacatttactgaaatattattgaggttctcaaactttttaatgtcttttagtttcatcggaaagtcaattccttcaaaattcaacaaagtatcatatggtggatatgattctggtttggttgggttgccactagcaggaaaaatagctgcaataatactccatgcaaaacacttattatctttgttttcgatatttaaaatagcgtgttttcgtactataggtattgggagacgaatatatgttgatgcggaaatactactaaatttgtttatgttaacatctaaaaacattatttcctgcaatacccaatttgaatctttctcttgaaattctgatgcttgcgtcatcagttcttccttaaaatcatcgaatacttcatccagttcagtgctgatagttatagttttattacatgtgttcatggacttgatatctgataggttagtgtcaggttttagataaataccaaatatttcaaaatttacctttatgctattgtgctgatgtaaatattcactcaaaatgttcaaaactttgggtttgacatcgtttaaaaatccatgataatccagttttttatcactactaaaacgataagatggcgattctgtttttaaacgcgtgtgacaatttcgaaacagttccatcaatcacttccactccaagtgntcttaatctttttttgngaatataataatccccattcttatcactatccacatttcccgtatttgcatttttttttaaat

SEQ ID NO: 17949 - DNA, 788 bp, Diabrotica virgifera
  misc_feature (2)..(56): n is a, c, g, or t
  misc_feature (58)..(262): n is a, c, g, or t
  misc_feature (280)..(405): n is a, c, g, or t
  misc_feature (407)..(432): n is a, c, g, or t
  misc_feature (471)..(500): n is a, c, g, or t
  misc_feature (508)..(557): n is a, c, g, or t
  misc_feature (566)..(649): n is a, c, g, or t
  misc_feature (678)..(695): n is a, c, g, or t
  misc_feature (717)..(780): n is a, c, g, or t
annnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaggaggggtgttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnntgagaggggtgataaaaaaagagaaaggagggttgttgnnnnnnnnnnnnnnnnnnnnnnnnnnnnnnggggtgtnnnnnnnnnnnnnnnnnnnnnnnnnnnnnnnnnnnnnnnnnnnnnnnnnntctctttcnnnnnnnnnnnnnnnnnnnnnnnnnnnnnnnnnnnnnnnnnnnnnnnnnnnnnnnnnnnnnnnnnnnnnnnnnnnnnnnnnnnnaacaaaataataaaaggggcggcgggggnnnnnnnnnnnnnnnnnnccccccggcgcgggggggggannnnnnnnnnnnnnnnnnnnnnnnnnnnnnnnnnnnnnnnnnnnnnnnnnnnnnnnnnnnnnnngtgaggga

SEQ ID NO: 17950 - DNA, 881 bp, Diabrotica virgifera
  misc_feature (115)..(178): n is a, c, g, or t
  misc_feature (180)..(237): n is a, c, g, or t
  misc_feature (240)..(285): n is a, c, g, or t
  misc_feature (287)..(365): n is a, c, g, or t
  misc_feature (367)..(416): n is a, c, g, or t
  misc_feature (418)..(435): n is a, c, g, or t
  misc_feature (439)..(542): n is a, c, g, or t
  misc_feature (544)..(558): n is a, c, g, or t
  misc_feature (591)..(610): n is a, c, g, or t
  misc_feature (612)..(625): n is a, c, g, or t
  misc_feature (627)..(639): n is a, c, g, or t
  misc_feature (649)..(694): n is a, c, g, or t
  misc_feature (696)..(710): n is a, c, g, or t
  misc_feature (712)..(727): n is a, c, g, or t
  misc_feature (850)..(872): n is a, c, g, or t
cggacgtgagaagactaaaagattttttagtataggtaaaggaagattttattgagtgtatagataatgagtagtgtgagagaatgttgtatttttataaaaaaatgatttatgnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnntgnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnngnnnnnnnnnnnnnnnnnncggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnctaataatatataggagtaataagggaattcgnnnnnnnnnnnnnnnnnnnngnnnnnnnnnnnnnngnnnnnnnnnnnnnagataaagannnnnnnnnnnnnnnnnnnnnnnnnnnnnnnnnnnnnnnnnnnnnncnnnnnnnnnnnnnnngnnnnnnnnnnnnnnnngcaagctgcagtgtaggggtggaatgaaaaaaaaactgccttttatttcaattaatacaaaattcttattttcaagtgatacatgtttaaatttttttacgagaacgcgaccaccctatagcnnnnnnnnnnnnnnnnnnnnnnngcatttttt

SEQ ID NO: 17951 - DNA, 736 bp, Diabrotica virgifera
aatgcgcgtatctgttaacagaatgattacgagtacatctaccatattcttttgagaaaaagctttaatagaataatacgaaaatagtctctcgctgatcccgttgactttatgaaggatttcctcgatggaggaatttccgccgctatttcaaaaacatgagcacctccaatcaagcgtgcatagctgattttgaaagtaccatacatttccaagcaaatcgctgaggatccgtgataccaggtaatgcaatattggttgccacagtatctctcataggaagaggctgtgctggcatagtggtgcggtatgacctgtaacagttgtccgttatttcccaaccctggtgcttaactcgccttcaaagacgaatactagcagatcttcttgagatgccttatacccaaaaaaacaattctgcatgttacttcataggaaagttgaactctgatgatgacaccgaagatacatcgctctgatttgtgtactcacttgatctcgatataaccatgatgcacgacgacgagctacaaggaggctggaaccattgatgctactgcagtgattacgtattattaaagaatccactgctgtgtggatcggctatgattaaaacgtgaaggggcaagatgaaaagaaacgtcctaattttcgatctgaccgttgacatttttgactgtgcctaactcgtcaaacagatgaatttgagatttttttaaaacaatccatttgctga

SEQ ID NO: 17952 - DNA, 824 bp, Diabrotica virgifera
agcgtccgcaagactactatcacactcgagtggggtaacatctcagttgttagtttgagcgttgtccgattgttatcttgtagtagcttctattgtattaatagccggaggtgctcagatgagattgattgattacttggtagacgtgtttctcccctaaagtcactcttacatgagcgtgcataatagtataagtgaagaccaaagatgaactttctcttctccatcagccaacgtatctcatgtacagtgaagattatggatctgaaagatgaagccgcacgagtacgtaaacagacatatcatccatacacctactaaatgataacaaatgtcgctatatcgagctgaagccttcctttagtgaagcagcgtgaccgactatctacgatctctcgtatctataggaactcacgctagccatgtaaggaaactctagtgccgacatcctgaccttgagagtctgctctgcatatgaaccatgtacacccgcaagaattatcgcacagctggcattgtctgacttagatgaccacacttatgaagcataacagagaccatcacagagatatagttccacgtgaatgctagaattccctacaaggcagcaaagcaaacacagggctcgtccggagatgcggaagatgatacccaacgcctcccacgaatacgactgtgataacgtgtctgtcgaagatgtcgccttccatcatatgcccggcagcaatggactacctctagtcactgagctgtaatctgtcatatggaccgacagactaacagttcttaaaatcatctgcgtcgtggctgctaaccacaactgt

SEQ ID NO: 17953 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (163)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaacccggtgtgagccaggttggttnnnnnnnnnnnnnnnnnnnnnnnnnnnnnnnngaaagg

SEQ ID NO: 17954 - DNA, 949 bp, Diabrotica virgifera
  misc_feature (593)..(622): n is a, c, g, or t
  misc_feature (772)..(772): n is a, c, g, or t
gcccaaaacgtcggcgtctagtcccacgtctggttcttcggcatcacgcacacctcagggccccattacgaaggtcagagaacgttcccagcgatcagtgcccatgggcagcctaccaagaacatcgaaatcgtctctctcagctggaaccccagactctctctctcacaacgaaagttctacattccgtactcccaggaagccgtcctacaggtcaacgttaactccaggcggttcaagaagtaattctaggccccaatccaggactggaagcaggccgggcagcaagccgccgtctaggcacggatcgaacctttctttggatagcacagatgatgctactccatcgagaataccaagaaggacaccaacatcaggaagaagctcagctctttcgacgactaaaagcatcaacggttctggctctaggccacgcacaccaagcggtttgatatctccagctagtcccgttggaagacgaaaaagccctgagtcaacttattctttccggctgaaaagtcgtagtccacggaaagattcaaactagacccggacaccttcaggatccaacacacccgtacatccggatcaannnnnnnnnnnnnnnnnnnnnnnnnnnnnntccacgggtggcacagacactcccacaagccaaactagaaagaaaaagtcttctctttccgatcgggagccttttaggttataatttagtctcttaactattccaaaaaaaaaactcacactgactgacatgttatgttaagaaacttanaatgttcatatttttgtataaatgtaaaatatttactgggatttttgttcggcaaatggaattggttggtttgtcgaacaaaagacatggttggattttttggtatatacaattaacagcactctatactaaactacttagtatattaggccaaaaaaacacagaagttatttattg

SEQ ID NO: 17955 - DNA, 282 bp, Diabrotica virgifera
  misc_feature (2)..(281): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17956 - DNA, 83 bp, Diabrotica virgifera
  misc_feature (2)..(81): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 17957 - DNA, 272 bp, Diabrotica virgifera
  misc_feature (215)..(234): n is a, c, g, or t
cattacgcgtccggtagcatcaaaatgttatccaaattgttaatatttgaatttgctgctgaattagatgaaagtagaatcaaaacaacagacgaatctcattacacgattattcttttttccgagcatgtgaggaaaacgtttacccaaagtagaatattagataagtaacatctcaacaatcgaacacgaaaaccacacaacaaccataaatnnnnnnnnnnnnnnnnnnnntgccatatcgaaaaacgagtacgcaaccagaaataccc

SEQ ID NO: 17958 - DNA, 703 bp, Diabrotica virgifera
  misc_feature (155)..(200): n is a, c, g, or t
  misc_feature (209)..(229): n is a, c, g, or t
  misc_feature (242)..(272): n is a, c, g, or t
  misc_feature (280)..(299): n is a, c, g, or t
  misc_feature (306)..(341): n is a, c, g, or t
  misc_feature (444)..(462): n is a, c, g, or t
  misc_feature (593)..(610): n is a, c, g, or t
gccgctgaattcttggcttaccagtgccccttacacgtgttagtcattttaactgacatgtcttcatacggtgaagctttgcgtgaggtatctgccgacagatttattttttgcgccctgcgtgtcctggacgaataattgaaaaccatgtatgnnnnnnnnnnnnnnnnnnnnnnnnnnnnnnnnnnnnnnnnnnnnnngtaaaatcnnnnnnnnnnnnnnnnnnnnnggaatgaaatgannnnnnnnnnnnnnnnnnnnnnnnnnnnnnncgaaatgnnnnnnnnnnnnnnnnnnnntatatgnnnnnnnnnnnnnnnnnnnnnnnnnnnnnnnnnnnncatatttagggatgatctaagaaatcaaatcttatgaaaatgtaatttttacataataaatcggataaaaaatccttcatattttacaagatggtgttactgnnnnnnnnnnnnnnnnnnnttctattttctataaattttgtattaagatataaaattacatgagttaaaattacagactgatgataatattactattataaaattcgagtatataacaaaaagatatagatgtaatagaggcaatcggtnnnnnnnnnnnnnnnnnncaattaaagacatgtctttatgtattaaatataaagccacgcctgctcactgaataatttaaacgtacgaagaattctgaccgggctaaggta

SEQ ID NO: 17959 - DNA, 226 bp, Diabrotica virgifera
  misc_feature (4)..(26): n is a, c, g, or t
agannnnnnnnnnnnnnnnnnnnnnnctgaaagctggctgtttagaaaaacatatctttttgcattaaatatattgtctctcctgaccactgtttaatttgatatgcggtgtcattgtggccgtgctgaaagagcataagcactatgtatgttattgatacctgtattgttcccctggacgaaaaaaagctgctttatataattgaaaacaagttatttttaccta

SEQ ID NO: 17960 - DNA, 692 bp, Diabrotica virgifera
  misc_feature (126)..(144): n is a, c, g, or t
  misc_feature (411)..(430): n is a, c, g, or t
  misc_feature (445)..(464): n is a, c, g, or t
gggcccttaaagccccggttatatattaaatttcaatgagagataccctttcaaacggactcttgagaatctttatattattaattggtaattaaagatgtgatgattatcttttttatgtaaacnnnnnnnnnnnnnnnnnnngtagcttgtggatattggaaaataaatttgtaataagaaatgtattatgttctaaattaaaaaacatattacatgaattaaattattgtaagaataagaaatttataatacatcttaaggagcggcatgtaattcttctttaaatattgcaaacatctaaccaaaaacattatcttaattaactaacactatattagactacgtatatattaaaatcttatccaatattatgaaatatcaggaatgagctttcctatataagttgannnnnnnnnnnnnnnnnnnngaaagaatagtaacnnnnnnnnnnnnnnnnnnnnctaggcaaatatataactatcctaaaataaacataccgcttgaatatatgagctattacaaaataatctcctctaatttttgtacataggtgtaaagaacacggcaatttatggtaatgaatatgtgagcgcgtgcacattgataaaatggaaggatcgagacactattactatccttaggaggggaataaatagacttttttactcaagatgtacggctggacctgg

SEQ ID NO: 17961 - DNA, 71 bp, Diabrotica virgifera
caaaaaacaactatttttgataaataatggccataacatgtgatacgtgaaatgatctctaactgagtacc

SEQ ID NO: 17962 - DNA, 517 bp, Diabrotica virgifera
cggacgcgtgggcaagggatcagaattgccatatttttcctagcggatgcgcagtgactttctgggctaattagaaatatgtcgaagaatagaggcagcagaatcttggaaattgagatgagggagatttgagacgagaggtaaactacgaacaccggaccttttatttctcgtaatggcggtgctttagacaaaatcagagagccgaacttcaaaaaactatgcacgcgatacctgtatgaagccgcaccctgaaacacttgaaagaatcatcgggacattatcaagtgagacggcgagttattaccatacgcttatagctttcatgctatgttggtaacagcatctagtgtatcgtcgtgtggtggttggccatgtgatcggaggtatccttaacctacatgacttgggatgcccttgatactgtgctcaccgtgtactcccatgtccacagtttgctgtcccatgacaacatgaaatgtctgctgtcgaggcaatcagggtgacatgtcctctc

SEQ ID NO: 17963 - DNA, 129 bp, Diabrotica virgifera
  misc_feature (2)..(128): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17964 - DNA, 910 bp, Diabrotica virgifera
  misc_feature (258)..(278): n is a, c, g, or t
  misc_feature (640)..(663): n is a, c, g, or t
  misc_feature (815)..(841): n is a, c, g, or t
  misc_feature (851)..(851): n is a, c, g, or t
  misc_feature (871)..(889): n is a, c, g, or t
gtagtttgattatttatggttgttgcgttttgaaatttgtgtgaaaagaaacaaagttagttaatagttatactgcctttttaaatagttttcatatacctatatttttggactattttggacaaggaaaactcattctaatttggtaagtagtttttattataatcatattgtaattaaacatttggattaggttggaatacatacatttattttctcaagaatggggattttagagagaaatcccaaattaggtcnnnnnnnnnnnnnnnnnnnnngatattttggcgtagatttatttatctagtaggtatgtaatgctttgatttacatacttaatttgattaccaacaaaagttctaccaattttcatctaatatattgttttcttactgttttgttatttaatattttcttccacaagatttaaactacctacataatttaattacatatatatttaaaacaactgtcaaacagtaaaacgttcagttatgggctattccacgaatatacgcctgtcttggattgtcgcgacaacgaatattgtagtgtgcaacagaagaagtgtgaaaataaatggctctaataattgttccaataaacaacaatatattttgcaatttactttcgttcttcnnnnnnnnnnnnnnnnnnnnnnnnttgtcgtgatggtccaggacaggcgtatgttcgtggaacagggtataccctatttttccacatgagaaataatgtgggattggacgagtgagtctaggcttcgattacgaatcaaagcgtcctgaagttcacgggttcgattcccgatgcannnnnnnnnnnnnnnnnnnnnnnnnnncattttatgnatgtaagtatatttgttatnnnnnnnnnnnnnnnnnnngagaatgcgtatttaaaattt

SEQ ID NO: 17965 - DNA, 869 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(769): n is a, c, g, or t
  misc_feature (777)..(777): n is a, c, g, or t
  misc_feature (783)..(795): n is a, c, g, or t
  misc_feature (798)..(846): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnntattttanaatatnnnnnnnnnnnnnccnnnnnnnnnnnnnnnnnnnnnnnnnnnnnnnnnnnnnnnnnnnnnnnnnctcattccctaaaaaatatttta

SEQ ID NO: 17966 - DNA, 889 bp, Diabrotica virgifera
  misc_feature (20)..(37): n is a, c, g, or t
  misc_feature (155)..(193): n is a, c, g, or t
  misc_feature (199)..(230): n is a, c, g, or t
  misc_feature (271)..(357): n is a, c, g, or t
  misc_feature (359)..(378): n is a, c, g, or t
  misc_feature (380)..(407): n is a, c, g, or t
  misc_feature (511)..(546): n is a, c, g, or t
  misc_feature (548)..(628): n is a, c, g, or t
  misc_feature (635)..(680): n is a, c, g, or t
  misc_feature (688)..(836): n is a, c, g, or t
  misc_feature (841)..(841): n is a, c, g, or t
  misc_feature (849)..(871): n is a, c, g, or t
  misc_feature (878)..(878): n is a, c, g, or t
aaaatatcttttccgtaaannnnnnnnnnnnnnnnnncttaacgatagttaattcgtatcgtcgagtgaatatcttctctctcctaaaagaaaaatttctttttccgtacctcgtgtatcagggattctttttaataattcatcatcatttatcnnnnnnnnnnnnnnnnnnnnnnnnnnnnnnnnnnnnnnncctccnnnnnnnnnnnnnnnnnnnnnnnnnnnnnnnntcgaaacgttattcgtttttcaaatatcatctaattttttnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnncnnnnnnnnnnnnnnnnnnnnnnnnnnnncaggattcaaaagattcttcatcattttcaaaatatcggttatctcatcttattctttcatcatcattatctcatctttctcattttttcatcaaattttttcnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnacctggnnnnnnnnnnnnnnnnnnnnnnnnnnnnnnnnnnnnnnnnnnnnnngccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattntttttatnnnnnnnnnnnnnnnnnnnnnnngtatagnattattaatac

SEQ ID NO: 17967 - DNA, 796 bp, Diabrotica virgifera
  misc_feature (124)..(145): n is a, c, g, or t
  misc_feature (517)..(536): n is a, c, g, or t
  misc_feature (539)..(555): n is a, c, g, or t
  misc_feature (779)..(779): n is a, c, g, or t
  misc_feature (783)..(783): n is a, c, g, or t
ctaaaatgaagtcgtgcacgtccggcacaaaaattttcgaaactcctagaaatgaatttattagcaaaatggaagattgcagtcgtgacgcaattaaagaaactaaatctcgtttggctaacannnnnnnnnnnnnnnnnnnnnncgtctcggatctcgcaaaatcgatggttaaatatatgtacgatgacaaagatctatttagagattcagaaattgtcggttgcataaataacttgggaaggtacacagtacaagttgagtatattagatgtttaaccaccgtatctcaaaaaactggagacgatgaaaatattcctacatctagggcagaattttgcagaaaattcgtaccagcaaccgaatagtttcccagacactattaaacggcactgtgtaaatactgcaaaggtcaacaagttcttcagcgactacagtaatgctatcgagactccatgtcaagattctgttaaagaatctaactacctttaaatccagtctgaatttatgtgatggnnnnnnnnnnnnnnnnnnnncgnnnnnnnnnnnnnnnnnccagtcttcgtatctggaatgaacccagatttaactgaggatgatattgagcaacattttggatctattggtattattaagttggacaagaaaacccagaaacgcaaaatctggctgtacaaagataaagcgacgggcgtgagcaaaggcgaagccaccgtaacctatgatgaccccaacgcagcgcaatctgcaatcaactggttcgacggcaaagacttccnaggnatgtatgatcaaa

SEQ ID NO: 17968 - DNA, 740 bp, Diabrotica virgifera
  misc_feature (41)..(63): n is a, c, g, or t
  misc_feature (82)..(117): n is a, c, g, or t
  misc_feature (158)..(180): n is a, c, g, or t
  misc_feature (200)..(212): n is a, c, g, or t
  misc_feature (214)..(300): n is a, c, g, or t
  misc_feature (310)..(358): n is a, c, g, or t
  misc_feature (394)..(465): n is a, c, g, or t
  misc_feature (480)..(497): n is a, c, g, or t
  misc_feature (503)..(529): n is a, c, g, or t
cgtaaggtaattaaaatagtgaggggatatgaatcattttnnnnnnnnnnnnnnnnnnnnnnncgtatcgcgcgtagcgggnnnnnnnnnnnnnnnnnnnnnnnnnnnnnnnnnnnnaatctaatagagataagatattaaaatatttattcgtatannnnnnnnnnnnnnnnnnnnnnncgtttcgaaacggtatgcgnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnngtttagagannnnnnnnnnnnnnnnnnnnnnnnnnnnnnnnnnnnnnnnnnnnnnnnnaaaaaaatttcatattttattatatgatatgatatnnnnnnnnnnnnnnnnnnnnnnnnnnnnnnnnnnnnnnnnnnnnnnnnnnnnnnnnnnnnnnnnnnnnnnnngtatagatgagaagnnnnnnnnnnnnnnnnnntatatnnnnnnnnnnnnnnnnnnnnnnnnnnngtaattcaattacatttttttcttctgattagtatatacatgacttgttgtattatatataatgtctcgtctggcctgtgattagtttgaatggactggccattttgttcgggctaaggtagcataatctttacattatttattgtatggtgagatgaagtgatggatgagatgaaaaactgactgtatttatttaatatataattttatt

SEQ ID NO: 17969 - DNA, 842 bp, Diabrotica virgifera
  misc_feature (6)..(25): n is a, c, g, or t
  misc_feature (27)..(49): n is a, c, g, or t
  misc_feature (166)..(201): n is a, c, g, or t
  misc_feature (205)..(229): n is a, c, g, or t
  misc_feature (276)..(295): n is a, c, g, or t
  misc_feature (297)..(358): n is a, c, g, or t
  misc_feature (360)..(410): n is a, c, g, or t
  misc_feature (422)..(440): n is a, c, g, or t
  misc_feature (492)..(614): n is a, c, g, or t
  misc_feature (616)..(636): n is a, c, g, or t
  misc_feature (639)..(683): n is a, c, g, or t
  misc_feature (685)..(833): n is a, c, g, or t
attttnnnnnnnnnnnnnnnnnnnncnnnnnnnnnnnnnnnnnnnnnnncttcaacgatcagttaattacgtaccgtgagagaatatttctcctcctaaaagaaaaattctctttcgacctccgtgtatcagggattctcaattaataattctatatttctcctcnnnnnnnnnnnnnnnnnnnnnnnnnnnnnnnnnnnnaccnnnnnnnnnnnnnnnnnnnnnnnnncccccgtaatcgaaacgttattcgtttttaaatacatctaatttccnnnnnnnnnnnnnnnnnnnncnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnngattagaaaatnnnnnnnnnnnnnnnnnnncgttattactcattttcaatattataattttcttttttcataaattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnntgnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgaga

SEQ ID NO: 17970 - DNA, 796 bp, Diabrotica virgifera
  misc_feature (8)..(30): n is a, c, g, or t
  misc_feature (64)..(82): n is a, c, g, or t
  misc_feature (145)..(163): n is a, c, g, or t
  misc_feature (173)..(195): n is a, c, g, or t
  misc_feature (215)..(244): n is a, c, g, or t
  misc_feature (264)..(344): n is a, c, g, or t
  misc_feature (358)..(392): n is a, c, g, or t
  misc_feature (400)..(422): n is a, c, g, or t
  misc_feature (477)..(530): n is a, c, g, or t
  misc_feature (650)..(682): n is a, c, g, or t
  misc_feature (738)..(762): n is a, c, g, or t
  misc_feature (764)..(764): n is a, c, g, or t
  misc_feature (768)..(794): n is a, c, g, or t
gattagcnnnnnnnnnnnnnnnnnnnnnnncctaactagcctttcgaaatctaaaaaggaggcnnnnnnnnnnnnnnnnnnnctctaatcgtaaaaataaaataactctaaaataaattttctttcgtaaatcgaaaacggttannnnnnnnnnnnnnnnnnnctaatcttcnnnnnnnnnnnnnnnnnnnnnnncctaacaaacaaatatattnnnnnnnnnnnnnnnnnnnnnnnnnnnnnncaaaataatttctagggacnnnnnnnnnnnnnnnnnnnnnnnnnnnnnnnnnnnnnnnnnnnnnnnnnnnnnnnnnnnnnnnnnnnnnnnnnnnnnnnnnggtaataactaacnnnnnnnnnnnnnnnnnnnnnnnnnnnnnnnnnnnttaatacnnnnnnnnnnnnnnnnnnnnnnntttagtaaatggatgataataataagtaataaaaaaaattcgtaataatctaagnnnnnnnnnnnnnnnnnnnnnnnnnnnnnnnnnnnnnnnnnnnnnnnnnnnnnngtttaataaaaacaggttttttggataaaaaaaggttcgcggccacgataaattgaaggccgcggtatttggacgggtaaggagaaatcattagttttttggaaggaatgagggtggagnnnnnnnnnnnnnnnnnnnnnnnnnnnnnnnnntaaaacttaatttttaaagagagagacctataagttataatattatagtttttagnnnnnnnnnnnnnnnnnnnnnnnnngngtgnnnnnnnnnnnnnnnnnnnnnnnnnnnat

SEQ ID NO: 17971 - DNA, 812 bp, Diabrotica virgifera
  misc_feature (2)..(613): n is a, c, g, or t
  misc_feature (620)..(657): n is a, c, g, or t
  misc_feature (677)..(690): n is a, c, g, or t
  misc_feature (693)..(715): n is a, c, g, or t
  misc_feature (729)..(729): n is a, c, g, or t
  misc_feature (775)..(806): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgagtttaaaccggtgtgagccaggttggttnnnnnnnnnnnnnnnnnnnnnnnnnnnnnnnngaaagg

SEQ ID NO: 17972 - DNA, 952 bp, Diabrotica virgifera
  misc_feature (7)..(25): n is a, c, g, or t
  misc_feature (36)..(55): n is a, c, g, or t
  misc_feature (196)..(269): n is a, c, g, or t
  misc_feature (298)..(395): n is a, c, g, or t
  misc_feature (397)..(462): n is a, c, g, or t
  misc_feature (526)..(874): n is a, c, g, or t
  misc_feature (883)..(943): n is a, c, g, or t
atttatnnnnnnnnnnnnnnnnnnnctctctctccnnnnnnnnnnnnnnnnnnnntctcatctctaacgatagttaatcgttatccgtcgagagaatctctctctcatttctctacaaaagaaaaattcatctctctctcgtacctcgtgtatcagggattatctaattaataattcatcatcatttcatctatcnnnnnnnnnnnnnnnnnnnnnnnnnnnnnnnnnnnnnnnnnnnnnnnnnnnnnnnnnnnnnnnnnnnnnnnnnntcgaaacgttattcgtttttcaaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncattttcaaaatatcgttattatttcatttttcatcatattaatctaatttttcatctttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgagannnnnnnnnnnnnnnnnnnnnnnnnnnnnnnnnnnnnnnnnnnnnnnnnnnnnnnnnnnnntataattta

SEQ ID NO: 17973 - DNA, 752 bp, Diabrotica virgifera
  misc_feature (2)..(18): n is a, c, g, or t
  misc_feature (20)..(64): n is a, c, g, or t
  misc_feature (71)..(747): n is a, c, g, or t
cnnnnnnnnnnnnnnnnncnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagc

SEQ ID NO: 17974 - DNA, 934 bp, Diabrotica virgifera
  misc_feature (58)..(933): n is a, c, g, or t
gacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 17975 - DNA, 217 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (111)..(131): n is a, c, g, or t
  misc_feature (161)..(192): n is a, c, g, or t
taacagnnnnnnnnnnnnnnnnnnnnnnnnnnnnnnnnnnnnnntgcgacctcgatggtggatnnnnnnnnnnnnnnggnnnnnnnnnnnnnnnnnnnnnnntgttcgacnnnnnnnnnnnnnnnnnnnnnagtttaaaccggtgtgagcccagttggttnnnnnnnnnnnnnnnnnnnnnnnnnnnnnnnngaaaggaccaatatataaaataatt

SEQ ID NO: 17976 - DNA, 830 bp, Diabrotica virgifera
  misc_feature (40)..(59): n is a, c, g, or t
  misc_feature (115)..(136): n is a, c, g, or t
  misc_feature (144)..(159): n is a, c, g, or t
  misc_feature (161)..(176): n is a, c, g, or t
  misc_feature (178)..(260): n is a, c, g, or t
  misc_feature (271)..(355): n is a, c, g, or t
  misc_feature (361)..(829): n is a, c, g, or t
atttttctccctctctcaaaataataaaatctttctcccnnnnnnnnnnnnnnnnnnnntctctctctaacgatagttaattagtatccgtgagagaatatctctctctttctcnnnnnnnnnnnnnnnnnnnnnngtacctcnnnnnnnnnnnnnnnncnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnncattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17977 - DNA, 606 bp, Diabrotica virgifera
aaaaatgaggttccttattctacttgccccattggctgtagctgagaatgctacatcaatccaccaacaatggcctacctttaagttaactcagtccaagatttgtgcaaatcttaattcgacgcatatgacgcaccccgtgtctcctaccacataaacgtctattgctctattaattatttgccatgttaagaaaagctacaaaaataaacattataatgatgagaagcccttttaaaaagaggtatcctcacgtagtgatatcccactgttcacggtatcaactccattaggtatgacatgtaacttatttattatcactacttctacaatgatctcctgtgtatatccagaaataacaccctagtcctcatcactgaagttccactcaacctctagttaaaagtaaaattatgacccaaaacttgttttaaaacttcaccactcccaacatgatggaatacatattgtcatacatcactagtacgcttctcgacgaaccactgatattgttatggactccggagatgttgacacccacaccgaccctaacaacaatgttaacacacttccccacgccatcctccgatagaacttgtacgtacg

SEQ ID NO: 17978 - DNA, 654 bp, Diabrotica virgifera
  misc_feature (161)..(182): n is a, c, g, or t
  misc_feature (199)..(219): n is a, c, g, or t
  misc_feature (318)..(351): n is a, c, g, or t
  misc_feature (472)..(507): n is a, c, g, or t
  misc_feature (630)..(651): n is a, c, g, or t
ctccctaggtccgattttattggagagtttaaatggttttcctttttgcgaactcgatgtttttacagtgatagtgattgaattgtgggagaatatattgtttttagtataatatcccattattttttatgacgtgggtgtatggggatatatgaatatannnnnnnnnnnnnnnnnnnnnncttttttatgtggttgnnnnnnnnnnnnnnnnnnnnnaaagaaatattttttgtacatttttttgtgaatggaagtgataatcttttatatatatctctatttttatgagatagataaaatttatatattttcacnnnnnnnnnnnnnnnnnnnnnnnnnnnnnnnnnnataacatagttttagagttgcgcttataaatacaattttttttaaagttaaattttatataaagattggggttataaattttcatatattataatatgtgataatttataattgtatatgnnnnnnnnnnnnnnnnnnnnnnnnnnnnnnnnnnnntaatgttatgctattaatatttatgtaaggatgatgagattagtatgaaaaaattgtatatatagtaagtatatttagatttaatacaggtattcgggaatatttttttcatctgtttagtannnnnnnnnnnnnnnnnnnnnntta

SEQ ID NO: 17979 - DNA, 653 bp, Diabrotica virgifera
  misc_feature (33)..(54): n is a, c, g, or t
  misc_feature (274)..(294): n is a, c, g, or t
  misc_feature (315)..(334): n is a, c, g, or t
  misc_feature (362)..(407): n is a, c, g, or t
  misc_feature (414)..(444): n is a, c, g, or t
  misc_feature (446)..(502): n is a, c, g, or t
  misc_feature (536)..(551): n is a, c, g, or t
  misc_feature (553)..(581): n is a, c, g, or t
  misc_feature (594)..(606): n is a, c, g, or t
  misc_feature (608)..(630): n is a, c, g, or t
  misc_feature (632)..(648): n is a, c, g, or t
gtcgctttatgtcaatgatacagcagtgcaacnnnnnnnnnnnnnnnnnnnnnntacattttctgtgcataaatccattaataagcatgagatgtgtgcaatatgtacacatgtatatattatcttatttaaaatgcatacgacaaaatttcttctcattttttttttaatctttaagttatacaaattataaaaaattacattgaattggacctccataaatcttcttataatattacaaacggtaatgacttgcaaaattatatgaattttnnnnnnnnnnnnnnnnnnnnnctttttttgctacatctatcnnnnnnnnnnnnnnnnnnnngattattacatatttttatggatgaacnnnnnnnnnnnnnnnnnnnnnnnnnnnnnnnnnnnnnnnnnnnnnncattatnnnnnnnnnnnnnnnnnnnnnnnnnnnnnnncnnnnnnnnnnnnnnnnnnnnnnnnnnnnnnnnnnnnnnnnnnnnnnnnnnnnnnnnntactatttagatttatgtaatgatgaattgattnnnnnnnnnnnnnnnncnnnnnnnnnnnnnnnnnnnnnnnnnnnnncataaattcgagnnnnnnnnnnnnntnnnnnnnnnnnnnnnnnnnnnnnannnnnnnnnnnnnnnnnactct

SEQ ID NO: 17980 - DNA, 180 bp, Diabrotica virgifera
aagcaaaatcgaccgacctgctcatggtggcggttgcttgaaatgcttgtaaggacgatttagtgaatgtttaaatgggatattttaaaaaaatgccatatcacgctatttgttgtgttgttcactgtaagaatacatgaagaaattgtgatgtgaaatacctttattttcctcgtttcc

SEQ ID NO: 17981 - DNA, 494 bp, Diabrotica virgifera
  misc_feature (110)..(123): n is a, c, g, or t
  misc_feature (125)..(141): n is a, c, g, or t
  misc_feature (152)..(186): n is a, c, g, or t
  misc_feature (191)..(216): n is a, c, g, or t
  misc_feature (234)..(295): n is a, c, g, or t
aaaaaaaaaatctttttcgtaaagtaaagaaaatttcctcacgaagttaattcgtaccgtgagagatctttcttcctctaaaagaaaaatttcacctctccgtacctccnnnnnnnnnnnnnncnnnnnnnnnnnnnnnnncatttattacnnnnnnnnnnnnnnnnnnnnnnnnnnnnnnnnnnncctcnnnnnnnnnnnnnnnnnnnnnnnnnncccgtaatcgaaatcgtnnnnnnnnnnnnnnnnnnnnnnnnnnnnnnnnnnnnnnnnnnnnnnnnnnnnnnnnnnnnnncatttaataattcaaataatcttttaatattaatctaataatctagaataatctttctcaagggatcgtagctctcaaaaatcaaatattttaatctaaatattctaattctttcaaatcaaataattcaaggattcagaaaatcttttcataattttcaaaataacggttattaatttaatttttcacatattattaa

SEQ ID NO: 17982 - DNA, 893 bp, Diabrotica virgifera
  misc_feature (40)..(57): n is a, c, g, or t
  misc_feature (112)..(129): n is a, c, g, or t
  misc_feature (143)..(174): n is a, c, g, or t
  misc_feature (185)..(255): n is a, c, g, or t
  misc_feature (268)..(645): n is a, c, g, or t
  misc_feature (647)..(766): n is a, c, g, or t
  misc_feature (774)..(803): n is a, c, g, or t
  misc_feature (805)..(823): n is a, c, g, or t
  misc_feature (826)..(826): n is a, c, g, or t
  misc_feature (834)..(892): n is a, c, g, or t
atttttctctctctccaaataataaaatatctctctcccnnnnnnnnnnnnnnnnnnctctctctttaacggatagttaattagtatcgtgagagaatatcttctcttttcnnnnnnnnnnnnnnnnnncttttcgtacctcnnnnnnnnnnnnnnnnnnnnnnnnnnnnnnnntcatttattcnnnnnnnnnnnnnnnnnnnnnnnnnnnnnnnnnnnnnnnnnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggatnnnnnnnnnnnnnnnnnnnnnnnnnnnnnncnnnnnnnnnnnnnnnnnnntanaaagctcnnnnnnnnnnnnnnnnnnnnnnnnnnnnnnnnnnnnnnnnnnnnnnnnnnnnnnnnnnna

SEQ ID NO: 17983 - DNA, 420 bp, Diabrotica virgifera
  misc_feature (65)..(87): n is a, c, g, or t
  misc_feature (315)..(332): n is a, c, g, or t
ctttttaaacatatgctaatttttttagaaatatattagctttatttattatgcttatatttagnnnnnnnnnnnnnnnnnnnnnnncttagaaatgcgttgaccgacgaactgaaatccatcttgttatttaaccaaattactttagcacattattcagcttaatgattatcgccacttctatcattatgacatacttggtaactagacatcaaggatgtacttatcctggaaattctatacaaaatctagttagagccaagtttcttcagaaaaagttatcgtattactatatatgttattacatatgttgannnnnnnnnnnnnnnnnnacgtatttgatatttgagtatgtagtgataatatgttgtattgctacaatattagaccaaaaaccgacgataagatatgtggtaacta

SEQ ID NO: 17984 - DNA, 622 bp, Diabrotica virgifera
  misc_feature (6)..(423): n is a, c, g, or t
  misc_feature (430)..(467): n is a, c, g, or t
  misc_feature (487)..(500): n is a, c, g, or t
  misc_feature (503)..(525): n is a, c, g, or t
  misc_feature (533)..(555): n is a, c, g, or t
  misc_feature (585)..(616): n is a, c, g, or t
agaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 17985 - DNA, 958 bp, Diabrotica virgifera
  misc_feature (794)..(794): n is a, c, g, or t
  misc_feature (887)..(887): n is a, c, g, or t
  misc_feature (916)..(916): n is a, c, g, or t
attagattagccgaaatggccaaaatgaggctagaatatgacgaagctaggaaacgtgtacaacatattcaacaaaaattggcagatctcgaagaaaaagtacaaccgggacagttagaatctgataaagacagacttttactattccaagagaaagaacagcttttacgtgagttaagaagtataaccccgcgtatgaggtcaaaagaagaaatgagtgatatacaattagaatgtaagagattagaagatgatttgaacaaagctttagaaatttccaatcgagccattgctgatcgattaaggctgcatgaagaaaaacaacttctacttcaacaattgaaagatggtttacggcaaatgacgcatttagaatcccagttaaaaaccctatcagccagtacactgtctgttagtagtagttctagtctaggttctttatccacaactagtagcaaaggatctttaagttcaggattaagttttacagacatttatggcggtccccagtgtatgagttccaataatatggataaacccatcgatatggcagatttacataaacgggttgaaagactattaaacagcgatagtacaaaccatatcccttcgcctagtagatcacaaccttctttatctcctagaagttcgcttagttcagtttcacctccagtatctccaatgtacgagaatctccctagtatagtgcctccccccacttacgatcaagtgaagagggagaggaaactacaaatagatgaacgattagtggaactaagactctctaacccttncatcgcgagtgctggaaacatggagtatcatcaaagaagctcttttcccagtttgtcacctttaacagatctcttggaaagctcagctagcantatgtcgcagggctccggattggggaggncgagcagatattcctacgaaagctcaggagatccgcctctat

SEQ ID NO: 17986 - DNA, 825 bp, Diabrotica virgifera
  misc_feature (293)..(313): n is a, c, g, or t
  misc_feature (398)..(416): n is a, c, g, or t
  misc_feature (526)..(545): n is a, c, g, or t
  misc_feature (547)..(561): n is a, c, g, or t
  misc_feature (600)..(619): n is a, c, g, or t
  misc_feature (695)..(713): n is a, c, g, or t
  misc_feature (723)..(768): n is a, c, g, or t
ggtacggccaggcgagtaccgggtccgggaaattcccggggtcggacccacggcggtccggtttttccactcaccttcaaaatcgatcaaaatcatccccttacggtaaaatggtaaaagaaaaaaatctcctacgctctcaatcggatagttcaatctcggtatccggcgagatgaatcactctccgcccttcatcaaaatgaaaaattccactcccccggtacctccgcgtatccagggatctagctagattaaatagattatcatcactcaatagcccccgaatctcaannnnnnnnnnnnnnnnnnnnnctcctcaccggtaaaataaatacctcagaatagattccctccggaacgaaacggtactcgtttctcaatatatctaatcttttcnnnnnnnnnnnnnnnnnnncctatagacaatataatcttatcaattaaaataccttatatctacaataataaataccctcatgggatcgggcttagaaaataaaattttaactagaaattctaaatttnnnnnnnnnnnnnnnnnnnngnnnnnnnnnnnnnnnataatttcaaaaataacggttaataactaattttaatcnnnnnnnnnnnnnnnnnnnncatcaaatttttctcatcaaaaataatcaaatttaaaattcattaaaatttcagtaatcggatggataataatcannnnnnnnnnnnnnnnnnnataattcagnnnnnnnnnnnnnnnnnnnnnnnnnnnnnnnnnnnnnnnnnnnnnncaccggttaataaaaacatggtctttttggtataaatataaaggctcgcccgcccac

SEQ ID NO: 17987 - DNA, 973 bp, Diabrotica virgifera
  misc_feature (111)..(128): n is a, c, g, or t
  misc_feature (828)..(828): n is a, c, g, or t
  misc_feature (852)..(852): n is a, c, g, or t
  misc_feature (890)..(890): n is a, c, g, or t
gaaggttttaggtgtagcataaatcggtagaaaaaagcaaaatgcaaatacttgtttttcgtgtggattttttcgcaattattgctattttcgcaacaagggtgaggggtnnnnnnnnnnnnnnnnnntatcggctttgctcgccggtacaactcgatggccctggagaatttgattttgaacaagcaactaatacgagcaaccctttctggaatgttgtaagggactttattttccctccaacaccagatgacgttgtatgccattttccaaaacctatacttatcatgtcaggaaggattactaagccatacgaatggcaaccggtaacagtttctaaccaattagtaaaaataggacagcttgttctgattgccgttcctggagaatttacaaccatgtctggaagaagattgagagatgctgttaggaaagcaattatcacaaacgacggaccctcagattcattggttgttatagcgggcttaagcaacgtttataccagttacattgccaccccagaagaatatcagcttcaacgatatgaaggtgcttcaaccatctacggtccttatactttaccaatctatgaaaacatttatggtcagctaacgaaagccatgatgaagaatgaaactgtgaatgacgactcaagtccctataaattcccgaaagacatggccactcttattactcccgttattatggattctagtggttggtttaataattttggtgactgcgtcgttcaaccaaatgactgctatgaaccgggccaaacagtttctgcagttttcgtcgcaggtcatccccgcaatgatgttatgncagacaaaacctttttgaccgtancaaaacaagaaagtcaaaatcaagataagccaacttgnaaaactatttgcacggatgcaagctggggaaactaaaagttatttggagtagaccagacccattaaacacctacccagtcagc

SEQ ID NO: 17988 - DNA, 266 bp, Diabrotica virgifera
  misc_feature (10)..(27): n is a, c, g, or t
  misc_feature (141)..(154): n is a, c, g, or t
  misc_feature (156)..(170): n is a, c, g, or t
  misc_feature (185)..(220): n is a, c, g, or t
  misc_feature (225)..(257): n is a, c, g, or t
ttttctttcnnnnnnnnnnnnnnnnnntctccttacgtaaaagtaaatgaaaaattctcaccacacgatagttaatctcgtaccgtcgagagaatccttcaccccctaaaagaaaaatttatctctctccgtacctcgtcnnnnnnnnnnnnnncnnnnnnnnnnnnnnncatcatttatctacnnnnnnnnnnnnnnnnnnnnnnnnnnnnnnnnnnnncatcnnnnnnnnnnnnnnnnnnnnnnnnnnnnnnnnntcgaaacgt

SEQ ID NO: 17989 - DNA, 690 bp, Diabrotica virgifera
  misc_feature (298)..(315): n is a, c, g, or t
  misc_feature (372)..(441): n is a, c, g, or t
aacaatatataaagttcttgaactccctaagtggaacatagagcttcagtgaaaatgcaccatcacctcattccaagactttccttgacttcttaccaattgttggacaattataactcagattaattttactaggtgacagttccataagtaaaaatatgcaatggctatatattgcgtactaaacttaagaagaaaaattgtgtcgctctggaagaaagattacttgcataagaatgaaaatcagtgtcatattttgcgtttatgacatccctagacgatactattttttcgttannnnnnnnnnnnnnnnnngatcaagagcaacaatttggagactgatattcttatgcgagttgttgctcttgatcnnnnnnnnnnnnnnnnnnnnnnnnnnnnnnnnnnnnnnnnnnnnnnnnnnnnnnnnnnnnnnnnnnnnnncaaaataatagcttattcattttcttggctacgtaacctccaacttgatttatacatttattttacttttgattgtctattttttctggaatagagaggaagaattaacattccattaaatgtcattgcccaatgaataaagcaatatacctcttaccattcgatgctttttcagcattttaattctagatggagaacggagatatttcttgatggaggatttgacatgttcgaagttactgcaaaaat

SEQ ID NO: 17990 - DNA, 568 bp, Diabrotica virgifera
ccacaagagagttagtgttctttgactttttttaatagcttgaaactattgaagtaagtctagtgagtaagctcagagaaaaaaagtaaattttttatctttaagtaacgtattgtcttttcttagatactatgtgtagcaccgtgaataaattaatatatatccgatttattactatctaaagtaactagcccaaacaaaatatgttttattattgacaaatattctatgttcaactatcttgtgtataggaagggatagtctttcataattaaatctatctttacatgtaaccaataacctatatctattcactaaactatatattcataactacttctatatttatgatatcgatctattatatacttatgcatgtacttacaactgttttaatatataaaattcatattaaccgtaagctttataaacaataagttcatcataatatattatatgttataatttctgtttatagttattgttatttataatttatttgatattagataatgtattgcatattacgatcaatgacggcacatattgataaatatcagacgaggat

SEQ ID NO: 17991 - DNA, 785 bp, Diabrotica virgifera
  misc_feature (704)..(726): n is a, c, g, or t
  misc_feature (760)..(760): n is a, c, g, or t
acaaaacttcgataaagtcctaaaaactttcaaattccttaaggcagaactcggagaaattatatcggctgtagaggttatagatactcctacgatggattttatcaatcaaatcgttggtcaaacctctccaattggtgattatcctttctacttacttgtcgaaacatcaggtagcaatgaacaacacgatgaagagaaactcaatcatttttttgaagcagctctaaagaaatttttggttctgaacggtaccgttgcttccgaacccgcaaaaattcaggctttgtggtcaatacgggaaaatattccaaatggatttaagatctgctcatcaaaaatgatgtattatgacgtctctatgcctctttcaaattattattctatagtaaatgatgtcgatgaattcacgaagggcttaagcgaacgagtatttggatttggtcatctgggtgatgggaacatacatcttcaaattcagttgaaggatgatctaaccgacgaaataaagaagcacattgatccgtttgtttttgacaagatattgagctatggagggagtatcagtgccgaacacggtataggtattataaaacagaaatatatgaatagacttaaaactgttaacacacttaatctaatgaaagatttgaaaagtttactagatccaaacaaaatactgaacccctataaagtgatagtgnnnnnnnnnnnnnnnnnnnnnnnccttttgttcttttttctattttttcctggtggntggacgtttatatcaacccaggtct

SEQ ID NO: 17992 - DNA, 791 bp, Diabrotica virgifera
  misc_feature (12)..(35): n is a, c, g, or t
  misc_feature (38)..(57): n is a, c, g, or t
  misc_feature (65)..(92): n is a, c, g, or t
  misc_feature (131)..(206): n is a, c, g, or t
  misc_feature (209)..(415): n is a, c, g, or t
  misc_feature (417)..(442): n is a, c, g, or t
  misc_feature (460)..(513): n is a, c, g, or t
  misc_feature (530)..(555): n is a, c, g, or t
  misc_feature (557)..(569): n is a, c, g, or t
  misc_feature (583)..(599): n is a, c, g, or t
  misc_feature (601)..(651): n is a, c, g, or t
  misc_feature (664)..(684): n is a, c, g, or t
  misc_feature (704)..(737): n is a, c, g, or t
  misc_feature (768)..(790): n is a, c, g, or t
atttattttagnnnnnnnnnnnnnnnnnnnnnnnntgnnnnnnnnnnnnnnnnnnnngatagtgnnnnnnnnnnnnnnnnnnnnnnnnnnnntcttctataaaagagaaatttagtttttcgtacctcgannnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnngttattatttacttttcnnnnnnnnnnnnnnnnnnnnnnnnnnnnnnnnnnnnnnnnnnnnnnnnnnnnnngtttaaatttatgatgnnnnnnnnnnnnnnnnnnnnnnnnnncnnnnnnnnnnnnntgaatatatagggnnnnnnnnnnnnnnnnntnnnnnnnnnnnnnnnnnnnnnnnnnnnnnnnnnnnnnnnnnnnnnnnnnnntaagtctcgtcgnnnnnnnnnnnnnnnnnnnnnctcgcggcattttgaccgcnnnnnnnnnnnnnnnnnnnnnnnnnnnnnnnnnntagctgtaatgaaggtatgaatgaagacatnnnnnnnnnnnnnnnnnnnnnnnc

SEQ ID NO: 17993 - DNA, 810 bp, Diabrotica virgifera
  misc_feature (618)..(649): n is a, c, g, or t
  misc_feature (695)..(695): n is a, c, g, or t
  misc_feature (767)..(767): n is a, c, g, or t
atttaaataaaattgttgtttattcccattaaatattcccattatatattaaattatcatagttaatggatacaatccataattttagttcaaattactttacatttgacatttcgatttaaactttgaaaatcgttataaaaatacgatttatttcattaaaattcccattaaattagtagtaaatataaacatttcataagaaaatagtttcagacccacggtaagaaattattagtgagtttttcaacaaaaaatttagagtactacacagttggttaatcgtcatcgaaaaattgctctctacaaaaagctgtatgtttctaaaactgtactaataatcattttgtaggcttaaatatagacatagcattaaggagatcagtgcctttctgttatcattagcagcttactacatgtcatcatcaaaggtgtggtattttttgtcgttttataaacactatatgttgtgtgtttttgattacacagatttttgactttcttggacatcaaaactgaaggaaacactgtgtctgttcctaacactccacgcccatctatccacaagtatgaataaaagaaatatagatttttttacagtaagtggtaataatatgnnnnnnnnnnnnnnnnnnnnnnnnnnnnnnnnctaaatctgtatggaattcatatttatgttatgtttaatattttanaatatttcgtatgattttaatttgctcaatattacacattgtcatatatctagtctaagttgtacccgtatntgtaatatgttccgcattgtaagatacgtaataaatctactat

SEQ ID NO: 17994 - DNA, 921 bp, Diabrotica virgifera
  misc_feature (100)..(100): n is a, c, g, or t
  misc_feature (185)..(185): n is a, c, g, or t
  misc_feature (495)..(513): n is a, c, g, or t
  misc_feature (522)..(564): n is a, c, g, or t
  misc_feature (644)..(656): n is a, c, g, or t
  misc_feature (658)..(739): n is a, c, g, or t
  misc_feature (881)..(900): n is a, c, g, or t
  misc_feature (903)..(915): n is a, c, g, or t
gtttctctcttacaaatcaatcaaaataatctctctctccagtataaaagtcaaaagataataatctcttcgtcttcgatcggatatggttcaatctcangtatccgtcgaagaagaaatcatctctctcatctctctctcatcaaaaagaaaagaatctcaatctcctctccgtcactctctcntcgtcatccaagaggtatctcatctcaatctcatatatatctcatcatcatctctcatctccatctctttcagaaattctcaaataagaagctcataaataatctcaaataatctctcttcatccggtgaaaagtaaataatcttctcaaagtcaatttttcttcgtaatcggaaacggttaatctcgttcaccaaataatcatctcaatttttctcaagaaatagatctaatttcacttatctaaacaataatacctatcaattaaatattttctctcatctttaatatctaaatatcttcagggatcnnnnnnnnnnnnnnnnnnnctcatctcnnnnnnnnnnnnnnnnnnnnnnnnnnnnnnnnnnnnnnnnnnnatattctcaaaatacggtcttcatctcattttatcacatcataatttccattctctcacaaattctatcttaaaatatcnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnggaacattttttcacgttaataaaaaggtttttgataatataagttcgcggcacgatattgaaggcggtatttgacggtaggagatatcatatttttatgaagtggatgaggttggtgaaaaaacggcttattattataagnnnnnnnnnnnnnnnnnnnngcnnnnnnnnnnnnngacgag

SEQ ID NO: 17995 - DNA, 842 bp, Diabrotica virgifera
  misc_feature (49)..(68): n is a, c, g, or t
  misc_feature (147)..(160): n is a, c, g, or t
  misc_feature (162)..(175): n is a, c, g, or t
  misc_feature (233)..(258): n is a, c, g, or t
  misc_feature (276)..(324): n is a, c, g, or t
  misc_feature (326)..(342): n is a, c, g, or t
  misc_feature (347)..(389): n is a, c, g, or t
  misc_feature (395)..(473): n is a, c, g, or t
  misc_feature (517)..(723): n is a, c, g, or t
  misc_feature (726)..(801): n is a, c, g, or t
  misc_feature (803)..(827): n is a, c, g, or t
cccacgcgtccgttttctctctcttaaaataataaaatctctctccccnnnnnnnnnnnnnnnnnnnncatctaacgatcggttcatctcgtaccgcgagagaatattttctctccacaaagaaaaatcttctctttccgtacctcnnnnnnnnnnnnnncnnnnnnnnnnnnnncatcatcatttatcactttcgaatttaaaagagctcaaaagattaaaatttttcatcnnnnnnnnnnnnnnnnnnnnnnnnnncctcgtaatcgaaacgtnnnnnnnnnnnnnnnnnnnnnnnnnnnnnnnnnnnnnnnnnnnnnnnnncnnnnnnnnnnnnnnnnncatcnnnnnnnnnnnnnnnnnnnnnnnnnnnnnnnnnnnnnnnnnnnggatannnnnnnnnnnnnnnnnnnnnnnnnnnnnnnnnnnnnnnnnnnnnnnnnnnnnnnnnnnnnnnnnnnnnnnnnnnnnnngttattatcttcattttctcatcatcatctatctatttttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnntaagaattatatttt

SEQ ID NO: 17996 - DNA, 674 bp, Diabrotica virgifera
  misc_feature (85)..(108): n is a, c, g, or t
gttttattgattgttattgtagaattccattttttattgaaaaggatagagaaaatttatttaacgccagaaaatgactactggnnnnnnnnnnnnnnnnnnnnnnnnggaaagattgatttttcgaaccttgtgcctgaggaatgattacttactaattatatattgattatttgcgactttcaaagagatatcacatcagaattgttatcgaagatgaaatagtttagatgattcttttgaagtgaaacgagattccatcttacctatagctaattatttaaaatgtagattagacttatttattactgatagaactatcagtaagtattcttatatgatcattagcaccgattcttaggcatgaactattccaacgacattttatgaagatctagtttttatgtaaaaatgactgtcacctattttcatatttgaaaatatgatataatgtattactatatgtaagtatttttattctatatatatcgtttattattctatgaattcaattgattctacattatcaatgaagataatattataattgactcaccgtatatttatgattcctagataataatgataaggatgttcgcaccgatctttttcacctgattattaagaacatgtcttgtgtgatgtattcattcagtctcgactgcccactgagt

SEQ ID NO: 17997 - DNA, 935 bp, Diabrotica virgifera
  misc_feature (514)..(530): n is a, c, g, or t
  misc_feature (778)..(778): n is a, c, g, or t
  misc_feature (784)..(784): n is a, c, g, or t
  misc_feature (814)..(814): n is a, c, g, or t
  misc_feature (864)..(864): n is a, c, g, or t
cgacgcagaaatgaatgacccaaacacacttccgcgaatttataatgtaaaactaagttttcgttgaaaattcatatcgtaattgtggaaagagtataaaagttagtaaaggtcatttgagctccataaattaaaagtctatagttgttcaatgatatttttgaatgtacctacattatttacgaaaaatataataataggagcttagctagaaattctaaggcatgattttagtacggcgacgtaaaaattggatttttttcgtgcaacggagaaaaaaaagagggtactgtacaatttttttagtaacttcgtttgaataaacgaatcactttatagtctgtaaatccccctaaatcgaaacgggtacaaatattatacggcaaaaaacaacttacacttaaacttacgtgcttacaattatttttggctgtgtgcgtaaatgcaagagataatataaataaaagagacaaatagaaacatgcagaggaatgattaagaaatttctgtaccnnnnnnnnnnnnnnnnnaaagaatatatttaaatgattttagttacctattatattatgtgtatataatcactgccagctcggaggtaaagtttactttttaagaacataattttcaagaaatttcgacagttttcacaaaaattatttaaattatgctattgtatccttagttaaccttggtctttgtgttcaaacgaaagtgcctatatttcgtatatattttattagggtataccatagcctataggcgcccatactcatgngaaggngcgagccgtgggcccctaagccttttcggngttgcttttaactatatatcgtgatccattgtatacaaaatgcaatgtgncacatccttcatgtctgtcgcccccctaaaatttttatatagccgcccataagtatatacgtactacagtt

SEQ ID NO: 17998 - DNA, 747 bp, Diabrotica virgifera
  misc_feature (82)..(106): n is a, c, g, or t
  misc_feature (154)..(167): n is a, c, g, or t
  misc_feature (169)..(181): n is a, c, g, or t
  misc_feature (205)..(235): n is a, c, g, or t
  misc_feature (301)..(337): n is a, c, g, or t
  misc_feature (347)..(367): n is a, c, g, or t
  misc_feature (380)..(424): n is a, c, g, or t
  misc_feature (428)..(457): n is a, c, g, or t
  misc_feature (460)..(474): n is a, c, g, or t
  misc_feature (492)..(505): n is a, c, g, or t
  misc_feature (507)..(661): n is a, c, g, or t
  misc_feature (672)..(727): n is a, c, g, or t
  misc_feature (732)..(733): n is a, c, g, or t
tttttcttccttttcaaatcaatcaaatcattttcccggtaaaaagtaatagaaaaaattttcatcctcaacgatcagttcnnnnnnnnnnnnnnnnnnnnnnnnntctttcatcttctctcaaatagaaaaatttcattttcccgtacctccnnnnnnnnnnnnnncnnnnnnnnnnnnncatcatcatttcatcctctttcgnnnnnnnnnnnnnnnnnnnnnnnnnnnnnnnccaccggtaaaataaataattttcaaataaattttcttcgtaatcgaaacgttaactcgtttttcnnnnnnnnnnnnnnnnnnnnnnnnnnnnnnnnnnnnncatttcttcnnnnnnnnnnnnnnnnnnnnnctttttcatatcnnnnnnnnnnnnnnnnnnnnnnnnnnnnnnnnnnnnnnnnnnnnncatnnnnnnnnnnnnnnnnnnnnnnnnnnnnnnggnnnnnnnnnnnnnnnatcatttcaaaataaggnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtttatannnnnnnnnnnnnnnnnnnnnnnnnnnnnnnnnnnnnnnnnnnnnnnnnnnnnnnngatgnncgcggtatttttga

SEQ ID NO: 17999 - DNA, 876 bp, Diabrotica virgifera
  misc_feature (13)..(87): n is a, c, g, or t
  misc_feature (89)..(165): n is a, c, g, or t
  misc_feature (231)..(306): n is a, c, g, or t
  misc_feature (378)..(458): n is a, c, g, or t
  misc_feature (475)..(495): n is a, c, g, or t
  misc_feature (497)..(539): n is a, c, g, or t
  misc_feature (553)..(629): n is a, c, g, or t
  misc_feature (646)..(683): n is a, c, g, or t
  misc_feature (718)..(740): n is a, c, g, or t
aaattttattagnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnntgattacaaaattgtatatttagcaaaaatatatagccctaataaaggaattcgtcaacattttannnnnnnnnnnnnnnnnnnnnnnnnnnnnnnnnnnnnnnnnnnnnnnnnnnnnnnnnnnnnnnnnnnnnnnnnnnngcgcgtgattttgaccgcgctaaggtaccataatcattagcttttttattgaaagctgtaatgaagggttgnnnnnnnnnnnnnnnnnnnnnnnnnnnnnnnnnnnnnnnnnnnnnnnnnnnnnnnnnnnnnnnnnnnnnnnnnnnnnnnnncaacaccctatagagcnnnnnnnnnnnnnnnnnnnnngnnnnnnnnnnnnnnnnnnnnnnnnnnnnnnnnnnnnnnnnnnnttgagattaaaacnnnnnnnnnnnnnnnnnnnnnnnnnnnnnnnnnnnnnnnnnnnnnnnnnnnnnnnnnnnnnnnnnnnnnnnnnnnnnaccttatggataacagnnnnnnnnnnnnnnnnnnnnnnnnnnnnnnnnnnnnnntgcgacctcgatgttggatacagtttataattgannnnnnnnnnnnnnnnnnnnnnntgttcgactcttaagattttacatgatctgagtttaaaccggagccagccagcttgcgttctatcgttaatttattagtatattttagtactgaaggaccaaatatataagataatctttatatttagataaatat

SEQ ID NO: 18000 - DNA, 198 bp, Diabrotica virgifera
  misc_feature (9)..(34): n is a, c, g, or t
cgcgcgcgnnnnnnnnnnnnnnnnnnnnnnnnnnccccttttaagaagatgcatgacagatcttcatttaccgatagcaaaagaagaagggagactccctatgatgttagtacagaggaagcagcttaggcgggcgtaccgcgacgcacgccgcactaggaatgtactatattatgtatcatctcattttcgaatttt

SEQ ID NO: 18001 - DNA, 825 bp, Diabrotica virgifera
  misc_feature (230)..(247): n is a, c, g, or t
  misc_feature (701)..(701): n is a, c, g, or t
gttgggtagttttattttagaaaacatgaaagagaaggagtcctatgaacatgtttatggagatcctaaacaatatcacatgccgattaaagaaatagaggaaaaatggaagttggtgcctgcctttctgaaaataagaggattggtaaaacaacatatagactcattcaattacttcattgcagttgaaattaagaagatagttgaagctaacaacaaagtaacatgtnnnnnnnnnnnnnnnnnntatatcaagtacacaaatgttcaagttggaacacctgatgtggatgaaggtttcaatattagcaaacctacgacacctcatgaatgtagattaagagatatgacatattcagctccaataacagttgatatagaatacacaagaggatcccaaaggctctctaaaacaggcctgttaattggaaggatgccaattatgctgaaatcatcaaattgtgttctaagcggcaaatccgagtatgaattagcaaaaatgaatgaatgcccgttagacccaggtggatactttgttgtcaaaggacaagaaaaagttattttgattcaagaacagttaacaaaaaatagaatgttggtcgaggaaggaaagtatggtgtgcagtgccaagtgaccagttccactcacgaaaagaagtccagaacgaatgtatttgtcaaaggaaataagtattacgtgnggcataatactttcacagatcctatccttgtctctgtagtatttaaagccttgaacatcataaacgaccaggagatatgtgaactgatagggaataacgacattcacaatttgactcccacttt

SEQ ID NO: 18002 - DNA, 823 bp, Diabrotica virgifera
  misc_feature (5)..(42): n is a, c, g, or t
  misc_feature (81)..(126): n is a, c, g, or t
  misc_feature (146)..(570): n is a, c, g, or t
  misc_feature (574)..(686): n is a, c, g, or t
  misc_feature (695)..(727): n is a, c, g, or t
attgnnnnnnnnnnnnnnnnnnnnnnnnnnnnnnnnnnnnnngagaaagttttagtttaatagatagcttaattacgtatnnnnnnnnnnnnnnnnnnnnnnnnnnnnnnnnnnnnnnnnnnnnnngtaccttcgtgtatcgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcggannnnnnnnnnnnnnnnnnnnnnnnnnnnnnnnnctattttattgagagctggaatgaaggactggatgagaaaaagactgtctttatataatttatagagaattttatttgtatgttaaaacgcttaaa

SEQ ID NO: 18003 - DNA, 779 bp, Diabrotica virgifera
  misc_feature (2)..(45): n is a, c, g, or t
  misc_feature (47)..(89): n is a, c, g, or t
  misc_feature (97)..(776): n is a, c, g, or t
cnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagc

SEQ ID NO: 18004 - DNA, 938 bp, Diabrotica virgifera
  misc_feature (752)..(753): n is a, c, g, or t
  misc_feature (781)..(781): n is a, c, g, or t
  misc_feature (863)..(863): n is a, c, g, or t
gaaaaattatcgtagtatctctaagcaatcagcaataccaaagttattcgataaaatagtatacaatcatctatattgtcaatcgtaaagaattattatctcgtagttcaacatcgggtttgcagctcgggaaatccactattactaacttggcagtgtatcgaaatggatctcgttggaggcattaaagagaaaggaacaagtagactcagtatcgcactcgacttctccaaggccttcgacagagtcaattttgacattttcgcttgaaaaactcctaaatttagaatttactaaggaggccatagaatggatatcaagttttttaaacaaagggtgaaactatttaatttcctatcctatctgaatcatttgaggttttatcaggtgtcccccaaggataccactcgttcaccattactgtttaatctctataattgatatttctgataattttgaatcatcagttttactttttgcagatgacttcaagttatatagatgtataaaatctatagctcacatacatacagggtgggggcattagtgtgacaaagtccaattactgtttgttgtaatagatacgaaaacaagttatttaggtaaaaatttggggtacacatagtaccataatctaaaaatattttcaaatatacaggggtgtccgtgttgacagggtgacacaaacttatgttttttttaatggaaaacgctgtacatttttggattcccttgaatgtttcctttcttannaatatagggttttgtaatattatacggngtagataaaagataattacgtttttttgttaatttcgtagcaatatatttacaccctgtagaattgtagtgattcgacatcnaattttctatttacgtttaaacgattttttatatagtctactattggtaaacattaacagtatagcgaaatgttt

SEQ ID NO: 18005 - DNA, 734 bp, Diabrotica virgifera
  misc_feature (642)..(664): n is a, c, g, or t
caaaatctgctagatgatggattgttaggattatatcgagtgttgggagtatcacgacgagtatcattatctaccgcgtcgatttcttcgtgttctacaatactgtcgagtttattttacccgatcctaaaaagactccacttgaatctacatgaaacattgcacaaaatgaaaacactgtagctgtaatcatcacatatcccttcgatactgtacggactggaatgatgatgtattatggactataaaataccgaaatcatctactgaaccacagatcactgatgaatcacaaacgccaaaaccgaaggtaccgatgtctacttcaagaaagctttctccaacgctctccttatgactgtcgcagatattgtattgctaatgtgcgacaaagtcagaaacttgattgagtaatatgattatcattgctacgacaatcgcccatcattatcatcactccaatctatttgtcctaaaaaatatttaatcaaattcaacgatatatacgtctaaccgtgcttgttgcaaaccataccatattgtatttgtgaccattgtatagacctttagagctcactgaaatgttattgatgtcaccccacccctagctgaacacgacttgaaatagaatgaatatatacgnnnnnnnnnnnnnnnnnnnnnnngccataaataatatcatcatactcgtccgttagaagtatagactatatatttctcattcagagactgata

SEQ ID NO: 18006 - DNA, 696 bp, Diabrotica virgifera
  misc_feature (218)..(244): n is a, c, g, or t
cccacgcgtccgctcgactaaggtgtataagttaatgaatttcaataatatgaatagttatcgagtggttatatcgtacgtataacttacagcctacaggggtctaggacgtttcatcgccgccgtttcgatgccgccaggtcgatgccgatgccggccgattcatcgccagtctattaatcgctatctgatatatttccgaattttcgacagttacnnnnnnnnnnnnnnnnnnnnnnnnnnnaggaattctaggaaatgcgagatatgacggcggtgaaatggactggggatgaatcggggggatcgaaacgggggcgatgaaccgggggccatgaaacgtcccattccggattacaggtactaatatttgatacgtttcaaaatcttttaataaaaatatgttggaataggattgataccgtcgactttttggatatcctttttacattctattttcacacatttcttgcaagttttacgttaagaagattttaagtatgtattacaatatcttctttagcagattcttacttttccatattcgtgtgtcttgagctgcctgggataatagtgagtctcttcctgcctcttctttaatatcgttgatccaccttttttgctgtcttgctaagccttgtctatgtgctgctcgttgtatgcattgtattattctctttgctcacttgtctcttt

SEQ ID NO: 18007 - DNA, 928 bp, Diabrotica virgifera
  misc_feature (696)..(696): n is a, c, g, or t
  misc_feature (841)..(842): n is a, c, g, or t
  misc_feature (862)..(862): n is a, c, g, or t
gttgtggcttcaagcgggtataacctcgaaacgggtggagatcggataatttgacaaacttcgtttggaagcttcttagttgagctttggagggacacctcgtggggctcattcgcacgcgcagaagccgagttacgatcgatgaagcttcgaaaaatgcttattttcgcaatttgaaatttgcgttgtgcactagttttgcagtatcctgagttctcattcgtcggatttgggtttggtaaacggttctttcttcgttttttattatggaacaaattttgtttgaagcatttttttctatttcttttggtttgtgagccggagcattgtggacagtttataaacaattaaattgtttataacaggtttttgaccactcggatcgaagtcccccctcgaaatttgtgatcagcagccagggatccataagaaaccgttgagtttgtccaccagggttgggggtgacacggtggcctctatttggcgcctagactatttcccccgtactattttcatttatatatctttcatacacgtgccatctcgtcatttaccataaatacttaaaagtcttacaactcttaatagtgtcttctaaacttacgtttaaatcagcaaccaatctgtaatcaattatgtaccttcgactagattaaattggtttagattaggctaaactagtttgtcctgatgtgngggcgtgcacttcaggataaactagtttggcctgaagtgtgcgtctttatatcgggatagactagtttggcctgaagtgtgtgtatttatatcaggataaactagtttgggccacgcgcgataggacaaactagtttagcctagnncatactagtttggtctgaanatcgggtttggccggtacaatatatattttatcaaaggtaatttgatcgtcgctgcatacaaaatc

SEQ ID NO: 18008 - DNA, 922 bp, Diabrotica virgifera
  misc_feature (369)..(386): n is a, c, g, or t
  misc_feature (819)..(819): n is a, c, g, or t
  misc_feature (825)..(827): n is a, c, g, or t
  misc_feature (843)..(843): n is a, c, g, or t
  misc_feature (860)..(862): n is a, c, g, or t
  misc_feature (868)..(868): n is a, c, g, or t
  misc_feature (870)..(871): n is a, c, g, or t
  misc_feature (908)..(908): n is a, c, g, or t
agcagacacagaaaataccgaaaaatacgtgatgctactaataacgtagaaaactcttcgacataaatattgaatttcagtgtaagaggtgttttttcaagtaaatatcgcagccttacatatacatatccgtttttttatacatttttataccgcatttggcagtaatttctaaaaataactttgaaactatcgtctttttattacttaaatatttaatatatctactaatattgctttctacgtaagaggcctattagttagacaaatgcatattatgtaggcccctatatcattgtgataatagaaagtttcaataaactaataaactaatcatttctttttaacaataatatagacattagaccnnnnnnnnnnnnnnnnnnataaaccccaaacaaaagatgcagttaatctcatcatcatgcagactctgtttgcgtctacagtgagacataggtcttctcaagttttttctatttatttatatcttgtagcgttgcacccaagtctgcgtctaccttattactcattggtctccattccagaaccttccttgtccatctcctgtcctgaaagtgtgctatagcaccgtccacgaatccatgtcaagacaacaatatgccttgaatgcccataaaccagacttggacttactacgcagaacatcttcttcaaataccatcgacgaaggtcggcaatcatcatatctctttggacttaagagtaatgtagagtaataattatattttctatattattcaacagttcttattagtgttttgaaactttttatgtcaggtgatctattgctcattngtattnnnctaatgtttatcttanatagtattacatactannnaccagntnnatatctgtactacatagttatgtttattgtatctcanaacacaatttccaa

SEQ ID NO: 18009 - DNA, 134 bp, Diabrotica virgifera
  misc_feature (7)..(44): n is a, c, g, or t
  misc_feature (66)..(66): n is a, c, g, or t
  misc_feature (110)..(132): n is a, c, g, or t
taacagnnnnnnnnnnnnnnnnnnnnnnnnnnnnnnnnnnnnnntgcgacctcgatggtggattanagtttataattggtgtagcagctatataattaagtctgttcgannnnnnnnnnnnnnnnnnnnnnnag

SEQ ID NO: 18010 - DNA, 739 bp, Diabrotica virgifera
  misc_feature (101)..(122): n is a, c, g, or t
  misc_feature (545)..(572): n is a, c, g, or t
  misc_feature (665)..(694): n is a, c, g, or t
  misc_feature (718)..(736): n is a, c, g, or t
aaaaagaaaaaaattccatccctcccgtcacctccggtgtatccagaggtattcatctcgattcaatagatcatcatcatctctcaaccctcgaattcaannnnnnnnnnnnnnnnnnnnnnctccaccgtaaaataaatatctcaaatagattccccccggaacgaaacggtactcgtttctcaatatcatctaatcttttcagaaataaattagaatctactaacaacaatatactataattaaatactttaatcactaacaaataactaaaataactttcatgggatcggagctctaaaaaataaaatttctaatcaaaaatcctaaattttctcaaataaaaaattaaggattaaaaaactttcataatttcaaaacaggtcataactaactttcacacaataataacttttcacttcttcacaaattttcttacatcaaaataatcaaatttcaaattcattcaaatttaagtaatcggatcggataataatcagtaatcaaaaaaatggtatcattaagtaaaaataatataggtttannnnnnnnnnnnnnnnnnnnnnnnnnnncacccggtaataaaaacacggcttttcggataaataaaaaggctcgccggcccaccggataatttggaaggccggggtattttggaccggggnnnnnnnnnnnnnnnnnnnnnnnnnnnnnncggaaggtgggaaggaagggttgnnnnnnnnnnnnnnnnnnnctt

SEQ ID NO: 18011 - DNA, 926 bp, Diabrotica virgifera
  misc_feature (809)..(809): n is a, c, g, or t
  misc_feature (827)..(827): n is a, c, g, or t
  misc_feature (879)..(879): n is a, c, g, or t
gaagattatgaatcctaataatgcgcggcgaaaagaataatcctaaattagcgacggcaaattttattttcgtagctactttactggaaaataatttttgtttaatgtaaatcttcgaggagttattttttccgcaagaacaggaatgtaaataattatattcgtcgtcatatattaagaactagatgttttcgtcataaatattttgggagttatgatcttcgtgagtgtacagataaaaagaattattttttgttgttcctggtataaaaataattctttttctacgaccgtttaataatatgctcattattcgctgtttttgaatagataataacatccattactttacccgtgagtaatggtttattactcacgggctgaagttactcacggtttgaagttagattctagtggtgcatggcacttttaatatacctattagcaaataaaattacttaagcttgtttatttaataaaatagtcattgtaatttatatccacaattaaagtcgaaaaatgtttaaaggatttttaattgtaacaatgggttagtatattttttacgtttaaatttcaacatttgacaatttaagatttacgttattcaaaggtaaataagcaatcgaatgaattctgttttacttactgttgactgtacaataaatttttattaagagcacacgtttcttttcgtgtaattgccttaaaatatgtcttatttttaaaagccacctccattccatgacactaatgtcaactgtctgtttcattgtttcgtaagctcaaagagggctattctaacagtngtgccatatttatataanatatattttcttatgaaaaacaaaatcttttgattttgaataatgttagtangtgataattatattttctactaacccaataaaaaaggtcgtagaaaa

SEQ ID NO: 18012 - DNA, 732 bp, Diabrotica virgifera
attgacattgggagattaattttggttatttgtgtaataacatatttaataatgcaagtgtctagtggagattttttacaagttagattattataccaaacagagaatcatcgttgcccttatatgtattttatttactattatagcaatttcttagcttctattttcagatatgcagtcccagacttgcccctttctgtggtctcccgcaatatgcgcgaactcattatgtgaattattaattcaactgcttatggacagcaattccgattttctgaagcccttctatttcgactttttgtctattgataaacttataaaacgagccccttattgatcttttgcgatatagaaatgaatctacagagaccactgttgatgatgagtatttgaaacgtacacctgctcctgagcctagaagattcattgttacatgatgattgactttgtgacattgaaacatcacagaattgcatacttactgaatgctatgactattcatgtaaatatatgagcacatcttggaaaaataattacctctgtgaaataacatatacatgtactgatggcaggtagctgtatagacaagacagatcctagtagagtattcatcattgtatcacatgatttaacgaaactgatgtggtcttttgaacctggtactgataatgtagtaccccaagcagtgttaatcttccacgaaagaggtatagacagtgttgtagttagtcc

SEQ ID NO: 18013 - DNA, 808 bp, Diabrotica virgifera
  misc_feature (2)..(15): n is a, c, g, or t
  misc_feature (20)..(45): n is a, c, g, or t
  misc_feature (53)..(166): n is a, c, g, or t
  misc_feature (176)..(732): n is a, c, g, or t
  misc_feature (740)..(806): n is a, c, g, or t
cnnnnnnnnnnnnnncatcnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagcnnnnnnnnnnnnnnnnnnnnnnnnnnnnnnnnnnnnnnnnnnnnnnnnnnnnnnnnnnnnnnnnnnngt

SEQ ID NO: 18014 - DNA, 893 bp, Diabrotica virgifera
  misc_feature (8)..(54): n is a, c, g, or t
  misc_feature (179)..(201): n is a, c, g, or t
  misc_feature (308)..(336): n is a, c, g, or t
  misc_feature (347)..(365): n is a, c, g, or t
  misc_feature (372)..(390): n is a, c, g, or t
  misc_feature (396)..(429): n is a, c, g, or t
  misc_feature (432)..(446): n is a, c, g, or t
  misc_feature (518)..(541): n is a, c, g, or t
  misc_feature (595)..(647): n is a, c, g, or t
  misc_feature (703)..(703): n is a, c, g, or t
  misc_feature (799)..(885): n is a, c, g, or t
atttctcnnnnnnnnnnnnnnnnnnnnnnnnnnnnnnnnnnnnnnnnnnnnnnnctacacatagttcatcgtaccgtgagagaatccctcaccttctaaaagaaaaatttcaccctccgtacctccgcgtatcagggattctcaattcataattacatcacttataaccctcgaatctnnnnnnnnnnnnnnnnnnnnnnnccctaccgtaaaataaataaccccaaataattctcttcgtaatcgaaatcgttaactcgttcttcaatatattctaatcttttcagaaataaattaaatctactaannnnnnnnnnnnnnnnnnnnnnnnnnnnncatactaactnnnnnnnnnnnnnnnnnnngggatcnnnnnnnnnnnnnnnnnnnttttcnnnnnnnnnnnnnnnnnnnnnnnnnnnnnnnnnnggnnnnnnnnnnnnnnnataatttcaaaatacgttaataattcattttcacatatcataattttcatttttcacaaatttttctcatcnnnnnnnnnnnnnnnnnnnnnnnncaaatttaagtaatggtggataatattaagtattaaaaaaattggtatatttannnnnnnnnnnnnnnnnnnnnnnnnnnnnnnnnnnnnnnnnnnnnnnnnnnnngtttaataaaaaacatggtctttttcgtattaaaataataaaagtcttcgcctggnccactggattaaattttgaattgagccggcggtattttcgaccggtgcttaaggtagcataaatcattaagtttttttaattgaaagttggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnncgagagac

SEQ ID NO: 18015 - DNA, 811 bp, Diabrotica virgifera
  misc_feature (210)..(228): n is a, c, g, or t
  misc_feature (234)..(255): n is a, c, g, or t
  misc_feature (305)..(323): n is a, c, g, or t
  misc_feature (397)..(415): n is a, c, g, or t
  misc_feature (419)..(453): n is a, c, g, or t
  misc_feature (456)..(485): n is a, c, g, or t
  misc_feature (545)..(567): n is a, c, g, or t
  misc_feature (602)..(620): n is a, c, g, or t
  misc_feature (637)..(670): n is a, c, g, or t
  misc_feature (704)..(731): n is a, c, g, or t
  misc_feature (770)..(788): n is a, c, g, or t
atttttctctcttttcaaataataaaatctctcttcgtaaaagtaaagaaaattttctcttcaacatagttaatctcgtatcgtcgagagaatcttctctcccttctaaaagaaaaatttctcttctcccggtacctccggtcgtatcagaggatctctctcaattcataattatcatcatcttcatatctcccgaatctctaaaagcgnnnnnnnnnnnnnnnnnnncaccgnnnnnnnnnnnnnnnnnnnnnncttctaacgaaacgttactcgttttctcaatatcatcctcaatcttctcnnnnnnnnnnnnnnnnnnnctctactaacaataatatcttatcaattaaattcttctcaatcataataaatatctaaatatctttagggatcnnnnnnnnnnnnnnnnnnnctcnnnnnnnnnnnnnnnnnnnnnnnnnnnnnnnnnnnggnnnnnnnnnnnnnnnnnnnnnnnnnnnnnncggttaataactcattttcacatatcataattttcacttttcatcaaattttcttcatcnnnnnnnnnnnnnnnnnnnnnnntttaaaattaagtaatcggatggataatattcagnnnnnnnnnnnnnnnnnnncagtaaaaataatatcnnnnnnnnnnnnnnnnnnnnnnnnnnnnnnnnnncacccggttattaaaaaacacggctttttggtannnnnnnnnnnnnnnnnnnnnnnnnnnncggattaaattgaagagccgcggtattttggaccgtggnnnnnnnnnnnnnnnnnnnagttttttaatggaagtggaatg

SEQ ID NO: 18016 - DNA, 862 bp, Diabrotica virgifera
  misc_feature (669)..(687): n is a, c, g, or t
  misc_feature (827)..(847): n is a, c, g, or t
taatagtatgatagaattgattcaaaaaatgacataacccagacatcggaagtgaaagttgtcctcggacaccaaattgttctgtatcgtccatataatgttcagcaaaaaggtacactttttgagcgtcggctttggggggaggggggtcaaaaatcttcaaaaatcgtgttacataatacttgaacgctccctaaataaaaaattctgcttgcattttattttcgcaaaaatggtacatgtttgaagggcggctactaaagaattgcctagggcggcaattgacctaaacgcggccctggttctgaagtccctgtaggtgtgccgcgacattttaccgtcttttttactatgtagtatttacttttttaattcgccgtgataacttttaccgtgggatatgtttgagttaacaaacaattgcaatgtagaaccaaatctctcatacctttttttgaaaagtcttagtaagctgaatgacaatatcaaaaagtattttccctccctcgatacgtccttgataaactgggtgcgaaatccatacatcgagtcgtcttatgacacggccttgttcactactgatgaagagggtgaactgatagatataaaaacgaccgtcgacttaaacctaagtacagtaaactagttgaagaagcagagcctcagtcnnnnnnnnnnnnnnnnnnngttaatgtaaattttgcatcattttttgattcccctctgcaagggatatcccactgttcacaaaggaaactatgaaatgcataatatcgttttcaactgcttatacttatctgtaaatctgttttttcttcatgaacgcnnnnnnnnnnnnnnnnnnnnnaaaaggttaaatttt

SEQ ID NO: 18017 - DNA, 828 bp, Diabrotica virgifera
  misc_feature (2)..(18): n is a, c, g, or t
  misc_feature (20)..(64): n is a, c, g, or t
  misc_feature (71)..(744): n is a, c, g, or t
  misc_feature (748)..(827): n is a, c, g, or t
cnnnnnnnnnnnnnnnnncnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 18018 - DNA, 173 bp, Diabrotica virgifera; identical to SEQ ID NO: 14885
  misc_feature (2)..(44): n is a, c, g, or t
  misc_feature (52)..(164): n is a, c, g, or t

SEQ ID NO: 18019 - DNA, 536 bp, Diabrotica virgifera
  misc_feature (330)..(348): n is a, c, g, or t
  misc_feature (420)..(438): n is a, c, g, or t
  misc_feature (502)..(520): n is a, c, g, or t
gaattgttagaaatatataatcgaaaaagattaagaacaaaaaatggtgctttattttatataccttttaagcatgacgaatttataaatgaaaagttaaacaaattggaaattcttaatgctaaatcccaaactgattatctcatttctgagtgtctaaatcttatcgaattatactataacatgaataatttaatattgttactattattatacattatattttctggattgttcagcgatacgcagtttaaagatgatctaaaatataaaacacatgtctaatgaactacatattacatagtttattatagaataaacctttaaacnnnnnnnnnnnnnnnnnnngattcatcgtgatacattattattctactttaatatcctcattaatgatgacttccaatataagaattgacnnnnnnnnnnnnnnnnnnngagattctacttttatatttttcattataattatctcctataaatattgtatgacaatttatcnnnnnnnnnnnnnnnnnnnccaacggagaattaat

SEQ ID NO: 18020 - DNA, 789 bp, Diabrotica virgifera
  misc_feature (2)..(17): n is a, c, g, or t
  misc_feature (19)..(61): n is a, c, g, or t
  misc_feature (69)..(680): n is a, c, g, or t
  misc_feature (684)..(715): n is a, c, g, or t
  misc_feature (718)..(720): n is a, c, g, or t
  misc_feature (738)..(739): n is a, c, g, or t
  misc_feature (742)..(764): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgnnnnnnnnnnnnnnnnnnnnnnnnnnnnnnnnttnnnataagaatttatttttanngtnnnnnnnnnnnnnnnnnnnnnnncgagagaccctatagagtttataaa

SEQ ID NO: 18021 - DNA, 552 bp, Diabrotica virgifera
  misc_feature (234)..(264): n is a, c, g, or t
  misc_feature (473)..(492): n is a, c, g, or t
gaaacgattctgcttggtgaaagcattgggaattatctcctttcttttgcatgatccagaatccagagtataccaatgttccaatcactcggaagctctttctttttccatatttctcttataaggtgttgtgggaccattactgtatagaatacagaattttgattttgtgaattcaaaatatctaaaagtaaaccgttatattataatagtaaaatagacttgttgtgtagnnnnnnnnnnnnnnnnnnnnnnnnnnnnnnncttgacataatgagaggtgtacactgcataatagaattctattattacccaaatatatatttatactgatatttctaagatttatattggacgtgcttgttaagatgggttaactaaaagacactattccaaggctaataggaaggaaaatgatccttcggtaatgttaggagaagataaataccgatataatgagatattatataaannnnnnnnnnnnnnnnnnnnaaattcgtatttagaaattatgccaatgaatgtagattgtcagtaaagtgtaaatgagta

SEQ ID NO: 18022 - DNA, 569 bp, Diabrotica virgifera
ccctccccttaagcgacgtttatacatgtgtactcgttgtggtgactccctttaaaattaccattatcagaatgtgatggaaaattctatatcgattaattacattttatgtaaagaaaattaactttatgtatgcttgagctgccgcgaccaccagctgtaaaggagcacaaatgtaatatgtatcccgacttataatggaagaggagaatgttattttgttgctatataaatacgattaaatatgcgggatagctgagcgcagtgcgattacagataattaagatataaattacgtcattatttttagtgtatttcaaagctaatagagaacaaacacgattacatgtttatatatatatatagagtcaacatgaaagtattgttctacattaatatgcaaattaatgttggcccctaaatattaaattggcgtaggacctttgccactatgtgatactgcgttaatatttgcattaaagattatctgcgattcctgttgtaagaatatttatgataaagtcaatacagattatccagcgtagaattatgtggttggattagaacta

SEQ ID NO: 18023 - DNA, 550 bp, Diabrotica virgifera
  misc_feature (5)..(47): n is a, c, g, or t
  misc_feature (58)..(72): n is a, c, g, or t
ggccnnnnnnnnnnnnnnnnnnnnnnnnnnnnnnnnnnnnnnnnnnntatatcagtannnnnnnnnnnnnnnaacagagatagaagcatatcttttgataataaaaggcagctctatgtcatatcgccaagtgctcgcaggggctaatcacaaaaaaagactcaatgaaaaaggtaccacacgaaattcctgaagaatacaaaactatgatagctcaatattaagtacagatatctcgccagaatgctatagaagaactgccataagtatatctgtaaatgtaaacatcgctagagcttgaatgattactggactagctgtaggttgctacgctatgattactacactaagatgattctcctctgcggtttcaaaggacgatccaaatagcctccaagacttaacctgtgaaactgatgaaacaaatacatgctattcgacctctaaactcactgtattagctttcttatttctcgtattgtctactttgttatacatattgaaaatgaaaatctctctgcatttatcttatgaaactacgataaatata

SEQ ID NO: 18024 - DNA, 707 bp, Diabrotica virgifera
  misc_feature (68)..(97): n is a, c, g, or t
  misc_feature (100)..(121): n is a, c, g, or t
  misc_feature (123)..(138): n is a, c, g, or t
  misc_feature (428)..(442): n is a, c, g, or t
  misc_feature (519)..(554): n is a, c, g, or t
  misc_feature (591)..(591): n is a, c, g, or t
  misc_feature (609)..(609): n is a, c, g, or t
  misc_feature (670)..(670): n is a, c, g, or t
  misc_feature (686)..(686): n is a, c, g, or t
gaacagtgaagttatgtttgatatgtataataaaactttgtatttaattatttcagataaaaatatcnnnnnnnnnnnnnnnnnnnnnnnnnnnnnngtnnnnnnnnnnnnnnnnnnnnnncnnnnnnnnnnnnnnnnccgatatatgtttgtgtctatataggtacatatatgtactacattatttaccactattatttatataatgtactacattatttaccacattatgtaccacttttgtgaggggtgatccagaataatctgcatcaaaagatcaaatgctcattttgaaatgatacttatctttgccaggttttctcgttgaaaaattatgttactgcttaagctgtaatgatagttactgttgctgtaggtcacaccaaaagggaaacgcccgatataaacactgtttatttagaagctannnnnnnnnnnnnnntcagatattattaattttgacagtcctatcttacctaccaatcttattgagtaggcaactgtggcaattacatcagnnnnnnnnnnnnnnnnnnnnnnnnnnnnnnnnnnnncagggcatttcacgttttcattcatcatagtgcatgngtttctatcaatgcttanaatttaatgaaacaaaccacaaagatatatacaaatattttaaacgcttttcaaagactgntcttccgatttttganccttcgcttcgttatcgatca

SEQ ID NO: 18025 - DNA, 535 bp, Diabrotica virgifera
  misc_feature (103)..(123): n is a, c, g, or t
gtaaaaatgggttcaccgatatatatttttttatcggtcctttatttttcgtgttcgatcacattatctactgcaggtgtgatatcttgtactacggaagtgnnnnnnnnnnnnnnnnnnnnncgtcttaccaatgattaattgaaattagatataatttgtagctctcgaaatttactcgagcaatgatggtgcaatgttgattgtacatttaacgttttgaatgttgttttcgtgtacgaagcgcaatgggatattaaaaatatctaatttatgtggaaatgaatgatgattaatactatttgcaatgcatagataatttgaaatttgtatgtagaaaaataatgacaagagagagagcgtatgagtctacaactaacaatgtgttatcattagcttcttacaacaaagtgagaattagacattatcatcatatgactatatgctataagtatgattcttacatataatcttctacaccttctatgaagccttttatcacaaaatagattgaagctattcaactctgaataat

SEQ ID NO: 18026 - DNA, 844 bp, Diabrotica virgifera
  misc_feature (53)..(79): n is a, c, g, or t
  misc_feature (528)..(566): n is a, c, g, or t
ttttattcttgttgacttgttatgttgaatttaccaaacttaaccaaaaccannnnnnnnnnnnnnnnnnnnnnnnnnntgacgaattcttcgcagagaacacttactttactttgcatgtggtgttgccacctcctcctgagcgcgccaaatagaagtgggcgttttcgatttacaatgatcccgatgtgagttacggaatgccaatccaaatacgaaaacgacgcgatagatatccaacattccgatttcgaataattacgattcgacttgtgtcatttctattcgtttggttaaaagttacagaatagggcagaatttcatgttaagttatgtgagtacacacagaagaacagtactgtatacacttaatataaaaaaatcattcctgaactacgtcataaatgtgcttagggacactgccacttaatgggttacagtggttcggttaccataagaaattatgcgtttcctgtaacgaacctagtaagatattgtcgataaagacattttcgcctataccgttgnnnnnnnnnnnnnnnnnnnnnnnnnnnnnnnnnnnnnnncaagtaagtgtttaatatagcaagtgtttaatataatgtttattgtagatttataagaattttgagtttaaaactatttgttatcatagagaggtatttgagactaaatatatgacaaatttcaactttatatactgcaaattatgtcgaatgaaggtatcgatatacagggtgtttcattgataattggaaatattttaaccgtaaattcctgggctcacatattaagatttaacccaaaccacctagtccagaaatgcttaataaggaatctagat

SEQ ID NO: 18027 - DNA, 787 bp, Diabrotica virgifera
attcatactgcgaacaatatgattatcaaaagtgtttttacgatattcttgctgggggttatttctttggcccagggattcaatacagaatattttgacacagaattttttacgtccaatgggaagttgaaattggctaagctagtaaaatatgaacctgaaaagtttgagtgtctcttgcgaagacatgcagaatgatgcattgaatctattaaacggtactggaaacactttgaaccaaaacgttgctgctactacggatgtgaaaatagaagaaaatccttttagatgtgaattttgctccaaacaattaacaagaagttcttctttaaaaagacatatgctagtgcacagtggtgaaaggccttttacgtgtgatctatgcaacaaacagttttcaacaaactcacatttaactagacatatgagagtgcatactggtgaaaaaccatttgagtgtaaaatatgcaccaaacagttttcaatgaagcatgctttaaaatcgcatatgacagtgcatactggtgaaaaaccatttagatgtgaaatttgctccaaacaattttcaacaaacacacttttaactgaacatagaagagtacatacgggcgaaaaacctttcacatgcacaatatgcaccaaacagttttcaaatagttccaatttaacacatcacctgaaaacgcacactggggaaagaccttttgcgtgtgaatatgcaacaagagtttcacacagttcgtacgtcaagtacatatgagagtgcatactggtgaaaaatctgcat

SEQ ID NO: 18028 - DNA, 920 bp, Diabrotica virgifera
  misc_feature (14)..(32): n is a, c, g, or t
  misc_feature (42)..(63): n is a, c, g, or t
  misc_feature (146)..(161): n is a, c, g, or t
  misc_feature (163)..(178): n is a, c, g, or t
  misc_feature (189)..(227): n is a, c, g, or t
  misc_feature (230)..(261): n is a, c, g, or t
  misc_feature (285)..(387): n is a, c, g, or t
  misc_feature (389)..(424): n is a, c, g, or t
  misc_feature (524)..(657): n is a, c, g, or t
  misc_feature (659)..(704): n is a, c, g, or t
  misc_feature (712)..(855): n is a, c, g, or t
  misc_feature (858)..(872): n is a, c, g, or t
  misc_feature (894)..(919): n is a, c, g, or t
atttttatcttatnnnnnnnnnnnnnnnnnnncttctcttcnnnnnnnnnnnnnnnnnnnnnnatctctaacgatagttaattcgtatccgtgagagaatatctcttctttcctaaaagaaaaattcatctctcttcgtacctccnnnnnnnnnnnnnnnncnnnnnnnnnnnnnnnntcatttattcnnnnnnnnnnnnnnnnnnnnnnnnnnnnnnnnnnnnnnntcnnnnnnnnnnnnnnnnnnnnnnnnnnnnnnnntaacgaaacgttattcgtttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnctaaatcaaaaattcaggattcaaaatattcttcatcattttcaaaatatcggttattctcttcacttttcatcatcattcattctcttttcatttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnngccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnagacgagaaagacctatagagnnnnnnnnnnnnnnnnnnnnnnnnnng

SEQ ID NO: 18029 - DNA, 702 bp, Diabrotica virgifera
  misc_feature (189)..(224): n is a, c, g, or t
  misc_feature (228)..(252): n is a, c, g, or t
  misc_feature (402)..(454): n is a, c, g, or t
  misc_feature (456)..(470): n is a, c, g, or t
  misc_feature (542)..(555): n is a, c, g, or t
  misc_feature (557)..(574): n is a, c, g, or t
  misc_feature (688)..(700): n is a, c, g, or t
agatttcattttacaaataatcaaaatatctcttctacgtaaaaagtaatagaaaaattcttcatctccaacgatcagttcaattcagtatccgtgagagaatctctttctctctctaaaagaaaaatttctccctccgtacctccgtgtatcagggattctcaattaataattctatattcatccccnnnnnnnnnnnnnnnnnnnnnnnnnnnnnnnnnnnnaccnnnnnnnnnnnnnnnnnnnnnnnnnctctccgtaatcgaaatcgttatctcagtttttcaaataatatctcaattttttcaagaaaataaattcaaatttatcttatctaaacaataatatttaataattcaaataatttttcatactaactaatattaaatatttctagggacnnnnnnnnnnnnnnnnnnnnnnnnnnnnnnnnnnnnnnnnnnnnnnnnnnnnngnnnnnnnnnnnnnnnataatttcaaaatacgttaatcattcattttcacatatcataattttcatttttcataaattttcttcatcnnnnnnnnnnnnnncnnnnnnnnnnnnnnnnnngtaatggtggataatattaagtattaaaaaaattggtatatttaagtaaaaatatatcaggtttaaataaagggaatttcggcaacatttttctttcacctggtttaataaaannnnnnnnnnnnntc

SEQ ID NO: 18030 - DNA, 248 bp, Diabrotica virgifera
  misc_feature (2)..(114): n is a, c, g, or t
  misc_feature (116)..(247): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 18031 - DNA, 579 bp, Diabrotica virgifera
  misc_feature (2)..(58): n is a, c, g, or t
  misc_feature (81)..(380): n is a, c, g, or t
  misc_feature (387)..(424): n is a, c, g, or t
  misc_feature (444)..(457): n is a, c, g, or t
  misc_feature (460)..(482): n is a, c, g, or t
  misc_feature (490)..(512): n is a, c, g, or t
  misc_feature (542)..(573): n is a, c, g, or t
cnnnnnnnnnnnnnnnnnnnnnnnnnnnnnnnnnnnnnnnnnnnnnnnnnnnnnnnnntgattatgctaccttagcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 18032 - DNA, 835 bp, Diabrotica virgifera
  misc_feature (299)..(316): n is a, c, g, or t
  misc_feature (784)..(784): n is a, c, g, or t
  misc_feature (799)..(799): n is a, c, g, or t
caatttttgctcttattattgaaaattaagagttggtgcaatgatgggaattgaccgttgaattgaaacgaatatattcatataaattttgttgaatttgagtgacattgtattttccataggatgtgtgccatgtcttttatctcaatcgaatttaaaatcggtcaaagataattactttagaataataccaaaaactataaaagcagaaattctattgactgcatttattctttattagtgcctattatatgtagatgtagattattgtaccatagaaaaaatatgaattgcaaatnnnnnnnnnnnnnnnnnntatttttatcaccaaaaaaccatcacgcacgctttacttatgtgcatccccgaaaagatagtcctaaaatggttaaatggttggcaaatgtctaaattttataaatacagccacactgtccagtgccaaaggcatctattggatctgtatcaatgtacataaaaggaatttatgaaattcacctattaaaatggcatactgtccttcttgtttaatttactatattttattttgttaattgtgaagctgctagtcctgtaaagaaatgttatgtatgcatgtgtgacaatagttacctaatataaaagatgggcgagtttgatacagatactaacgatttttataaagccaaattttttttaccattttatcgcttttttaattgttagttttacccatttctcttttaaatcctatatcaaatatatacagttgaaatttctgaaaagggctgcatcacggagctgnttttcgatttgttgnccaatcatcatcggtgcttgcgtgaggtttacatgc

SEQ ID NO: 18033 - DNA, 675 bp, Diabrotica virgifera
attatcttcagattccttggatgtatccctctagtagaccattctctaaatgcttctgctgatcaatatagttctattgtcgaccttattactcacatgccagcgatatatattttgaccagcgtgccactttactggtatttattgaaattaaattgatattcaagccggaattgagactcaaggtgctgcttctcagttgattctacctctctctttttgatatcaagtttacagatcgtgatcagaaggatacttttgaaataaacactatacaaagatgcaccatgatatcacccttgctcgacatagacgttttgcgattagtttgttcgataaatgaacaaggtgaagatctagactctctaataaactccgtgttctccataccatcataggataaaccgacaactgaagcgacaaagccagtaacttcttctccaggaatcaacttacaacccgtagtaagtcacgtactatgaaaccggtattccagaaatagaggaatgcaattgagcaccgtattacctttgcaataatgagagtatcaataccaatgaatacggaattattgacattataataaacgagggttcttgtgataacaatatatcgatgtatgttgggataagacaactacagtcgatgaacccataactcccactccccacacaa

SEQ ID NO: 18034 - DNA, 668 bp, Diabrotica virgifera
  misc_feature (305)..(332): n is a, c, g, or t
  misc_feature (445)..(464): n is a, c, g, or t
  misc_feature (466)..(484): n is a, c, g, or t
  misc_feature (597)..(614): n is a, c, g, or t
gcgtaagtaataatatctccacgtggcgaaaaggagggaagatatttcaagacggctcactgagacacttttttttctgttagcctgaatgcctctactgtattgtgcctatgcaatttatcatgagagtagtaaaacgatctatatgttgtatacaattgattttcgtaagtttggaaaatgcattgtccattgtattatcgtagaatttgatgtatttttttatagcatagctgtattgtttagataacccaactgatactctattgctctattcaaattgtgcttttttgtctatattatcnnnnnnnnnnnnnnnnnnnnnnnnnnnncgatcaccattcatttatttttacgtctgtgtcttacttgattgcagattattaagtattcttttttaaatactgattagtatcaatgattttcatactttaagatatgttannnnnnnnnnnnnnnnnnnngnnnnnnnnnnnnnnnnnnnatcttttactactaaatataattatgttatttatgcttagtaatgatcataatattaatgttcaacatgtgcacatgctatcaaaagtatattggtgtaattgaggtcttctnnnnnnnnnnnnnnnnnncgttgttcaaaacatgttcccatgtattaaagattgagcctcgcctgcccactg

SEQ ID NO: 18035 - DNA, 501 bp, Diabrotica virgifera
cgaccgcgagatcgaacgtggaacgacatatttataatattgcgaggatttttactacgtcattgtgatgttagttacagtttcagaacatatgatacttgcaatactatatgttttattatctctttctcgttcttaccaaagatacagacgaactcgatacactgtcgagatataatttgccctaaaagatatcaaaaactgtgcttcgcaataattttacaaatgacattgaacttgcaagagaactgtggagagagatgaggcagaaaagattggtcagctgacttccctacttattttactgctaaagtacaaaagcagatacatggcatacgctacctgaaatccaatacaaaagaaaccgcatccattgaaaaggactaacttattttcacacatatttttttgctgcgtaccggcttttctctctaaagaattaaggaaagatttagataacaatgctatgtaccaaactagacattcccaacaatccagata

SEQ ID NO: 18036 - DNA, 703 bp, Diabrotica virgifera
  misc_feature (539)..(557): n is a, c, g, or t
gtcttttctgaagctgtattaaagagaaaacacaccagcgcgtctccctgccgtaatgtatcgtataaaggctgatttgtgttaggatggggacgtggacgaaacggctgtcttacgtggaacgttgaagaatcgtctgatacgaatagcattagttagtttatcatacaacggaacggggcgactccggggacctgctgcgatgtgcgctctattgttcacgtaacgtgcacgccccgtcctagcatagatcaaccttggtagtggacgacacggctgtcttacggagcacgcgcgttgaagaatcgtttgatatgaaaagcaaaatcagcctttataccgtatgtttcaaattctttcttcctgtgcgtgacaagctttagggtttttttctaaacacattgaattaatattttttgcacattctgtgaaagtttcaaattgtcatatagttttttaaatcctttttgaagtcattgagcagcaaacaattttggaacgcatcttatacatatctgagagttatcccaataacaggnnnnnnnnnnnnnnnnnnnaacaattgttttaacagtattccacttcatcaaaagtgtacgaattgattatcatttacttcctgtataaatcaatcgaatttttcgcatttcctgctcgctagaaatatgcctgtcaatatgttttggatctgaataatctactg

SEQ ID NO: 18037 - DNA, 780 bp, Diabrotica virgifera
  misc_feature (14)..(32): n is a, c, g, or t
  misc_feature (43)..(62): n is a, c, g, or t
  misc_feature (153)..(166): n is a, c, g, or t
  misc_feature (168)..(180): n is a, c, g, or t
  misc_feature (211)..(236): n is a, c, g, or t
  misc_feature (240)..(258): n is a, c, g, or t
  misc_feature (313)..(334): n is a, c, g, or t
  misc_feature (414)..(435): n is a, c, g, or t
  misc_feature (439)..(481): n is a, c, g, or t
  misc_feature (544)..(579): n is a, c, g, or t
  misc_feature (585)..(665): n is a, c, g, or t
  misc_feature (690)..(711): n is a, c, g, or t
  misc_feature (713)..(771): n is a, c, g, or t
atttttctcttatnnnnnnnnnnnnnnnnnnnctctctcttcnnnnnnnnnnnnnnnnnnnntctcatctctcacgatagttaattcgtatccgtgagagaatatctctctcatttctctctcaaaagaaaaattctcttttccgtacctccnnnnnnnnnnnnnncnnnnnnnnnnnnncatcatcatttcttatctttcgaatttcaannnnnnnnnnnnnnnnnnnnnnnnnntccnnnnnnnnnnnnnnnnnnnataatttccctcgtaatcgaaacgttactcgttttcaaatatcatctcaatttcnnnnnnnnnnnnnnnnnnnnnncttcactaaacaatatcatcttatcaattaaatatcttctctcatctatctaaatatctaaatatctttctcagggatcnnnnnnnnnnnnnnnnnnnnnnctcnnnnnnnnnnnnnnnnnnnnnnnnnnnnnnnnnnnnnnnnnnncttttaaaatacgttatcattcattttcacatatcatcattttcatttttctaaattttttcnnnnnnnnnnnnnnnnnnnnnnnnnnnnnnnnnnnncgatgnnnnnnnnnnnnnnnnnnnnnnnnnnnnnnnnnnnnnnnnnnnnnnnnnnnnnnnnnnnnnnnnnnnnnnnnnnnnnnnnngtttttaaaaacacgtctttttggnnnnnnnnnnnnnnnnnnnnnngnnnnnnnnnnnnnnnnnnnnnnnnnnnnnnnnnnnnnnnnnnnnnnnnnnnnnnnnnnnagttttttc

SEQ ID NO: 18038 - DNA, 750 bp, Diabrotica virgifera
  misc_feature (2)..(17): n is a, c, g, or t
  misc_feature (19)..(61): n is a, c, g, or t
  misc_feature (69)..(746): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagc

SEQ ID NO: 18039 - DNA, 692 bp, Diabrotica virgifera
gctaataaatcgataaaattaaagtttatcagagaaatattcttcaaacacgttagttggggtagaaagaaagttagtttctacacgatccatagttctcggaaggtcaacgttctcgttgaaggtacggtacaagtttcgattctcgatcgtttagtggtaataccagaggaattctcgtgtaaaagagtgactaatcctttattaatagtaataaagaaattaagaggatttcaacaagctcgtatcgagatcgctcaagcagatcgcttacagatttatcgtctgtgaaggagtttggattcgtcaacatttcttttatttttagacatacaaaaagactgaatacaatgttaaaatcgtctgtccagcataagattctaaattatttacccgatgatagacccattactgccatacaaattatagaaaatttagataagtgtccgagagggttttttgctatcaacaaaacctacgatcaagactctgatggtgacttaagagagagctcaatttttaaaagtagttctgcacgatatctgtgtttatcgaaaactgaagtagattgaaaaaggcgccgtctggattttcattcgcaggcgaattaaacggagtgacactttgctacaagatgggtaatggttcagactcgcaagcgaacacaaacgaccaatttcccccagaacgac

SEQ ID NO: 18040 - DNA, 58 bp, Diabrotica virgifera
  misc_feature (19)..(19): n is a, c, g, or t
  misc_feature (21)..(21): n is a, c, g, or t
  misc_feature (26)..(26): n is a, c, g, or t
taacagcgtaattttattngnagagntcaaatcgataataaagattgcgacctcgatg

SEQ ID NO: 18041 - DNA, 714 bp, Diabrotica virgifera
  misc_feature (2)..(46): n is a, c, g, or t
  misc_feature (53)..(658): n is a, c, g, or t
  misc_feature (662)..(664): n is a, c, g, or t
  misc_feature (675)..(697): n is a, c, g, or t
  misc_feature (706)..(707): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgnnnatgagggttgnnnnnnnnnnnnnnnnnnnnnnnattatttanntaagatt

SEQ ID NO: 18042 - DNA, 705 bp, Diabrotica virgifera
  misc_feature (249)..(281): n is a, c, g, or t
gtaaaaatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgattggaaaggtcttaaaatcacagnnnnnnnnnnnnnnnnnnnnnnnnnnnnnnnnntttctgtagtcccatctgcttcctccctgatcattagggctcttaaagaaccaccacgcgataggaagaagcaaaagaacattaaacacactggtaacattactttcgatgaaatcatcgctattgccagacagatgaggcccaggtcgatggccaaacagttatccggaactgtaaaagaggttttaggaacagcccaatcagttggatgtacaattgatggtaaagcagcacatgatgttattgacgaggttaatgaaggaaccatagaagtaccagatgaataaactattattagaatattttttctaagttatcagttgttttatttaacctttatccaaatgtggcattttttaatttgttaagaatgtaattgatggattcgaccgttacttgatggaagttcattttatctcacaat

SEQ ID NO: 18043 - DNA, 435 bp, Diabrotica virgifera
  misc_feature (372)..(386): n is a, c, g, or t
  misc_feature (388)..(405): n is a, c, g, or t
aggcgtagtactaggcgccccagagaagtcgttcgaggaaaatttggcaattctcaggaaaataaatttggatgaagtacttccgaatgaccgccttgtcaaaagttttgtcgattgtatgtgcggtacaaaaacttgcacccatgaaggaacggctttgaaagcaacctggaaacagcttcttgacaatcgctgtaaagaaaagtgcaccgaagaagataagacaaaagtaaaacaagttataaagcatctgtatgtaaaacaccgcaattggtgggacgaattagctgcacaattagataaagatgaggaataccgtaacaaatacaagaaacaactcgaagctattgttaatgatgattctataaaagnnnnnnnnnnnnnnngnnnnnnnnnnnnnnnnnngccaagtttaatatgtggagaatatttgtt

SEQ ID NO: 18044 - DNA, 754 bp, Diabrotica virgifera
  misc_feature (342)..(367): n is a, c, g, or t
aatttggtggattatggagatcgactcggtatccactttcgttcgcgctcttactcgtaagaggaataggaaatgtctgcgaaatactcactggacaaacgcgatgctcatcgaggagtgatcggccgctgctttaaacgtgcaaaagtgaaatattattgtttggatacaatcggataagccgatgagggaaatagggaagatcgcccaatgccagccgttatacgttgagaaccgtaagttgtcacaaaacgatctcgagagacaaggagaaaggaggttgtacaagatactaagaaagtaatgaaacaaggatatatacagaggttcgttctcgtccannnnnnnnnnnnnnnnnnnnnnnnnncaggtggaatcgtaattcgatgtcgttggagtcgaggtgtagtattcatatctcgtatgtctattcgaaacgtagtatctctgctaagagggatttcgctgtactgggccttctcatcctctctaactttcgacaaggagcacagatagatcgagttcgtgacgaatcgatggatacttcatgtaaatcctcgtagcagggtctcgctcgtctaaatggtactaccaaaaggatgactggaataagtagacataatttaaaggtgtatatatacattactagtaaaaggattgctagggtgtgactgacactagctatcatttctttttaatatatattagtaatataatcatctagaaccttatttatacctttccgagatataat

SEQ ID NO: 18045 - DNA, 910 bp, Diabrotica virgifera
  misc_feature (15)..(15): n is a, c, g, or t
  misc_feature (162)..(184): n is a, c, g, or t
  misc_feature (274)..(305): n is a, c, g, or t
gtacggccttgcagngtaccagggtccgggattttcccaggggtcaggacccacggcaggtccaggcccatggtatgtaggttccttctctctctctacatgtttaaattctccgaacaggttcgcatctctcactcttctcttccaaacaatcaaaacggnnnnnnnnnnnnnnnnnnnnnnnaacatccgtcgtcattcggacacgtagattctcggtaaatctcactcactaaccggacatcttaatttcacaaacgggggggtatccgannnnnnnnnnnnnnnnnnnnnnnnnnnnnnnncccaagaaatcggggtaaaggttcatctcaaataatcgcccgggtaactccgaacaaacttaaggccgagagagaaacggtgggtatctaaccattcgataattcggctttcgggggaaattcgaaacagctaaataactaacgtaaccattcattcgacggcccccggacacagaggatttttcatctaaagaaacaatcggtcactcgggtacattcacaaggctcgaactcgtggctcgtacttcattcgttcggcagctcgggtactcggtggaaatttcgaagcaggtattttcaaagaaagggacaaacacggtggaacacgcttctttcttcggcttttcacccttcggtggtaaaacaacttcttggttgggtggtcaacaaaagggactcgaccgaaccagcatcacagtggaatcacgtttcgaggaaaatcaagaaggaagtattctcatacattcaagaaaattgggttacaacccagccgccgttggttttcgtaccaattttcaggatgtgcacgggagacaacatggttagaagggatctggacaagaaggccatgggttcaaggggatgggcaaaatcgaacggtaaag

SEQ ID NO: 18046 - DNA, 75 bp, Diabrotica virgifera
  misc_feature (9)..(24): n is a, c, g, or t
  misc_feature (26)..(68): n is a, c, g, or t
catttaacnnnnnnnnnnnnnnnncnnnnnnnnnnnnnnnnnnnnnnnnnnnnnnnnnnnnnnnnnnngtacctc

SEQ ID NO: 18047 - DNA, 398 bp, Diabrotica virgifera
aactctcgaccggcgctgtcaaggggcgagattaacaaagttctcagcacggggtcgtgggtgcccgaatggatcaacttcgccaatccccgccgatgccttccagtcatcatcaggcatcgcggctgccatcttggttaagactacgacatctcgacagtgacactcgaatcgcgcaatgttaagaaatctcatctccccgaagccaaggtatcggtcgatctcgcatctcgttcgcgatcgtgcactcggatcggtccaatcgtcaactcggtgaaacataatttcggtatctgggattcctaattcacgcggagggcttccgagagacttcctttcggaatctggtcagattctcgcttcgaatcttcgggacgatcgatcgtggtgtggaggtt

SEQ ID NO: 18048 - DNA, 950 bp, Diabrotica virgifera
  misc_feature (33)..(50): n is a, c, g, or t
  misc_feature (216)..(243): n is a, c, g, or t
  misc_feature (480)..(494): n is a, c, g, or t
  misc_feature (497)..(526): n is a, c, g, or t
  misc_feature (649)..(674): n is a, c, g, or t
  misc_feature (685)..(737): n is a, c, g, or t
  misc_feature (764)..(785): n is a, c, g, or t
  misc_feature (792)..(835): n is a, c, g, or t
  misc_feature (842)..(929): n is a, c, g, or t
  misc_feature (942)..(942): n is a, c, g, or t
atttcttttaaaatcataaaatcttcttctccnnnnnnnnnnnnnnnnnnctcttacatctctcaacgatcagttcaaatctcagtatccgcgagagaaatattctctcatccccctaaaagaaaaaatttatctctcccgtacctcgtgtatcagggatctccatccaatctaataatctatcataattctaatctaatctctcgaaatctctcnnnnnnnnnnnnnnnnnnnnnnnnnnnnatccgtaaaatcaaataatctctcaaatcaattcttctctccgtaatcggaaatcggttcaatctcgttcttctaaaataatcatcctcaattctcctcaagaagataaattaaaatctaatcctcacatctaacaatcaatcatcttcaatcaattcaaaatcaatctcctcaacatctcgtctagataataaataatccttagggatcgagctctaaaaataaaatttctcatcnnnnnnnnnnnnnnnctnnnnnnnnnnnnnnnnnnnnnnnnnnnnnntctcataatcttctcaaaaatacgttcatctcatctcatctttcaataatcataatttctcatttttcaaaattttttctctaaaataatcaaatttaaattcatcttaaatttaagtaatgnnnnnnnnnnnnnnnnnnnnnnnnnncgtatatttannnnnnnnnnnnnnnnnnnnnnnnnnnnnnnnnnnnnnnnnnnnnnnnnnnnngttaataaaaacatggtcttttttggnnnnnnnnnnnnnnnnnnnnnngccacgnnnnnnnnnnnnnnnnnnnnnnnnnnnnnnnnnnnnnnnnnnnntaatcannnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcttanattttttt

SEQ ID NO: 18049 - DNA, 426 bp, Diabrotica virgifera
  misc_feature (287)..(357): n is a, c, g, or t
gaacatcgagaatttacagtaagtgaatcaacacgtagtttagagatataatggtacgatgtgggattccgacgctgagtctcattacacctcagatatttccttactgcctatatagcaggcaagagaagtgagggacaatatttatctgcaaaatgactccgcaatacgtaaagctactaaattaagaactcccttgttaactaataccacgacagaaacctcacactcctaaaacgacaaacagtgaaagcttatcccacctatcagaaagaaagggtagactnnnnnnnnnnnnnnnnnnnnnnnnnnnnnnnnnnnnnnnnnnnnnnnnnnnnnnnnnnnnnnnnnnnnnnngcctgcgtagaaatacaaacactctacatgtactcagaaaattgaaaagttaattcttgaaatatgcaa

SEQ ID NO: 18050 - DNA, 820 bp, Diabrotica virgifera
  misc_feature (19)..(47): n is a, c, g, or t
  misc_feature (55)..(86): n is a, c, g, or t
  misc_feature (92)..(135): n is a, c, g, or t
  misc_feature (140)..(167): n is a, c, g, or t
  misc_feature (183)..(361): n is a, c, g, or t
  misc_feature (403)..(738): n is a, c, g, or t
  misc_feature (745)..(745): n is a, c, g, or t
  misc_feature (750)..(785): n is a, c, g, or t
  misc_feature (794)..(794): n is a, c, g, or t
  misc_feature (805)..(805): n is a, c, g, or t
cgtgagagaatcatcttcnnnnnnnnnnnnnnnnnnnnnnnnnnnnngtacctcnnnnnnnnnnnnnnnnnnnnnnnnnnnnnnnntcatcnnnnnnnnnnnnnnnnnnnnnnnnnnnnnnnnnnnnnnnnnnnncatcnnnnnnnnnnnnnnnnnnnnnnnnnnnncgtaatcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaaaatacgttattatttatcttttcatatattattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttaanaagcnnnnnnnnnnnnnnnnnnnnnnnnnnnnnnnnnnnngtttataanattattaatangttttttttagtatt

SEQ ID NO: 18051 - DNA, 210 bp, Diabrotica virgifera
  misc_feature (2)..(72): n is a, c, g, or t
  misc_feature (79)..(127): n is a, c, g, or t
  misc_feature (156)..(189): n is a, c, g, or t
  misc_feature (193)..(208): n is a, c, g, or t
cnnnnnnnnnnnnnnnnnnnnnnnnnnnnnnnnnnnnnnnnnnnnnnnnnnnnnnnnnnnnnnnnnnnnnnncatgacnnnnnnnnnnnnnnnnnnnnnnnnnnnnnnnnnnnnnnnnnnnnnnnnngaagctgatatttttttaccagacgagcnnnnnnnnnnnnnnnnnnnnnnnnnnnnnnnnnngtgnnnnnnnnnnnnnnnntc

SEQ ID NO: 18052 - DNA, 918 bp, Diabrotica virgifera
  misc_feature (21)..(61): n is a, c, g, or t
  misc_feature (63)..(95): n is a, c, g, or t
  misc_feature (104)..(128): n is a, c, g, or t
  misc_feature (130)..(216): n is a, c, g, or t
  misc_feature (218)..(294): n is a, c, g, or t
  misc_feature (296)..(347): n is a, c, g, or t
  misc_feature (349)..(383): n is a, c, g, or t
  misc_feature (385)..(410): n is a, c, g, or t
  misc_feature (412)..(469): n is a, c, g, or t
  misc_feature (471)..(484): n is a, c, g, or t
  misc_feature (494)..(516): n is a, c, g, or t
  misc_feature (538)..(550): n is a, c, g, or t
  misc_feature (552)..(855): n is a, c, g, or t
  misc_feature (871)..(872): n is a, c, g, or t
  misc_feature (895)..(897): n is a, c, g, or t
aataattatatcatttatccnnnnnnnnnnnnnnnnnnnnnnnnnnnnnnnnnnnnnnnnncnnnnnnnnnnnnnnnnnnnnnnnnnnnnnnnnncgaaacgtnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnncnnnnnnnnnnnnnnnnnnnnnnnnnnnnnnnnnnncnnnnnnnnnnnnnnnnnnnnnnnnnncnnnnnnnnnnnnnnnnnnnnnnnnnnnnnnnnnnnnnnnnnnnnnnnnnnnnnnnnnncnnnnnnnnnnnnnncgtcttttcnnnnnnnnnnnnnnnnnnnnnnncgcccaccgattaatttgaacnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaataattaccttannggatacagcgtaattttattggnnnagagtcaatcgataataaaga

SEQ ID NO: 18053 - DNA, 827 bp, Diabrotica virgifera
  misc_feature (763)..(763): n is a, c, g, or t
  misc_feature (778)..(778): n is a, c, g, or t
  misc_feature (797)..(797): n is a, c, g, or t
agaatatttaacaggctaaagtttaaatcacaatcaaattcaaaaaaagtacaagaatatcgaaatatcgcttaagtatatttcgctcgatctcgactttcgtgttcctccgtggtatcgaattaaattatttaggggaaaactttcgaggaaagggatttgacaaaacaggcgtataacaggcaaataacaaatcgttattgatacatttttttagccaaatcgtaatttttatggaattattaataaggaatatgtttaatgacagattcttcacaacataaacaatcagtaacagctttgacaggtgacagttggctgtatagttaatagggagaaaggccttttcatcatgtgacgaacgcaagcacagccgccctcagccgccacgttgatataaacatataaatacagcgccgattcaatattttcgtactgttttgatcaacaatggcaaggaccgcagtattatctccccaattggatcatgcattagaaaaaatcgataatgatgcttcacttatttataattcagttgaattccataattgtaagcaattaaaaaggtggttcaaatgtcatggacttccagaaaatggaaaaagaagtgagctgatttgtgaggttaagattaaacaattactctaattctgataataatactccacaaaatataattaagggctttttcatcgattggccttttggtttcgggcttctgtcatgtgacacatgacagaggctcgaaacaaatgactgtganatgaaagccctatanaaacatctgtttcctcaantcttgatcgagtttccaaagaaatatgatt

SEQ ID NO: 18054 - DNA, 908 bp, Diabrotica virgifera
  misc_feature (82)..(105): n is a, c, g, or t
  misc_feature (782)..(799): n is a, c, g, or t
  misc_feature (853)..(870): n is a, c, g, or t
  misc_feature (878)..(907): n is a, c, g, or t
cggacgcgtgggcggtaaccctacaccagaacctacagaactcctcgatcatgttgtgtggagtcctgtaaaagacgaaagnnnnnnnnnnnnnnnnnnnnnnnntgatagaatcagtattactggtaatgttgaagcagaaaggatacaattctggagagagttatatgcggaatgttgtggtacagcctaaaagtttctttgccgaaatttttgataaataatgcaaaaatgtgatttatttgtgtaggatagattgatacgatattatttgaatggcatgtttgtagcctactgttaaaacatcacatatctttgaaatgattttagctgtatgaaagtcaatgttttatatttactctcctgaaaaaacatcaatccagtataaaagccagtttgttcttcatttttaatagtcaatgcatagtcggaattttcatttgtaaagtccaagtatctaggacacaattcttctgacccaacatatatgtacttgtgcacttgctaagtatattacgttgtctttatacttgctctatactctttggagcattgaaatcgtgcatttactatataggaaattctacataatccttttctcataaaaatatgagtataactttgcaatttttgtcaaaatgtgatatttatgttcttgctgggttatctataagctacaagagattattactcctatttgagatattaaagatcatctgttgtttaaatgtagtatcgtagataatactcgtatcgaaagtattaatagataggtcaaatgnnnnnnnnnnnnnnnnnngacacttaaaattaagttatacatatttatgttatttatttctttaaaagaatnnnnnnnnnnnnnnnnnngtaaattnnnnnnnnnnnnnnnnnnnnnnnnnnnnnnt

SEQ ID NO: 18055 - DNA, 552 bp, Diabrotica virgifera
  misc_feature (160)..(485): n is a, c, g, or t
caaaatgttttgatatctcagagatcaatttgttatcttttcaagaggaaatatctatattatggtggaagtaaacatttccgagcaggaaaacaatgtttacaaagcttaattaatgattactagtgcctggcgtatcagggataacaatttaataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacttttgattacaagataacgagaaatcatcatatagctagtaatgatgatagtagtagtattaa

SEQ ID NO: 18056 - DNA, 971 bp, Diabrotica virgifera
  misc_feature (32)..(49): n is a, c, g, or t
  misc_feature (196)..(219): n is a, c, g, or t
  misc_feature (224)..(248): n is a, c, g, or t
  misc_feature (558)..(571): n is a, c, g, or t
  misc_feature (573)..(697): n is a, c, g, or t
  misc_feature (712)..(743): n is a, c, g, or t
  misc_feature (745)..(928): n is a, c, g, or t
  misc_feature (930)..(945): n is a, c, g, or t
  misc_feature (954)..(954): n is a, c, g, or t
atttctcttcaaatcataaaatcatcttctcnnnnnnnnnnnnnnnnnnctcttctctacagatagttaatctcgtatccgcgagagaatctctctcactcttctaaaagaaaaatctctcttttccgtacctccgtgtatcagggatctcttaattaataattaatcatcatttatctatccttcgaatcttaannnnnnnnnnnnnnnnnnnnnnnncaccnnnnnnnnnnnnnnnnnnnnnnnnnccccgtaatcgaaacgttattcgttttcaaatatcatctaattttttcaagaaataaattcaaatttcaatcttcaatctcaacaatatcatttcaatcaattcaaataatttttcatcattaatctaataatctagaataatctttctcaagggatcagagctctcaaataatcaaatatccttcaatctcaaaatttcaatcttttcaaatcaaaaattcaggattcaaataatttctcataatctttcaaaatatcggttatctaatcttaatttttcatcatcattaataatctttctctttttcnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaaaacagnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnattattaantaagtttttttagtatt

SEQ ID NO: 18057 - DNA, 889 bp, Diabrotica virgifera
  misc_feature (300)..(314): n is a, c, g, or t
  misc_feature (316)..(348): n is a, c, g, or t
  misc_feature (674)..(696): n is a, c, g, or t
  misc_feature (761)..(783): n is a, c, g, or t
  misc_feature (845)..(864): n is a, c, g, or t
  misc_feature (870)..(870): n is a, c, g, or t
ttaagacagaggaaattcaggaaccaaaagtaatttgcaatgaattagatttgaatgaagaacatcagacaagtcaacatggtgttcttcagagtgtggtcaaaactaaatctggaaaatccttggccacagacaccagagaaaattcgtacaagtgtgaaacgtgtttaaaggaatttagtcaagagggacgtttgaaaaaccatttaagaatacatactggagaaaagccattcaagtgtgatatttgttgtaagcaatttagtcaaaatggtaatttgaaaaggcatatgatgagannnnnnnnnnnnnnntnnnnnnnnnnnnnnnnnnnnnnnnnnnnnnnnngtgaagttttcttcagagtgtggttaaaactgaatcagaaaaatctttaaccacttacatcagagaaaattcgtacaagtgtgaaacatgtttaaaggaatttagtcaagagggaaatttgaaaaaccatttaagaatacatactggagaaaagccattcaagtgtgatatttgttttaagcaatttagtcaagagggaaatttgaaaaaccatttaagaatacatactggaaaaaagccattcaagtgtgatatttgttgtaatcaatttagtcaaaatggacatttaaaaacgcatttaaggatacacactggcgaagaaccgnnnnnnnnnnnnnnnnnnnnnnngcaatttagtcaaaatggacatttaaaaacgcatttaaggatacacactggcgaagaaccgtatnnnnnnnnnnnnnnnnnnnnnnnatttagtcaaaatggacagttaaaatcgcatttaaggatacacactggagcaaaaccgtatnnnnnnnnnnnnnnnnnnnncagttngctcatgtaggtaatttga

SEQ ID NO: 18058 - DNA, 949 bp, Diabrotica virgifera
  misc_feature (421)..(440): n is a, c, g, or t
  misc_feature (772)..(793): n is a, c, g, or t
  misc_feature (850)..(876): n is a, c, g, or t
  misc_feature (915)..(915): n is a, c, g, or t
acggatgtcttggatagccaggcacagagaagggctaggaaaaatcgttagcagatttccgccagctacttgtcggaataataagtttttcagatataccgtaccaataataatttttgagtatcctgattaactttaagttatgtaacctaggattttagaccctcaccgattttgagcttaccgaatttgaccctcaccaaaaatgtccctattacaggcgtttgatacgcgttagttatcaccagtcctaaggaaacaataactattaccatctatctcatatgcaagtatgtcatcccgtatttctaatgtctaacttttctccagtataacccaattcttttgttttcgaaaaactagtaacgtacctctatgtctgaatttcatggtttgtttcttttatggccatgttcctacnnnnnnnnnnnnnnnnnnnnactcatataacatttacgctgtgagtgaacgtagaaatgtgaaaatatgtgattaagtccgcttatagacgtgaggataaatacgtatacctcaagtcgagagatataatgaaaatctctatatgtcaagccacaaaggctacaattctccttccattttagtgtaatagtatggtcgtttgaataaattttatctaaattttctttggatgtatgaatttgtcttggtcgtttcgttacgtgtgtttccacacccatagtccgatctaaatcgcgctagcgagctttagttcgtgaaggaggttgtgtaacgatccgaaataagtataccnnnnnnnnnnnnnnnnnnnnnnctcttttaattcacaccgattacttgcatgacgtaatcataataataagtggtcacnnnnnnnnnnnnnnnnnnnnnnnnnnncaacgcaacaaatccataacgaaagtcattttttctgantatccaccgactaactgtcactgtctaataatca

SEQ ID NO: 18059 - DNA, 973 bp, Diabrotica virgifera
  misc_feature (21)..(51): n is a, c, g, or t
  misc_feature (766)..(766): n is a, c, g, or t
gtacggccttgcagggtaccnnnnnnnnnnnnnnnnnnnnnnnnnnnnnnncacggcaggtccggtggtagagataaaaaatttcagcctcactctcagagatcgacctacgaaattcgaacgagaaacttcgatctcgaaatcgaatgagaaaatgccgaccttagtgtacaagtaatccaattaatcagaaacgtctagaagaagccgagggtggtgcagaatgtcagttcgaaatcaacaaaaaacgcgacacagaattcgctcgatgctttcgcaaactaactagaagaacgtacacatatgatgtctagaatgaaaactcggcccttcattccttcaaagaatgaaaacaatcaagaaaatcggtcgtcgactttccaagaaacaatttcggtttcctctaagctaaaaggctaaaattcaaagacggccgaaaaaatgaaatagaggcaaaatttccaaggccggaaaatctaaccaagcttcaattcggcccatagagtcgtaataggcggttcaaccaaaggaaacggcttcggaattcttccaattcataaacaaatcggtggaggaataactatagaataattcaactcaggtcaaacggaggcttcaaacattcaagaaattcgatgagaggctctaaaccggtttccggtcggttggacattcaaccttcccaacaaggaacccggtcttcttcccaaggaggaaacaattcgaggcttcattcaatgggaatggtccaaggaaccttcaagangtcaaataattcgaattaacggccattctaaccttcaaggaggccaggcttcggccagggccaaactctgatgggaatggcccggccaggtcgtggctcgaaagaacgaatggaaaggaagaacggcttcccttcttcggagggccaaaccttccaccaagggtcgaggaatcgaaacttcgaaattctaggtccggggtggcaaac

SEQ ID NO: 18060 - DNA, 632 bp, Diabrotica virgifera
ctcgtgtcagacggggggttctgtctgctgcatattatgaacttgactcgctattttactatcgctcaaccctgaccccatcaacacttacgttagtcctattagtagtagccgccacaataggtaactccctgtaggaccggttcctccagtgagaagtatgcgaccccatatgaatcctgacccatcgcgccttttgtatcactataacccatgtgtcgatgtatgcccacagtcaagcgctaatgacactgggagattaggaacttgccctgtaagataagttctattccaaatgctgatgcagatgaaatatatacggaggtttctcatgactaccatgaatgagacatgcccggcggacatagagatttaacgaaaggtcgtagtcgctggcactggtcatgatctttcacagagatggagaggctttactcatggtcctcagaaatggatgtacataacttagtccaaggacatactggcaaaaataacgatcttattagatcacaacaagctccctcgttaccagaagaaacgttactagctatgtctgtgattgctactaaatacagagtagagcatcaatttatatctatatatatactagaacatatagcttttagtaatga

SEQ ID NO: 18061 - DNA, 920 bp, Diabrotica virgifera
  misc_feature (71)..(89): n is a, c, g, or t
  misc_feature (845)..(845): n is a, c, g, or t
ctactttaatttttgattgtaatccgtttaaagagccagccattacacttgcaccatcgtaaaattgagcnnnnnnnnnnnnnnnnnnntcatatggctcaagcacgtttgaaattaaactatatagagcgtctgcagatctattatcgctaacatcaaaaaaccctaaaaatctttctgttacctgaccaactttgttaacaaaacggattgttaaagtacactgtgatttttcggttatatcagtagtatcgtcagctagtatagaaaaaaattgactttcattaatttctgttgaaatttcatttttttacgtaatcggcaagacaatctattaaatcattttgtattgtttttgacaaacccgtgaacaccccttctattttttaacatgatcctggatttcctgatcgcgtttaactactaaattaaaaatttctttaaaattacccatgtttgaagaattatggctctcatcacgaccgcgaaatgtaagttcttgtttctttttgtaacttcttcattatatatcttattagatagagaaatatgtccagcgaaagcactgtcagtagtttgtttatttttttctaaccgttttaaatctaagcaattgtttaaatgttctttcgaagattcatgtttttttacactagctgataaatttttcaaatctgaatatcccagactcacccaaacattttgcttcaaatttgagagcaacagacaaggccaacagaaaagtgaatttttaaaataacttccgcttagccatttatgattttcataccatattgttttaaacgatctcgaaaatggttgattgtcttttgtcttatctgtgnataaaatgttaaattttgtaaaggccgggtcaattgaataattactaatctttcttgattttggcgccttgaaaa

SEQ ID NO: 18062 - DNA, 786 bp, Diabrotica virgifera
  misc_feature (116)..(133): n is a, c, g, or t
  misc_feature (191)..(224): n is a, c, g, or t
  misc_feature (230)..(253): n is a, c, g, or t
  misc_feature (284)..(299): n is a, c, g, or t
  misc_feature (301)..(349): n is a, c, g, or t
  misc_feature (386)..(439): n is a, c, g, or t
  misc_feature (442)..(456): n is a, c, g, or t
  misc_feature (522)..(541): n is a, c, g, or t
  misc_feature (565)..(595): n is a, c, g, or t
  misc_feature (599)..(644): n is a, c, g, or t
  misc_feature (674)..(695): n is a, c, g, or t
  misc_feature (718)..(737): n is a, c, g, or t
aaaaaaaagaggcgatttttctttctctttcaaataataaaatcttttctcgtaaatgtaaagaaaaattttcactacacatagttaattcgtatcccgagagaatatttcactcnnnnnnnnnnnnnnnnnnctcccgtacctcgcgtatcagggattcttaattaataattatcatcatttaatctccnnnnnnnnnnnnnnnnnnnnnnnnnnnnnnnnnnctatcnnnnnnnnnnnnnnnnnnnnnnnncttttcgtaatcgaaacgttactcgttttcnnnnnnnnnnnnnnnncnnnnnnnnnnnnnnnnnnnnnnnnnnnnnnnnnnnnnnnnnnnnnnnnnctttcatactactaatattaaataattttcagggacnnnnnnnnnnnnnnnnnnnnnnnnnnnnnnnnnnnnnnnnnnnnnnnnnnnnnnggnnnnnnnnnnnnnnnatattttcaaaatacgttaataattcattttcacaaatcataattttcatttttctaaatttttcnnnnnnnnnnnnnnnnnnnnctttcaaatttaagtaatggatgnnnnnnnnnnnnnnnnnnnnnnnnnnnnnnncagnnnnnnnnnnnnnnnnnnnnnnnnnnnnnnnnnnnnnnnnnnnnnncacccggttaataaaaacacgtctttttgnnnnnnnnnnnnnnnnnnnnnncgcccacggattaaattgaatannnnnnnnnnnnnnnnnnnngtaaggtagcaaatcattaagttttttattggaagtggaatggagggtt

SEQ ID NO: 18063 - DNA, 741 bp, Diabrotica virgifera
agattgaccgagaggtcttggggatatgctagtattacgctattactacctgatgaataaagcgactccggtatattatatcttctttacaatgacagtatcctatatatcaataggaggatgaaaacatgatgtgaataggaaagaactttgaggataatcttacgctccaagaaacatcaacataatgatgagagactaacggagatgaggacaggtactcttatctatgctaagtgaagaatgtgaagctattaatgctttcgatgcatgatcattatggaattactgtttcgaggttatcagcactatcgacaaccaatctgattgaggatcttgatgccgaaggtctgtattatctgaaacggatgacagacgtatgtgacaacacccatatttcagcctaaagagcctgttctctgtgtgaatactcattgacctgtagaaaagattgtggattggaactgtgacactatatatatatatagatgcatgaatatgtttggatcatcatggaattactacaggaggatgtttacgatgtgcaaccacttttgacgatcatattcgcttctgccttgtgaacatcgtacacatgatactagagcgcgatgtacaactttgtgctacagcacaccttcttggagaacatatcgatgtgacgataccggactaaattataagtccgagtgaacttatgtctcaagtccagcgaattactatactacagatccctctatg

SEQ ID NO: 18064 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18065 - DNA, 91 bp, Diabrotica virgifera
  misc_feature (3)..(3): n is a, c, g, or t
  misc_feature (44)..(44): n is a, c, g, or t
tanattaccttagggataacagcgtaattttattggagagttcnaatcgataataaagattgcgacctcgatggtggattaaagtttataa

SEQ ID NO: 18066 - DNA, 55 bp, Diabrotica virgifera
  misc_feature (2)..(23): n is a, c, g, or t
tnnnnnnnnnnnnnnnnnnnnnnctctacaactccaaagattccaacttcacacc

SEQ ID NO: 18067 - DNA, 830 bp, Diabrotica virgifera
  misc_feature (682)..(682): n is a, c, g, or t
  misc_feature (715)..(715): n is a, c, g, or t
  misc_feature (809)..(809): n is a, c, g, or t
gcagtggttagataaagaagtgtagacttagctataagaaattgccaatatgccagaggatactcaatcggatgtaactttaagcaactcaagtagaacttcagtgccttttccactagccagttatgaactggaatttgccgaatccattcaacacccagaaagattttgggccaaagtaggtcaatatgtaacatggtccaaaccatggaagagggtgttggacaacacgtacgaaccttttacgaagtggtttgtgggaggagaactgaacgcttgttataatgctgtagatcgacatgtagaagcaggcaaaggtgacaaagttgccttaatttatgactcccctctactgggtattgtacgaaaaatcacatactttgagctacaagaaaaagtctcaaaacttggtggtttgctgcaaaggttaggggttagtaaaggagacaaagtcatcatatatatgcctctcatcccagaaacgattatggccatgttagcagttgcgaggataggagcagtacactcggtagtctttgggggtttcgccgcaaatgaattatgtataaggatccagcacgcagaaccaaaagtgataatagcagccagttgtggaatagaacccagtcgcgtagtcaattacataactgaactgaacgaggccattgctttatccagccancaaccgtcaaaatgtataatttatcaaaggaanggagtagagatcggagatctggatccagacagagatatggattgggaagaaaagcatcaaaattgtgaagtgctccttgtatacctgtagatgnccacgatcccttatatatact

SEQ ID NO: 18068 - DNA, 400 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcggtatctttattatggattagaactctatgttatactttcgtgggtataccgatgctgattgatgataatgagatctatgtgttataatcagatttctgatttaatatgtatctttaataaatataccgttttattaataaagcccgccacggtgtagtctgacttcgttattatcttttgtatacgcatcaggattataggctagcgtatgatagaattctgatactatttatttttatctataagcattg

SEQ ID NO: 18069 - DNA, 625 bp, Diabrotica virgifera
gtctactctaccaccagccattaagaaattattgaattttagtgttattttatttaaagttaagtaataataattagtattattacattatctctattttaaattacgccttgagctggtggcgtggaaaggttcagaatgaagggggatgatggtaagacccaggaacctgatccgtccaggaaactattcattgacagccgtttttgaacgatgtaatgagatggaatattattcgctttaccattgtgacattctcatgtggatgatcgaaaagtggcctgtgggtcacttctgaaaagattgagatgtgttttggatagagattcggcattgctagatttacttgatggctgtccaactcccgagtcatcacaagtacctggacatcatgaaactctactaaaagcttgattgcagatacgtgatgtcgtctttctggaagacattccaggatagtacactatctgtgacgacgtaacatataagctgtcccgttgcaggaagttacatatgatgcatgtgaggagtctgggattatataacgaagcacacctctcccagtagtgggacgttcttctaccactaataaatgcctgaatgatcaaaagcgtttgactatgca

SEQ ID NO: 18070 - DNA, 719 bp, Diabrotica virgifera
  misc_feature (182)..(205): n is a, c, g, or t
  misc_feature (241)..(299): n is a, c, g, or t
  misc_feature (305)..(323): n is a, c, g, or t
  misc_feature (340)..(370): n is a, c, g, or t
  misc_feature (386)..(460): n is a, c, g, or t
  misc_feature (474)..(499): n is a, c, g, or t
  misc_feature (554)..(584): n is a, c, g, or t
  misc_feature (607)..(643): n is a, c, g, or t
  misc_feature (651)..(668): n is a, c, g, or t
  misc_feature (670)..(712): n is a, c, g, or t
gccttgcaaacttttatttattgatagataattaatattgagcgagcagattctatccttataaaacacaaatttatgtttttgtaccttgggcatccggaattattaataaatatgtatctctttattatttccttattccaaagacgctaaacaattacattatttattgtaagatctcnnnnnnnnnnnnnnnnnnnnnnnngtaatgttattcagtctttaaatactatctaattgnnnnnnnnnnnnnnnnnnnnnnnnnnnnnnnnnnnnnnnnnnnnnnnnnnnnnnnnnnntcatcnnnnnnnnnnnnnnnnnnntatgagcttataaatcnnnnnnnnnnnnnnnnnnnnnnnnnnnnnnncaataggatcatcacnnnnnnnnnnnnnnnnnnnnnnnnnnnnnnnnnnnnnnnnnnnnnnnnnnnnnnnnnnnnnnnnnnnnnnnnnnnctatcaatctatcnnnnnnnnnnnnnnnnnnnnnnnnnngattatgattactaaattgtatatttagtccgaatatataggtttaatacagggnnnnnnnnnnnnnnnnnnnnnnnnnnnnnnngaaacgtgtctttttgaattagnnnnnnnnnnnnnnnnnnnnnnnnnnnnnnnnnnnnnaccgcgannnnnnnnnnnnnnnnnnannnnnnnnnnnnnnnnnnnnnnnnnnnnnnnnnnnnnnnnnnnatgtatg

SEQ ID NO: 18071 - DNA, 896 bp, Diabrotica virgifera
  misc_feature (5)..(22): n is a, c, g, or t
  misc_feature (27)..(46): n is a, c, g, or t
  misc_feature (89)..(116): n is a, c, g, or t
  misc_feature (199)..(219): n is a, c, g, or t
  misc_feature (304)..(323): n is a, c, g, or t
  misc_feature (416)..(434): n is a, c, g, or t
  misc_feature (441)..(467): n is a, c, g, or t
  misc_feature (480)..(510): n is a, c, g, or t
  misc_feature (522)..(547): n is a, c, g, or t
  misc_feature (560)..(594): n is a, c, g, or t
  misc_feature (645)..(697): n is a, c, g, or t
  misc_feature (722)..(743): n is a, c, g, or t
  misc_feature (750)..(889): n is a, c, g, or t
  misc_feature (891)..(892): n is a, c, g, or t
ttttnnnnnnnnnnnnnnnnnnttacnnnnnnnnnnnnnnnnnnnntcatcttacacgatcagttaattacgtaccgtcgagagaatannnnnnnnnnnnnnnnnnnnnnnnnnnncacctccccgtacctccgtcgtatcagggatctctcaatcaataatctcacatcatctctcatccatccctcgaatctctaannnnnnnnnnnnnnnnnnnnncttctcaccgtaaaataaatatcttcaaatcaattctcctcgtaatcgaaacgttactcgtttctaaatatcatctcaattcctnnnnnnnnnnnnnnnnnnnncatctctcatctcaacaataatcatcttcaatcaattcaaataatctcttcatcatctcaatcaaataatctcaaatattctttcagggatcnnnnnnnnnnnnnnnnnnnctcatcnnnnnnnnnnnnnnnnnnnnnnnnnnncaaggattaaaannnnnnnnnnnnnnnnnnnnnnnnnnnnnnntcatctcatttnnnnnnnnnnnnnnnnnnnnnnnnnnctaaatttttctnnnnnnnnnnnnnnnnnnnnnnnnnnnnnnnnnnngtaatggatggataataatctaagtatctaaaaaaattcggtatcatttannnnnnnnnnnnnnnnnnnnnnnnnnnnnnnnnnnnnnnnnnnnnnnnnnnnngttattaaaaacaggtctttttggnnnnnnnnnnnnnnnnnnnnnngccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannaagc

SEQ ID NO: 18072 - DNA, 908 bp, Diabrotica virgifera
  misc_feature (10)..(27): n is a, c, g, or t
  misc_feature (36)..(57): n is a, c, g, or t
  misc_feature (192)..(226): n is a, c, g, or t
  misc_feature (231)..(258): n is a, c, g, or t
  misc_feature (273)..(388): n is a, c, g, or t
  misc_feature (390)..(455): n is a, c, g, or t
  misc_feature (511)..(649): n is a, c, g, or t
  misc_feature (651)..(846): n is a, c, g, or t
  misc_feature (853)..(883): n is a, c, g, or t
  misc_feature (888)..(888): n is a, c, g, or t
  misc_feature (893)..(894): n is a, c, g, or t
  misc_feature (898)..(898): n is a, c, g, or t
  misc_feature (900)..(901): n is a, c, g, or t
ttttctctcnnnnnnnnnnnnnnnnnnttttcttcnnnnnnnnnnnnnnnnnnnnnnatctctaacgatagttaattcgtatccgtcgagagaatatctttctttctctctcaaaagaaaaattcatctctctccgtacctcgtcgtatcagggattatctaattaataattcatcatcattcattatctcnnnnnnnnnnnnnnnnnnnnnnnnnnnnnnnnnnncctcnnnnnnnnnnnnnnnnnnnnnnnnnnnncgtaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncattttaaaatacgttattcatttatcttttcatcatcattatctatttttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttannnnnnnnnnnnnnnnnnnnnnnnnnnnnnngattntattnnttangnntaaaagc

SEQ ID NO: 18073 - DNA, 468 bp, Diabrotica virgifera
tagatcgctcgatatagggaaagctcacgatacacaaggattaaatcaatatgtttttccccgcttgtgacgcagacggcctacccaaccaagttcatagttatcagttctgtcgtccctcccctcaacgcaaacttgctattgaacaccgctacgatcattaaaatgaacattcaccccgtccacgccctggaattgatattaacctttcaccaaatgtcgtcagaaagtcattgtacaacaactcactaaatgtaaccgcatagatgtatatgtatcttcacggcaaaccgcataacctgcgcttcaactgaggcacaaaatcttatccgcactcagaatgcaactgccaaactgacaatcaaaaaaatcgccgcatgcatggcaatgcgagatacctcgttcgcgcgctctacttcgattcagtctaatagatacaggtaggctcttacacctaaaaatgttatt

SEQ ID NO: 18074 - DNA, 573 bp, Diabrotica virgifera
  misc_feature (65)..(78): n is a, c, g, or t
  misc_feature (81)..(103): n is a, c, g, or t
  misc_feature (111)..(133): n is a, c, g, or t
  misc_feature (163)..(194): n is a, c, g, or t
  misc_feature (201)..(329): n is a, c, g, or t
  misc_feature (335)..(360): n is a, c, g, or t
  misc_feature (498)..(518): n is a, c, g, or t
taacagcgtaattttattaggagagttcaaatcgataataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccgnnnnnnnnnnnnnnnnnnnnnnnnnngagggatgggaacgaaaaaattcttcaaaagggccccctaatttcaattcatgggccgtctttttacaacggcgggactggaaaacccttggggttccccacttaaatcgctttgcggaacttccccttttccccggnnnnnnnnnnnnnnnnnnnnncccccccaatctcccttcccaaaagttgccccccttgaagggggaagggaacccc

SEQ ID NO: 18075 - DNA, 938 bp, Diabrotica virgifera
  misc_feature (7)..(30): n is a, c, g, or t
  misc_feature (34)..(57): n is a, c, g, or t
  misc_feature (132)..(147): n is a, c, g, or t
  misc_feature (149)..(164): n is a, c, g, or t
  misc_feature (177)..(215): n is a, c, g, or t
  misc_feature (217)..(248): n is a, c, g, or t
  misc_feature (257)..(780): n is a, c, g, or t
  misc_feature (783)..(784): n is a, c, g, or t
  misc_feature (789)..(811): n is a, c, g, or t
  misc_feature (817)..(931): n is a, c, g, or t
atttatnnnnnnnnnnnnnnnnnnnnnnnnctcnnnnnnnnnnnnnnnnnnnnnnnntaacgatagttaattcgtatcgtgagagaatatctcttctttttatcaaaagaaaaattcatttttcgtacctcnnnnnnnnnnnnnnnncnnnnnnnnnnnnnnnntcatttattatcnnnnnnnnnnnnnnnnnnnnnnnnnnnnnnnnnnnnnnncnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaannttatnnnnnnnnnnnnnnnnnnnnnnngcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttt

SEQ ID NO: 18076 - DNA, 629 bp, Diabrotica virgifera
gtccccctattcgtccgctaccatattcttttgagaaaagttttacactcctccaacaacacgtatctcgctgatcccgttgactttatgaaggatttcctcgctgtagatatttaagtcgcccccccaaaaacatgtgtacctcccatcgaaagggtaaagatgcttttggaagaacaagagatttccaatgaaatcggtgaagataagccttacgaggagatggaagagtgattcgaacgtatattaaaggaagagggagttgttgcataatgaattgtgaatgcaggtaagagattgagatattttgtgtgattagagatataagtgtacttaaagaagtaataatagtggatattattgaacgagagatatagagaaagaaaaatcaacgaataatgcatatgatatttggaataaggtgatgtggaaagaatggcttgtgattgggatgtataagactagatgttagcataagaattgaagatggtgaagtagaaatttataaagatgttaatgatgttgatggtatatatgagggaattgatgaggaataagcaggatatctgagtatgaggaagagaagcagtgataggaataataattgataagaattcgtagtggaaaag

SEQ ID NO: 18077 - DNA, 613 bp, Diabrotica virgifera
  misc_feature (311)..(328): n is a, c, g, or t
  misc_feature (396)..(417): n is a, c, g, or t
  misc_feature (494)..(512): n is a, c, g, or t
cagcgaggtacatctgaaataccatcgcatcggctgaagatcgtcaattttttcgaaataattaccgtaagaactgtcaaatttcataacattgaatgagaaagtgattgtggagtgtttgtgattgaggttgtttattgttttaggtatttaacatttcttattttagcagtatttgagatttttttagctttgtacttgtatatttcattgtataacgaagatttttgatacgtattgtgactggtcttgagattcttcttaatatatgagaatatatttactaagaactgtgtaatgaattaattacnnnnnnnnnnnnnnnnnntcgtaataatcaatatatgctgagcttgaccttatgaactaattgtgaacactactgcaatgataagnnnnnnnnnnnnnnnnnnnnnnctcgtatttaaaattatgtgctgatatatgattatataatattatttccaataattaataacagatctgttagacgnnnnnnnnnnnnnnnnnnngatataggtcagagggtaagagtagcgttacttattatgtttatgtattcaaaatatataggataaatatggtccgtctagcacatgtttttctgactgct

SEQ ID NO: 18078 - DNA, 51 bp, Diabrotica virgifera; identical to SEQ ID NO: 9123
  misc_feature (2)..(44): n is a, c, g, or t

SEQ ID NO: 18079 - DNA, 192 bp, Diabrotica virgifera
  misc_feature (2)..(17): n is a, c, g, or t
  misc_feature (23)..(62): n is a, c, g, or t
  misc_feature (70)..(182): n is a, c, g, or t
cnnnnnnnnnnnnnnnnccgtgnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgt

SEQ ID NO: 18080 - DNA, 169 bp, Diabrotica virgifera
  misc_feature (8)..(45): n is a, c, g, or t
  misc_feature (80)..(102): n is a, c, g, or t
  misc_feature (110)..(131): n is a, c, g, or t
taacagcnnnnnnnnnnnnnnnnnnnnnnnnnnnnnnnnnnnnnntgggacctcgatgttggattaagtttataattggnnnnnnnnnnnnnnnnnnnnnnntggtcgannnnnnnnnnnnnnnnnnnnnnagtttaaaccgtgtgaggccagggtggtttctatcttt

SEQ ID NO: 18081 - DNA, 612 bp, Diabrotica virgifera
  misc_feature (12)..(43): n is a, c, g, or t
  misc_feature (57)..(79): n is a, c, g, or t
  misc_feature (340)..(358): n is a, c, g, or t
  misc_feature (471)..(489): n is a, c, g, or t
cccctaaaggcnnnnnnnnnnnnnnnnnnnnnnnnnnnnnnnnccttctcaaacacnnnnnnnnnnnnnnnnnnnnnnngagataagtaagatggaatgtgagaatttaatttattacccccaacgagttatttgtttgtggagacttgtgtaggaaggaatattaatgaatatatatgtatttaatattttcgaaggagatgtagaaaaaaggagaagtagttttaatgaaaaataactagttaattgaattgatttggatgcgaagtgtcatatggtgttaggtatgattaagatatagaagaagtactttattctttctatatggatagatgattannnnnnnnnnnnnnnnnnngtataaatattaagtatgcgttaggaaagtgcataagaatagaattttattagatgataagtttgtagtagtaagaaggataagttattttgatagctgagaagaggttatannnnnnnnnnnnnnnnnnntgtagtagttattaataaagttataattatgatataaatgcatatgattttaatgtaagtaatgatgggaatatttgtgttatagtagtggatatttagtgggaataaataggtgtaagaagg

SEQ ID NO: 18082 - DNA, 91 bp, Diabrotica virgifera
gaaaccaacctggctcacaccggtttaaactcagatcatgtaaaattttaaaagtcgaacagacttaataatatagctgctacacccgcga

SEQ ID NO: 18083 - DNA, 963 bp, Diabrotica virgifera
  misc_feature (724)..(760): n is a, c, g, or t
ttactgcacggtggttttaggttagggtaacttgtcacataaatttttataagaaaatctggattttactattctaaacaatggggacgtgtagtgagtacattaaaaatgtttttcctgcgatagatgaagaatctaaacaatatgtagaaggtgtattattaaatggtgcggatgattttgaggatagtgaagaagtatatgatgcagtaggagaagttctaaaagaaatttcgaacgacaagtccgaagatgatattagaaatatctgcaatgatcttctatgcatgttaaaaccggataaaggagaaaaggctactaacggggctatgaaagttttaaatgcgccagtacatttggggtcaatggtagacaatacggatacaaatattgatgatgttaaaagtatatggcttatacaacgggatgattctctgaaagtcgatgcaagaaaactagaaaaagctgaagctaagctacaagaaaaattagacaagagaacgaaagaaataaaggttatagcaccgcccaaactacagaccgctacagcatcgcaagttaccagcaaaaaggacagcaaactagaagccaaaggtaccaataggacacaggacataagaatagaaaacttcgatgttgcgtatggagatagggttttgcttcaaggagctgatctaactcttgctagtggtagaagatatggtcttgtaggtagaaacggttnnnnnnnnnnnnnnnnnnnnnnnnnnnnnnnnnnnnnccaattaagaataccctcccacatatcaattcttcatgtggaacaagaagttgtaggtgatgatactgtagccttagatagtgtactagaatgtgatctgtgcccgaagaaatgttaaaaaaggaaaaagaaattagtgctgcaattaataagtggatcggttgatccacaactaaacagtcaattgacagaagtgtataatc

SEQ ID NO: 18084 - DNA, 879 bp, Diabrotica virgifera
ctatatgaatgtcgctatccttgtttcacaccctgcgtatcttgcatgagctaccccttatagacccaagctgataaattacatccattgcgaaagcgattagggaagagtaaagaactacccgtaatctgtgattgtgtgcgaatccactcctagctacatgccagagggtaatctgtgccatacgacctcacatggagtgaccagttttgcactcatagcttagacgatactgagatgtaaagcaagcatttgtagagactgaatcgcaaagattcagagcatgaagaagagacagtgttgagcacgtagctatatcatgatggcaacaaggcacacaaaccaatgttgcaagaaatagtaagcactcttgagcgatattgatattgtgactgcacgcagatcattatcatgtaagcgtatatctagcatcgccatactcttcatagttagtagcttagtaatcgttatctctagcctgtctagaatgtatctcaatatttctgaaacaacgacatatatgtatatgtcatctataataccctacatgcgctactgtagtttgagatcagtaatcagttttagacatgtgctacttcgccggacggtgatagtagttcatctgttcacccgagtgtgccatgaccaatgctatgtcctatcgaacctctgtgcttagatctgtatgacgaaaccactaacagaggacaatgagcgactcatcctcgagctgtactagctgaatgtgactttaaacaggatgtctaccagatagctaacagatgcacccatgcattttcgaacatatacactgacctgatgcgatcgatcctagatctagtagcgctacttagaaagctatatcgtatgatgatatga

SEQ ID NO: 18085 - DNA, 732 bp, Diabrotica virgifera
  misc_feature (59)..(59): n is a, c, g, or t
  misc_feature (146)..(163): n is a, c, g, or t
  misc_feature (183)..(214): n is a, c, g, or t
  misc_feature (216)..(297): n is a, c, g, or t
  misc_feature (306)..(419): n is a, c, g, or t
  misc_feature (421)..(486): n is a, c, g, or t
  misc_feature (500)..(518): n is a, c, g, or t
  misc_feature (520)..(552): n is a, c, g, or t
  misc_feature (554)..(731): n is a, c, g, or t
agcagtccgattctttcatcttatctttcaaaatcaatcaagaatatctctctctccangtaaatagtataagtaaataattcttcatcttcaatcggatcagttcaatctcagtatctcgtcgagtagaatatctcttcattttnnnnnnnnnnnnnnnnnntatcttcttccgtacctccnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncattttaaaatacnnnnnnnnnnnnnnnnnnncnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 18086 - DNA, 158 bp, Diabrotica virgifera
  misc_feature (8)..(28): n is a, c, g, or t
  misc_feature (61)..(79): n is a, c, g, or t
tttttagnnnnnnnnnnnnnnnnnnnnngtaaagtaaatttatttatgaacaatataatcnnnnnnnnnnnnnnnnnnnttgattcatactaacatatttttagtatatctcggttaagcagataataaatatcaatttatagctattgattaattaa

SEQ ID NO: 18087 - DNA, 837 bp, Diabrotica virgifera
  misc_feature (764)..(764): n is a, c, g, or t
caacactaagagacgccgatctccgaattttctcgcctttttgcccctcgaaaatccgaaaaaatggtttatgaaagcgatttttacacgaccaggaggccctatcgtgccactccttccgtttcgtcttacactatttcgggtgtgccttctcgacaagtcagggtattgccgggattagggaaggttcacgtaacgtatacatacgaccgcatcgtaccgtacgtggggcacaagcggcttacggtcgtaacggcccctcccagagtatggggaacgcgaccaagtgttcttcagcgcgaattcgaccgtatcgagaacaaaatccgtccttggaccggttattccgcgactaatcgctacctcaactccaactccgctgtgatattcgatgacgagacgagacttattcgcgctcaaacggcgtctctgttgaaacggattcatgacccggttcctcgtgtccaacgatacagctggcccgcggtcgctgcaaaatacgataatggtcttccggccagactacataacgacaactacatccaccggttgttagtgacctcgcctaactctaaaaccgaatacaccacctattacacggaacccgttaaaaaatatatcggcgacagagtatacagccgcaggccccacatctacctctacgaagatcccttgaagaatgacatccaacttttgagctactacatcaacaagttcaagcaggagaaagctattactgcaagcagtgagcctgctaaagctgncaaagttgagaaagctcagtctcctgagaaagaaacagagaagccagaaatcacagaaataccgaataaccaa

SEQ ID NO: 18088 - DNA, 839 bp, Diabrotica virgifera
  misc_feature (5)..(27): n is a, c, g, or t
  misc_feature (36)..(79): n is a, c, g, or t
  misc_feature (82)..(96): n is a, c, g, or t
  misc_feature (98)..(117): n is a, c, g, or t
  misc_feature (132)..(242): n is a, c, g, or t
  misc_feature (255)..(432): n is a, c, g, or t
  misc_feature (434)..(800): n is a, c, g, or t
  misc_feature (808)..(808): n is a, c, g, or t
  misc_feature (822)..(822): n is a, c, g, or t
tttcnnnnnnnnnnnnnnnnnnnnnnnctttttacnnnnnnnnnnnnnnnnnnnnnnnnnnnnnnnnnnnnnnnnnnnnccnnnnnnnnnnnnnnncnnnnnnnnnnnnnnnnnnnnatttttcgtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttttnaagtaaaagcttanatttttttaaagacgag

SEQ ID NO: 18089 - DNA, 933 bp, Diabrotica virgifera
  misc_feature (441)..(462): n is a, c, g, or t
  misc_feature (767)..(767): n is a, c, g, or t
  misc_feature (774)..(774): n is a, c, g, or t
  misc_feature (850)..(850): n is a, c, g, or t
  misc_feature (857)..(857): n is a, c, g, or t
  misc_feature (867)..(867): n is a, c, g, or t
cagaatgataaataccaaaaaaacaacagagattgaaaaagaaacagaacaaaccctacaaatgatattacaggagttgaaaaaattaaatgaaagggtcacttccctggaatatagagctcaaagtgctattccaaaggtaagaaatggctaatgatcttagaattgtcgcatggaatgccaacgggttgcttaatcatcaacaagaactacaagcaatccttgacatcgaaaaaattgatttgtttcttgtctctgaaacgcatttcacaaatcaatcctacatcaaatttaaaggatataaggtatatcatacaatacaccctgacaatgcggccaaaggaggcagtgcaatcatcataaaggataatatatgtcatcatgaagagttggaatataaaactgaacatattcaagccactacagtacacataaaaactnnnnnnnnnnnnnnnnnnnnnngttcaatatactgcccacctaaacattccattaaaaaagagcagtataatgaattcttgaaaagcttaggggaaaggttcattattggagatgacttcaatgcaaagaacacacactggggctctagaatcactactactaagggaaaggagcttttgttagccattaaagaacagaggtgtgaagcactatcaactggtagaccaacctactggcctacggatagaaacaagacccctgatttaatagacttctttattattaagaatatttcaactaatttcatagacattgatgactgttgngacttanattctgatcattcccctatagtactaaccatgagtgacaggattattaaaaaacaaagtaaccccacattaacaantaaatgnacggatttgngatagttttaagctaagcctttgagagagaataaatctaagtgtaccatacaaaacgcagagcaat

SEQ ID NO: 18090 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18091 - DNA, 741 bp, Diabrotica virgifera
  misc_feature (3)..(16): n is a, c, g, or t
  misc_feature (24)..(45): n is a, c, g, or t
  misc_feature (53)..(166): n is a, c, g, or t
  misc_feature (176)..(730): n is a, c, g, or t
ccnnnnnnnnnnnnnncattttcnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagctt

SEQ ID NO: 18092 - DNA, 899 bp, Diabrotica virgifera
  misc_feature (766)..(789): n is a, c, g, or t
cctactgtacacataatttatatacgtacaaaatttatttgagcaaagtgatgacggtcgcaaatttaatactttttccctatccaagaagtgcacaacttacataaagaaattttcaattcaaaaatttatttcgtcgaagcgatgacggacgttaatttaatactttttccccatccaaaaagtgcacaacgtccctcaagaagttctcactacaaatatttatttcgtcgaagcgatgataatcgcgatgacggtcgctaatttaatacttttttcatcgagaaagggcacaacgtccctaaagaagtttcacttcaaatacttatttcgtcgaagcgtcgacggtcgctaatttattactttttcccagccaaaaagtacacaacgtccctcaagaagttttcactttaaaaatttatttcaccgaagcgatgacggtcgccatttcaatactttttccccatctaaaaagtgcacaacggccgcaaaagaaggtttcactttaaaaatttatttcgcggaagaaatgacgatcgataattcaatactttttccccatacaaaaagtgcacaacgcccctcaagaagttttcactacaaaaatttatttcctcgaagcgaatgacggtcgctagttattctgttttccatcaagaaaatgcacaaatccctaatgtaagttcatttcaataattatttcgtcgaagtgttgaagggtgctaaattattacttttttccagcacacaaagtcccttcaaaaannnnnnnnnnnnnnnnnnnnnnnngaccaaaagctgtgacggccgcttaattcaaccctttttctccccatttaaattaggggactacggccccgggcaaagatttttttccctttaccaaattttattttttc

SEQ ID NO: 18093 - DNA, 926 bp, Diabrotica virgifera
  misc_feature (32)..(76): n is a, c, g, or t
  misc_feature (78)..(119): n is a, c, g, or t
  misc_feature (128)..(209): n is a, c, g, or t
  misc_feature (211)..(257): n is a, c, g, or t
  misc_feature (265)..(514): n is a, c, g, or t
  misc_feature (529)..(580): n is a, c, g, or t
  misc_feature (582)..(631): n is a, c, g, or t
  misc_feature (633)..(680): n is a, c, g, or t
  misc_feature (685)..(751): n is a, c, g, or t
  misc_feature (753)..(866): n is a, c, g, or t
  misc_feature (868)..(891): n is a, c, g, or t
gcgtgccgaaataatataaatatgtttttctnnnnnnnnnnnnnnnnnnnnnnnnnnnnnnnnnnnnnnnnnnnnncnnnnnnnnnnnnnnnnnnnnnnnnnnnnnnnnnnnnnnnnnncgtacctcnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnntttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttaaatttagtgnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnttgannnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnngttatataatgaatttatctagattggtggtgatt

SEQ ID NO: 18094 - DNA, 779 bp, Diabrotica virgifera
  misc_feature (5)..(6): n is a, c, g, or t
  misc_feature (24)..(24): n is a, c, g, or t
  misc_feature (26)..(27): n is a, c, g, or t
  misc_feature (207)..(221): n is a, c, g, or t
  misc_feature (223)..(235): n is a, c, g, or t
  misc_feature (237)..(257): n is a, c, g, or t
  misc_feature (369)..(401): n is a, c, g, or t
  misc_feature (460)..(481): n is a, c, g, or t
  misc_feature (499)..(543): n is a, c, g, or t
  misc_feature (553)..(572): n is a, c, g, or t
  misc_feature (690)..(710): n is a, c, g, or t
ccggnngtcgcatcctctacgcgntnnccgttattaataatacataatatatattatgtttaagtataatagtcaaacgaataaatatttgatcttaatagatgagtgtaagttaagaatatgttgtagagaagattatgtatattcgattatatgaaaatatccatcattttcttatagatgtagattcacattcattaattatcnnnnnnnnnnnnnnncnnnnnnnnnnnnncnnnnnnnnnnnnnnnnnnnnngcatgtgcttaaaaatcaaaattttcattaaaatttatctttttaaataaaaacctgggattacgcattctcatattataaaatatgtaatgatttatgtttatatattatnnnnnnnnnnnnnnnnnnnnnnnnnnnnnnnnnataacttaaaattatctaaggttaagaatgatgctaatattacatattaaatgattgcnnnnnnnnnnnnnnnnnnnnnnatttattaggaaattcgnnnnnnnnnnnnnnnnnnnnnnnnnnnnnnnnnnnnnnnnnnnnnccaacattcnnnnnnnnnnnnnnnnnnnngaatttgattgggcgcggtatactgaccgtgctaaggtagtataatcaatagcagttttattgaaagttggaatgaccggttgtatgagaaaacaactgtctttatataattgatacnnnnnnnnnnnnnnnnnnnnncaagctcacgttgttttaagagacgcacagaccctatcgtgttgtatatattattaatagatttttttt

SEQ ID NO: 18095 - DNA, 321 bp, Diabrotica virgifera
atctacatcaacacaaaatgtgcgattttctggaaattaaatattgagcttgcgcttctagagcggagcagagatgcgtcatgtgattccgtttctgtagtatatcttgcttattgtgaaatcgggtatattcattaataatctatagatttacaattcaagagtgttattgcattagtattttatactcttagagatgttctcaaagattattttgtcttgacacgttcgtcgttacgaatgactggggatcttgctgccatcatattgtaatatatctaatgacttatgcttatatatcatcattcttaatttttataa

SEQ ID NO: 18096 - DNA, 53 bp, Diabrotica virgifera
  misc_feature (31)..(31): n is a, c, g, or t
acctttaggataccagcgtaattttattggnagagtcaaatcgataataaaga

SEQ ID NO: 18097 - DNA, 614 bp, Diabrotica virgifera
  misc_feature (187)..(205): n is a, c, g, or t
cctctcgcgtccgtgaaatctcataataatatttttcccgcccttgacactcttaaatattttattactcaagctttagcttctgctattgtattgttttcaattcttttaacccccaattcttcagaaattatttcatacacgaggaagaattaccgcaggtactacactagatgtgtactttaannnnnnnnnnnnnnnnnnngatctgtacaggacaatacattatctagaaaaactctgaggatatgaataactaggatattgtagactgctactatcatatatctatggaggaggatgttacatagtaaaacgttataacaatactgatatcggcatacgaagacacccaacacatttccatagtttaaactagaaacatcatttcacaatttaaatattattaagtggagtagacaataaatacaccattttgaggatacatttaagttatctagatctagggcggtggcgacgatgctaaataccacggcctagatcaacacctgatgtctgccgataatgatggaacgacgaaacctgttagtcgcatgattagatagaagataccgtttttgtataaatgcttaaacgaatcagcctgaacactg

SEQ ID NO: 18098 - DNA, 875 bp, Diabrotica virgifera
  misc_feature (2)..(27): n is a, c, g, or t
  misc_feature (46)..(778): n is a, c, g, or t
  misc_feature (810)..(810): n is a, c, g, or t
  misc_feature (830)..(830): n is a, c, g, or t
cnnnnnnnnnnnnnnnnnnnnnnnnnncttcgtaatcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgatttatagaataatttaccttagggantacagcgtaaatttattggnagagtcaaatcgataaataagattgcgaccctcgatgtggattaa

SEQ ID NO: 18099 - DNA, 762 bp, Diabrotica virgifera
ggcagtcccaatccaaaatacaccttaaagcctgttgctggagaactgccaaaaattactgagcagatcaatcaagtgattaaaagaattagcgttattcaaaccataaatgtatgatgaaaaaaaccattctgattaataatttgtatatgtactactctggaattttgactcatgaaaataaatattgacttaaatatgtactgagaccttaatttctctttccaactcggtgtaaaccaagtattactagtttgcaatcaagtactatgttatatgtagtgagatatatgtataagttgaccattctatcaatcatcgaatatgtatacaaagggaccgtaaatgttattaccgtaaaagccacactcatcttctaagtataaataatcatcatacagtgatgccaaacctacaccgtttaatgtctacacagaaagctactgccatcaagacaatctgatcaatcgcgaggatttgagagactacctcaataaacaaatgacagacgctgatgaatgagacctcccaagtgatcgaaacgaagaatatgatagaagatcactgttatgtagaaaaatgaatcttccaacccgaagatctagacaagtgcggatacctatcgtatgcagaattctacgatcttaaacacaacctataagtttatttgataaaatagatttaacaattagggtattgtcattccataacgaagtattttttaccatgctccatatttttatataaggagtaaacaaattt

SEQ ID NO: 18100 - DNA, 97 bp, Diabrotica virgifera
  misc_feature (2)..(22): n is a, c, g, or t
  misc_feature (31)..(46): n is a, c, g, or t
  misc_feature (48)..(90): n is a, c, g, or t
cnnnnnnnnnnnnnnnnnnnnncatttaacnnnnnnnnnnnnnnnncnnnnnnnnnnnnnnnnnnnnnnnnnnnnnnnnnnnnnnnnnnngtacctc

SEQ ID NO: 18101 - DNA, 666 bp, Diabrotica virgifera
  misc_feature (417)..(436): n is a, c, g, or t
aatttgtctgaaatgatgcagatatctcctttgatattttcgattgtcacataagcgatgctagataatctattatgatgtgaaatgttatttcgttttccaacacccctccaacttttatataaataaagtcctctattcattaatcaagctatatattgtacaattctagaattcttatattaaccaatcataaatatatatttagagtatgtatctgaaacattaatttcttcttaaaatgtcaagtcgataaatagaaattattaagttcgcatcctcttataaatgaaatatcgtaatgatcaaatagtttataaattagtcatttttaactatgataaattattcatactaacataacttaaaattatttatgttaaagaacgacgcaaatattaatattaaatgattgcnnnnnnnnnnnnnnnnnnnncagctttttatggctatgcggcatcattctattctccagtttcctaaatacatggctttatgtaacgagtaaccattatcgcctgacgactagatgatgttgaatgggcgcggtatcttgaccgtgctaaggtattataatcaataactgttttatagaaaattggaatcgatggcctgcatgtccaaacaagtgtctttatttatgttatgtagaattttatttattaa

SEQ ID NO: 18102 - DNA, 95 bp, Diabrotica virgifera
  misc_feature (3)..(3): n is a, c, g, or t
  misc_feature (36)..(36): n is a, c, g, or t
  misc_feature (43)..(76): n is a, c, g, or t
canattcatttatataataaattcatttaaattggngtgatcnnnnnnnnnnnnnnnnnnnnnnnnnnnnnnnnnncaattaataatcttttgat

SEQ ID NO: 18103 - DNA, 65 bp, Diabrotica virgifera
  misc_feature (28)..(59): n is a, c, g, or t
gttaaaccggtgtgagccaggttggttnnnnnnnnnnnnnnnnnnnnnnnnnnnnnnnngaaagg

SEQ ID NO: 18104 - DNA, 532 bp, Diabrotica virgifera
  misc_feature (296)..(315): n is a, c, g, or t
gtagtaatgcatggaggaaattaacttaatatttagtaacaccatacattactacatacttgaaaaccagatttttcggaagcaaggcatctattgggtctagagaataagcacatagatgttacgctaaagattataaactgtctagaatcacagtctgtagccccaacgaacctacttatttactgaatatgtcatggatatgatatacttttatagatatagccaatttatttatgtatatatcaataatttcttattaaaataaatgtctaaggactaatactttataatgnnnnnnnnnnnnnnnnnnnngacatagcttaactactactactaatttaaatatcacttctaaatgaagaatatgcgaagcatcacatcatattgtaagagcaataaatctatagttgaagatacgataatctatattttaaaacaatgttttattcagatatcatataatattagttaatatatcaaacaggagatacctacgagtattacgacaatgcaattctagccttaatac

SEQ ID NO: 18105 - DNA, 421 bp, Diabrotica virgifera
  misc_feature (2)..(49): n is a, c, g, or t
  misc_feature (52)..(169): n is a, c, g, or t
  misc_feature (171)..(211): n is a, c, g, or t
  misc_feature (213)..(241): n is a, c, g, or t
  misc_feature (246)..(266): n is a, c, g, or t
  misc_feature (301)..(331): n is a, c, g, or t
gnnnnnnnnnnnnnnnnnnnnnnnnnnnnnnnnnnnnnnnnnnnnnnnntannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnannnnnnnnnnnnnnnnnnnnnnnnnnnnnaatcnnnnnnnnnnnnnnnnnnnnnctatataatttgtggtgactatacaagaagtttgnnnnnnnnnnnnnnnnnnnnnnnnnnnnnnnctttttgagccaactattttgactataagaataaattaccttatggataacagagtaatctcattggagagtccttaactgtcatgaaga

SEQ ID NO: 18106 - DNA, 914 bp, Diabrotica virgifera
  misc_feature (521)..(563): n is a, c, g, or t
cggatcacaataatttttgctaattagtaatgcacttttgaaacattttgttttcaaggtgtttcgaaatattaaccatttttgctattttttacatttaagccattgatatctcagaaagtcacatcgaaactcagcgaaaagctatgtaatatttgaacttagcactaattagcaccattgattgggctaaaagtcaactgtcaattgtcaactgccacattaacattaattacaatttcgtattcgtcagtatcaatcaggattcgacattttcaatattttagagctgtcgtatatgtagtactgcttttgaatacttcatctgtatgaatatttttcgaatatggagcattgactataacctacaataaaaattgttttgcaaggtcttagatttatttgataaatcatttgctctttaaaattgttcgaaagatattcgcaaactcaatcgactataggtggcagtgcagtggcatgaaaatggccgatgtaattgggataacgtattttgatannnnnnnnnnnnnnnnnnnnnnnnnnnnnnnnnnnnnnnnnnngcattcaatcgacgttgatacatacgttatttatagtatcatggatacataggttaacggatgctttgtttaaattttcatcccaattcctctagttccaaataagcggtagcaccctcgcttgagctcgcgaataagatgacgtaatatcatggagagatgtgttttgtgaatgaatgacggggaactatacaatcatactgaaacgtaggcaaccagttattcgatgcaaaatgtatgcagttttttccccttttttgaacacgcactatataaatactctcaaggggtgctatagtcctaaaccacctggcaacatgttttgggttgggtgttaaatttaaattccac

SEQ ID NO: 18107 - DNA, 51 bp, Diabrotica virgifera; identical to SEQ ID NO: 9123
  misc_feature (2)..(44): n is a, c, g, or t

SEQ ID NO: 18108 - DNA, 554 bp, Diabrotica virgifera
  misc_feature (2)..(61): n is a, c, g, or t
  misc_feature (84)..(150): n is a, c, g, or t
  misc_feature (166)..(190): n is a, c, g, or t
  misc_feature (193)..(228): n is a, c, g, or t
  misc_feature (235)..(251): n is a, c, g, or t
  misc_feature (253)..(271): n is a, c, g, or t
annnnnnnnnnnnnnnnnnnnnnnnnnnnnnnnnnnnnnnnnnnnnnnnnnnnnnnnnnnntttggatgaaaaagaaaactgannnnnnnnnnnnnnnnnnnnnnnnnnnnnnnnnnnnnnnnnnnnnnnnnnnnnnnnnnnnnnnnnnnaaccctatagagtatnnnnnnnnnnnnnnnnnnnnnnnnnagnnnnnnnnnnnnnnnnnnnnnnnnnnnnnnnnnnnnaggagcnnnnnnnnnnnnnnnnncnnnnnnnnnnnnnnnnnnncaattaataacttttaaatgcaacttttttgataataagattttataaccttaagtatattatcataattttattgaagagtttaaatcattaataaagatagcgacctctatgatgtattaaagttgataatagtttgaacattatataattgagtctgttctagtactaacattggacttgtgcaggcctacagcgatgtgcgcctctcctgtctgttatatacatgattcctgtatattacactctaaaggcacaacctgcccacagaataattagaata

SEQ ID NO: 18109 - DNA, 750 bp, Diabrotica virgifera
  misc_feature (3)..(66): n is a, c, g, or t
  misc_feature (84)..(278): n is a, c, g, or t
  misc_feature (295)..(307): n is a, c, g, or t
  misc_feature (309)..(322): n is a, c, g, or t
  misc_feature (369)..(405): n is a, c, g, or t
  misc_feature (410)..(427): n is a, c, g, or t
  misc_feature (455)..(489): n is a, c, g, or t
  misc_feature (493)..(530): n is a, c, g, or t
  misc_feature (570)..(719): n is a, c, g, or t
atnnnnnnnnnnnnnnnnnnnnnnnnnnnnnnnnnnnnnnnnnnnnnnnnnnnnnnnnnnnnnnnngagggaaagggggtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggggagggagtgnnnnnnnnnnnnntnnnnnnnnnnnnnngtaggaataatataggaaaaaaaaacaatttaatcatttgttttttnnnnnnnnnnnnnnnnnnnnnnnnnnnnnnnnnnnnngtatnnnnnnnnnnnnnnnnnncgggttttgagcggagggggggagcgannnnnnnnnnnnnnnnnnnnnnnnnnnnnnnnnnngttnnnnnnnnnnnnnnnnnnnnnnnnnnnnnnnnnnnnnntcttataataaaagagggggggggtctttttccgcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaggcggggaccccccgcgggggggggg

SEQ ID NO: 18110 - DNA, 420 bp, Diabrotica virgifera
  misc_feature (82)..(99): n is a, c, g, or t
cccttcaaaggccggtctagtgagcagagatcaaacacaaaagcccttatgtgtgacgacgatgttgcggatcttgtcgttnnnnnnnnnnnnnnnnnnagcatagctgaattcaacgtccgatgacggaccccgtgccgtcttcccctcaaacgtctagacgtccaaggtatctaagtgccatgttgggtatgctacaaaatgaatcatattttggtgaagtaaaaatgacaaataaatgtttcctcattgatgagataatccgttatacatgtaatcatcaccatatgatataacataaataaattcatgaatgacacattctacaatgaactatgtattattatcttatttaaacatattgcagatctgttgggaaccactctattgcataaaaagtagatgattgatgaaccatat

SEQ ID NO: 18111 - DNA, 123 bp, Diabrotica virgifera
  misc_feature (3)..(48): n is a, c, g, or t
  misc_feature (51)..(96): n is a, c, g, or t
ggnnnnnnnnnnnnnnnnnnnnnnnnnnnnnnnnnnnnnnnnnnnnnntannnnnnnnnnnnnnnnnnnnnnnnnnnnnnnnnnnnnnnnnnnnnncttagggaaaaaaagggaaattttttt

SEQ ID NO: 18112 - DNA, 687 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(461): n is a, c, g, or t
  misc_feature (476)..(496): n is a, c, g, or t
  misc_feature (634)..(683): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 18113 - DNA, 905 bp, Diabrotica virgifera
  misc_feature (815)..(835): n is a, c, g, or t
atctagatctgaatcagtagtagcaacttcgatgaattttaaccaacaaataacaatgatcagaagttctcccttttatcagagtttaaccagtcaacagaagttgctgttgaaccaagaactaagtctgcgcaacgattcatccaatatgcacgacccagtgctgaacagtcttctatctaacttagacgctattcctggatccaacacacatccaactcatagtttgagtgcagcactatctattcttaacaacgctagttcgaaaatgaatcccatgatgaaccaaaatcctgcaatgatgcctcccatggggccaaacatgaaccagccaggattattaggagctgcccctggcataccaaacatgcatccagaatttccgatcaacttcgatccgaggaacggaggattattaggaaatgcaccaatgcccttcggcggtttcccccaacaacaggaaccacaaaactttaactacaacgatgactattatccacccgagaaccagggaggtttccgtggtggtaatagagaaatgagaggaggctttaacagggacaggcgaagtcgaggtagaaatagctaccacagtaggcacaatggcaatagaaactttagaaacaataggaatcataggtcaaatagaactcattcgcctccataggggtgcattattaatttagattttaaatatataacttcttccttgtatataaaaacattgttataggtaatttagtatttttgtacgaaatcattcgactgttcaaagttgagtacttttttttacttcatacgaaaagagacccagnnnnnnnnnnnnnnnnnnnnncttatgtaaatatactatgttgtgatcagctattttgtaccaagtattgattctttatcagatttttata

SEQ ID NO: 18114 - DNA, 126 bp, Diabrotica virgifera
  misc_feature (5)..(22): n is a, c, g, or t
  misc_feature (47)..(118): n is a, c, g, or t
gaagnnnnnnnnnnnnnnnnnngacgagaaagacccctatagagggnnnnnnnnnnnnnnnnnnnnnnnnnnnnnnnnnnnnnnnnnnnnnnnnnnnnnnnnnnnnnnnnnnnnnnnnggcggctt

SEQ ID NO: 18115 - DNA, 1009 bp, Diabrotica virgifera
  misc_feature (538)..(565): n is a, c, g, or t
  misc_feature (906)..(906): n is a, c, g, or t
  misc_feature (951)..(951): n is a, c, g, or t
  misc_feature (985)..(986): n is a, c, g, or t
tttgcgtccgggaaatgtacaatagctacgtcttggagcccaccaaatttcatttgcttatctcaaccggttttgaagcaatagataaatcgtcggtttgtgagaacaatttcaacacccctatctcagaaacgaagcatttgcggacataccatttatacagcaaactgtcattgttttctcatgcagaattgccccttggagtttgccatgcgtattttaaaacaccctgtattgatgaggatcatggctggttgttaaagtgcctaacttttttatggtctaatgtaagcgaatgagtcaaaatcttgagaaaacatgaggctattgttggattttgatttcagtattttgtaaatgctagaatgttccacagggtgatgcgaactttgagagaagggacacggtttgattggtgcactcggtgtacagtgaaggtttgactgtttagtagcaatgctgttgcagcgatgttgttggagaatagggctataacatattaaaagatcacttaaatcggaaaacaggtttaggaaannnnnnnnnnnnnnnnnnnnnnnnnnnnggggtgtccggttaattttgcaccccagtgtatatgcccacagcccatttccactatataaaagattcccatacttgtactttgctagaaaacacttttaacacgttgacggacagaacgtctatagacatccaatttccattgatggaatgggacacaacgtctatagacgttgcatttttccctattctactatgcaaaatacataaatagtgtcacaacacttgcttatacatttgacgcactgtctgtcaacgtgttaagcaactgctaagcgaaaggaagatagaggctaaaaacaagaaaaattgatcttgactatctaacatctcacctgatanaacatgtagtgtacagtggacgcctacgcagaaatgcacagcacngtaaaaagagagtctgtgagagttgatgacttgnntgatgaagagtgatgaaaggatg

SEQ ID NO: 18116 - DNA, 742 bp, Diabrotica virgifera
  misc_feature (683)..(700): n is a, c, g, or t
gttttagacaaagtttccaaagaaaaacgaaaaatgtttgtgaaagttgcagtaatggctgtagcatgtgctatgtgctccgcaggatacattgacatttctccatatcatgaagctaattcttatggtaaattagtaggatctccaatttatgaaacaccatactacggaggcgagtacgatggtaatggatatggctatggctatgaaaaagattacgatcaccatgcttatccaaaatatgaatttgcttacggagtcaatgatccccacactggtgaccacaaatcgcaacatgaggaacgagatggcgatgtagtaaaaggatactacactgttgctgatcccgatggtacccttcgtactgtgcattacaccgctgacgaccacaatggctttaacgcaattgtagaaaaagatggacattcgatacatccccaacctgtagtggaaaaagtgtatgtagagccagtagttgaaaaggtagtactagaacctgtatatgagaaagctatctatgagaaacctatctatgaaaaaccattctacgggtacgaaaatggtccaattggtgataaatacggttttggctattagtaaaaaaacaacctttgacattttcgacaattagtggacacacacgtaacggatttttgctgttttcctagtactgatcaaataannnnnnnnnnnnnnnnnncttttcacactactatcaaaacgatagtatgttgggtcgggt

SEQ ID NO: 18117 - DNA, 870 bp, Diabrotica virgifera
  misc_feature (38)..(57): n is a, c, g, or t
  misc_feature (529)..(549): n is a, c, g, or t
cgtaaaataggctttgtgattgtacagtatgttgatgnnnnnnnnnnnnnnnnnnnncgatatatacagggtgtttttcaacttccgtgataaccattgtaaacatttagccgtgtgtattttgagagaacgatgaattactaattatctggtacaaaaatgtcggtctctacgacccctgtttatatttctgtcactttctaaccatttaaagttttgcagaacagttttgctttgtaaaatttagctatatatcatttttaagacattttaagattatgtagctttctgtactttttacctattctttcttatttgttgctttatttttccaatttgagattttaaggtcttttaagtcttttttaacatccttcctccaccgggttttcggcctacgtttcttcttcttttctcctattcctcccgttattattctttgggcagtcttgtgtttagcgttattatcttctagacatatttttacttcttggatttcttcgttcatatttggtctcctgatactggnnnnnnnnnnnnnnnnnnnnncttgtttacttctgtatcacagtacactgtcgctgatgacagtactctgtcatcagcgaatgctaggcattgatgttttagttgatgtacaagtcctgtccgattcattcaggcttctttgacgacaactttaagaaggatactgaacaataatgatgacaggattcctttgtcgcacctcctcctcattgacttcaaacttgtgtatttgttttgcatttattttatccatattcactgtttttcggagtgtcactcttataattcttactaatttttcaagagttccctatttagtgtaatgacttatttaagtttttt

SEQ ID NO: 18118 - DNA, 316 bp, Diabrotica virgifera
  misc_feature (228)..(245): n is a, c, g, or t
ggagcccaattcaagggaacacaataacagctgcatttgtgtatggtgcagctgttgttggggcgtcggtggagcccaattcaagggaacacaataattttaagaaggaatcaatgtgaagatggcggccaaaaccacaccaactgtcagcggtcgtcagttctacccttttccatcccccactatacactaatgtaatatttttagatcttaaattacagacttagnnnnnnnnnnnnnnnnnncgtatgacacgttataaataagaattcggttattttgtaataattgaattaaataaatcttatttaagacc

SEQ ID NO: 18119 - DNA, 589 bp, Diabrotica virgifera
  misc_feature (2)..(44): n is a, c, g, or t
  misc_feature (52)..(535): n is a, c, g, or t
  misc_feature (537)..(581): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnngccactgg

SEQ ID NO: 18120 - DNA, 875 bp, Diabrotica virgifera
  misc_feature (178)..(201): n is a, c, g, or t
  misc_feature (214)..(231): n is a, c, g, or t
  misc_feature (265)..(287): n is a, c, g, or t
  misc_feature (513)..(533): n is a, c, g, or t
  misc_feature (612)..(631): n is a, c, g, or t
  misc_feature (696)..(744): n is a, c, g, or t
  misc_feature (856)..(856): n is a, c, g, or t
gaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattgnatcactaaatttcttaatt

SEQ ID NO: 18121 - DNA, 734 bp, Diabrotica virgifera
gttgagtatcatcttaaacaatgtgaactttcaacctgtatggactgcaaaacttcaaatctgtatttattttgatatgcatatctacttacagagatagaattgttaacaaataaacgacacaaactggtaatacacttttacaattatactaactatttttaaaatgatatgatattatgaaattatgaattatgctgatataaaatgtaaataaaaaatggtcataaaaatggggccttaaattagatttttttggcggattttttttgctagtgcaaatttgtctagatattttacagttaggtatagcctcccctattgtaaacatcacgagccgccactgccttgaggaccttcaaataatataaaagtagtctttggtacaaataaagatttttcacttaaaatatttagaagagcatcgcaataacttgatattttcaaccttttcttgcattaatgtctaatatacggtgctaaaatccacacacgagttaatattcgtacaaagtgagaactacaatttttctttttgctatatattgttgggaacttatttgcacacatggtttttatctaattttgcttcaatttcacctaatcttcaatgacaaactttatataacatttactgtgtgaatacaacagaatcaatgactctagtgtttttctatgaccttgagaaatgacagcgaatttattgtattgaagtgtacaagaaatcctgatat

SEQ ID NO: 18122 - DNA, 917 bp, Diabrotica virgifera
  misc_feature (809)..(809): n is a, c, g, or t
  misc_feature (828)..(828): n is a, c, g, or t
  misc_feature (842)..(842): n is a, c, g, or t
  misc_feature (875)..(875): n is a, c, g, or t
agattgaggactttgagtttgacgaagaagaaggcgtttatcattacccgtgcccttgtggggatcgttttgaaattacaaaagaagaattgctagcaggtgaagaaactgctacatgtcctagctgctcattaatagttaaggtcatctttgatttggaggcctttagaaaagaaaacggtgaagtaaaaagtttatcagaggatttaaagaaactagaaatagcaaactaatatcataatgggcggaagaggtagaggtggacgaggaggtagaggaggtgtgtcaaaatccttcaacaaggaacagctgacatctcttggagtaggaaacaaagaattagtccctgggccagttctggaaccacctcttttatatccgattatggagagaagacccgcaccactttctcaatctctggaaatggattaccttcttatactcaggcaagattttatagatcacatgcaactttcgggatcctatttgaaaatgcctgaaagtaaacaccaacctcaacaagaaatagataaattggtggctcagcttcctagtgctaaagaaaaattcgattggaggttgtttccatctgaacttagacctaaagtattagtgaagaggattccaaagagtgaaaagtctaaaaatgtcaatattgagcagagattaaatgcactcgaaaaattagaagttaaaactgaaaatgtcgaaacaacgaaagttaaaactgaagtggaagagaacgacgatgaggacaaggaggatttcgaaggattagaggatgaggaagatgaagaaatggacgatgngaccgattacgcgaataanttacttgataatgngggaagggtacgaggatgaagatgataatttgnaggatggggcgatctattaaagttgtatatattattgatatg

SEQ ID NO: 18123 - DNA, 779 bp, Diabrotica virgifera
  misc_feature (2)..(17): n is a, c, g, or t
  misc_feature (19)..(61): n is a, c, g, or t
  misc_feature (69)..(725): n is a, c, g, or t
  misc_feature (728)..(743): n is a, c, g, or t
  misc_feature (748)..(760): n is a, c, g, or t
  misc_feature (762)..(777): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncannnnnnnnnnnnnnnncgttnnnnnnnnnnnnncnnnnnnnnnnnnnnnnac

SEQ ID NO: 18124 - DNA, 893 bp, Diabrotica virgifera
  misc_feature (8)..(97): n is a, c, g, or t
  misc_feature (105)..(242): n is a, c, g, or t
  misc_feature (244)..(892): n is a, c, g, or t
ccccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 18125 - DNA, 885 bp, Diabrotica virgifera
  misc_feature (146)..(163): n is a, c, g, or t
  misc_feature (853)..(884): n is a, c, g, or t
ccttctttcttcttcttgatgaattacagcttctgattccgcatccaacatatttttgtttaggttgttgaatgttcctccacagtcttcatctccagtatcttcatcagtcaattcagtggggtcaggaggtgctaggaaaacannnnnnnnnnnnnnnnnntccataagattcgattcttccagcatggacataattttatgtgctcttgattcgtaaaattttttttaggacgactattattattagtacgaccgaaactggtcgagccaagttaatttgacatcttatttccaccttctagaacaaaaatgattttttgtactaataatatgccttgtgcccagtgcgaatttgcgaaaacgcaacactgataattgggcagttgtaccaactagcacagataaaatattagcacttacttcatagatatattttcttcaatgatttaacaatacgttgctattaaaaaccaaatttttatccagttaatttatacacaaacgatttactactaactaaaaacatttgtttacagaaatcaaaattaatctaccactttcaatacgccatctgttaatagaaacctaaattttgcgaccaattcccactaaaacatacataggaaactgttgtgaaataaatctgaaccttgactgcccgaataagtcatgtcattttccaaaagatgacgccatagtgggctatgtcaaaagaacgcacctcctcaaaaaatcaagcaaacgttgcacagatcaaattctcgaacacaatgtccaaataaatattctctcttatatggtttgtagacatctaaagaagaccatagacaagtattataacattctgctnnnnnnnnnnnnnnnnnnnnnnnnnnnnnnnng

SEQ ID NO: 18126 - DNA, 823 bp, Diabrotica virgifera
  misc_feature (16)..(16): n is a, c, g, or t
  misc_feature (586)..(601): n is a, c, g, or t
gagaaacataaaatantcggaaataaacacaaaaacaaaaaattgatctttaaagttgagggggtgaattattgttctcacgagatcaacatgttgtcattaatactatttggggtagccttggccctcttttattatgttgctataaaacctttgagctactggaaggaaagaggagtaattttccaggagggagctctatggttgctcggaaatcaatggaagttctttttaaatcgtcaagatatgtttgaagtatttgaagatgcttacaatgttgcaccaaatgctagatatgtaggtttctatcaatttacggtaccttctttgatgataagagacccacaactgttaaaacagataactgttaaggattttgaccatttcgtcaatcatcgaacgtttataccacaaggtgctgacccactttggtcaaagaatctactttcattaagagatcaaagatggagagatatgagatcagtactaagcccatcattcaccagcagcaaaatgaagatgatgtttcatctcatggcgggctgctctgagaatatggtaaaacatttcttgactaaaaaccaannnnnnnnnnnnnnnncgtttaaagatgttgcaacgcgttttgctaacgacattatagcttccactgcttttggaataagtacgaattcttttcagaagcctaaaaatgaattttacttaatgggaaaagaaattacgagtttttccagtttctgcaagaatttaaaggatatgcgtcttataacaattcccaaaaattttaagcttcctaaaagatcaatctctttgatgggccccc

SEQ ID NO: 18127 - DNA, 622 bp, Diabrotica virgifera
  misc_feature (208)..(228): n is a, c, g, or t
  misc_feature (307)..(326): n is a, c, g, or t
  misc_feature (391)..(415): n is a, c, g, or t
  misc_feature (418)..(438): n is a, c, g, or t
atttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnctnnnnnnnnnnnnnnnnnnnnngttagcaaattaaagcttcttccttcatcattttttaccacaagcagtattacctgaaccaatatttatatgatcgggaggtaataatctgtatggtctaaaagcacgctataacattgacgatttttatagaaacaatgaacgattcatcgatgatcgagcccatgtttatatggagctatta

SEQ ID NO: 18128 - DNA, 794 bp, Diabrotica virgifera
cccacgcgtactgacttcgcttgccagctcgaaagaagaataaaaatagtccctctcgcgtgtgcaacttgttgtgagctacgaagtactcatatgcaaataacctcaatgggagcctttctgttcgctagacttacacctacgttgggatatgttgacaacagttacacccatagtggcaagcattgtattcgaatgtccgagaatatcccattcgagagggcaaaccctccgcatacaaagggcctttactaatatctccagtgtgaagaggcaacgacatacattcacgttatgattgatcgcatgacactgacagagttatagctgaattggatactttgataaagataaccgtcctattccgactggagcgccggaatgaagattgaaacatataaagagcattccgaaacaatcgacacttcctctcaccaaaccgtgacttgattatacccatgaggttcgtgccctttgtgatcaatcctcgttctgtaacacaactttgagaagaaagcgtgagaaccgcggacatccgcatcaaagacaatattccgtgatgatcaccaaactttagacacaagagataatgaatcacatctagaaacacgtgaagaaaccgttaccgataactacaatgcaactgataaaagaaactcaaatgagtggacttagcatatgtgagcagagaatgcctcgagagactttatccaggatcgactggcaacaggaccagcatactagactgttaacaaccagagaaaaatatgcaatgagaactccacacaaatgat

SEQ ID NO: 18129 - DNA, 850 bp, Diabrotica virgifera; identical to SEQ ID NO: 13153
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(843): n is a, c, g, or t

SEQ ID NO: 18130 - DNA, 507 bp, Diabrotica virgifera
  misc_feature (328)..(351): n is a, c, g, or t
ccctacgcggccggagaaaagagcagaggaggagcgaggaccctttcacggacggggaagagaaggggaaggaccaacggaggagaaggggaaccgggaacgggaggaaggcaagacgacaacgacgggggcgacggagggagggaaggaacccaagaaggaacgaggagaaaacagcctccggcacatgaaagacccaaacactgcgaagacaataagcaggcacccaacacggtgtttggtggtaggacttcgaggggttcatggtttcattttgaaagaaattggtaacctgtttggtaaatcttcttttaagataaatgttaannnnnnnnnnnnnnnnnnnnnnnngtattgaggattttttggaatgagcttataataacaatatcttgatagtagtttttagtagaaggtatcagtgcgtttcagacttttagatattgttgtgtgtgtgattattgatatttggatagttatatttttagaaatgatggctttttgttt

SEQ ID NO: 18131 - DNA, 157 bp, Diabrotica virgifera
  misc_feature (9)..(154): n is a, c, g, or t
attattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncct

SEQ ID NO: 18132 - DNA, 135 bp, Diabrotica virgifera
  misc_feature (6)..(89): n is a, c, g, or t
  misc_feature (91)..(112): n is a, c, g, or t
ctattnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnncatttaatttggggtgattaaaa

SEQ ID NO: 18133 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18134 - DNA, 755 bp, Diabrotica virgifera
  misc_feature (43)..(64): n is a, c, g, or t
  misc_feature (143)..(162): n is a, c, g, or t
  misc_feature (273)..(305): n is a, c, g, or t
  misc_feature (322)..(353): n is a, c, g, or t
cttatcttgacgatgacaatgtgtgatgtggatgtgtgttaannnnnnnnnnnnnnnnnnnnnngattttgttataagcaataaaacggttttgttctttggatataaacattattaaactgcaattagtactacgtaaaatnnnnnnnnnnnnnnnnnnnngaaacataacaagaaactagtgaggaactttgcaaaatagaaacagataatgaggtatttgatgaacatttggatgtcgtcaaagataatagcagctaacaacctcagacnnnnnnnnnnnnnnnnnnnnnnnnnnnnnnnnncttacctgcatctctgnnnnnnnnnnnnnnnnnnnnnnnnnnnnnnnngttgcgattggtgcaggattgaaagacttacatgacacagtcgtaaaatatagacaaatatagggacatcagaatattaaacctatatatatattacatttatctgttaatatcttcaatcttaggagcaactaaatttattacacagactaattaatatacgaccaatagcaataactgatgatccaatacccatatacgattcgcttgtcataatcacaggaaatgcttcttcgattatactaaccaggtttatatcggagtattaccatattattcccagatcgaaatccaaaacacatcatcattcgatccaactgtatggagggcatccaattatttatcaacatttaattcgaatttttggtcatacctcgagcatcttactttaactttaccagg

SEQ ID NO: 18135 - DNA, 731 bp, Diabrotica virgifera
  misc_feature (222)..(243): n is a, c, g, or t
gtcgcttctaatattgaattcaactcgcgatcagaagaggttcatggtgaccggcatcactaaacttttcagacgtaacagtgctactgaacactaccgaaaatgagcaactgttccgttatagtaagagacgtatttaagagttacgggaataaagaaatattgaaaaatttttgcatgactgtggaaaaaggagaaatatatggattactgggggctagnnnnnnnnnnnnnnnnnnnnnnttaaatacactagtaggacggaaaaaggtcgacagtggtcaaatatgggttttaaatagtaaagtaggagacaagggtagctctgtacaggggaataaaattggatatatgccacaagatgtagcattagtgggggaatttacagtaagagatgcaattttctattttgggcgaatctttggcatgaaggaaagccgtatagaagaacgatttagtgaattgtcagagttccttaatttgccacccgacaataggtttataaagaactgcagtggcggacagcagagaagagtatctttagcggtagccttagttcacaaaccacagttgctaattttggatgaaccgacagttggtattgacccactgttaaagagaaaagattttgttcttatttgccaaaaatctccaaaccaatataaatatatctcgggccacaccactactcactatatcacaggaatggccatcaagctacgcaacatctg

SEQ ID NO: 18136 - DNA, 524 bp, Diabrotica virgifera
  misc_feature (322)..(339): n is a, c, g, or t
  misc_feature (351)..(368): n is a, c, g, or t
  misc_feature (406)..(435): n is a, c, g, or t
  misc_feature (440)..(501): n is a, c, g, or t
cgcccgccccacgcgtccgagcttattatctgtgtttttctgtctagtgttcagtgatcaaccacaagaaacaacatgtgtgacgacagtgatgtagcactgggcgaggacattgtatccgtattgtgcaaaaatgcattcgccgtaccttgcgcaccacgtatcattatcccctcattctacatttattattgtgcgtactattaaaagaggctcaacaaattcccaatactcgtatctgtaaagacacacattttaaatcacttgttttgcaatgaaaagctattcgtgtttacatatagctaattttttaagatctacnnnnnnnnnnnnnnnnnnccatatatttcnnnnnnnnnnnnnnnnnnccattaatactaaatattattacggatgagctaaaacnnnnnnnnnnnnnnnnnnnnnnnnnnnnnncgatnnnnnnnnnnnnnnnnnnnnnnnnnnnnnnnnnnnnnnnnnnnnnnnnnnnnnnnnnnnnnngtttattactgaagaatttttta

SEQ ID NO: 18137 - DNA, 344 bp, Diabrotica virgifera
  misc_feature (2)..(48): n is a, c, g, or t
  misc_feature (133)..(158): n is a, c, g, or t
  misc_feature (173)..(185): n is a, c, g, or t
  misc_feature (188)..(212): n is a, c, g, or t
  misc_feature (256)..(285): n is a, c, g, or t
gnnnnnnnnnnnnnnnnnnnnnnnnnnnnnnnnnnnnnnnnnnnnnnngattaagagaaaataactgtaaaaatattctattatttaattgttttattacacctgaacttccataatattcaaatcatcctannnnnnnnnnnnnnnnnnnnnnnnnnccaaaataaattggnnnnnnnnnnnnnccnnnnnnnnnnnnnnnnnnnnnnnnncatattattctaaaaaataatactctagaaatattatttaaccnnnnnnnnnnnnnnnnnnnnnnnnnnnnnnctaactcataacctaatcaaactccaactataataaaaatcaaagttataatttttatt

SEQ ID NO: 18138 - DNA, 559 bp, Diabrotica virgifera
  misc_feature (37)..(37): n is a, c, g, or t
  misc_feature (68)..(68): n is a, c, g, or t
  misc_feature (332)..(349): n is a, c, g, or t
  misc_feature (357)..(378): n is a, c, g, or t
  misc_feature (416)..(437): n is a, c, g, or t
  misc_feature (445)..(465): n is a, c, g, or t
  misc_feature (467)..(492): n is a, c, g, or t
cttactgggtccgatcaaattatattgttcagaattnatatcctttgattcggggagagttaattttngaaattttacacaatattggctgtgattttgtaaagttgaatttgatttcaataggtgtatatacggtaagttatagattttgtttaaagtaacaataatctaaactaagttttattttcagatttatatttttgtattacatactttgtttattgtaacctacgagtaggaaaaatgtggccagagatataacaggtaaaaagcgaaaacaggtacgaacttgttctttctggaaaagaaatagcatcgaagattgtgaaaannnnnnnnnnnnnnnnnnatttctcnnnnnnnnnnnnnnnnnnnnnngttaagcatgggcttagaaataaaattatatcaagatnnnnnnnnnnnnnnnnnnnnnngattaacnnnnnnnnnnnnnnnnnnnnngnnnnnnnnnnnnnnnnnnnnnnnnnnctcgcatagaccagaaaattttgtctcaagtaaaaattgtatggtaatataaccatatcaatgatgc

SEQ ID NO: 18139 - DNA, 557 bp, Diabrotica virgifera
  misc_feature (36)..(74): n is a, c, g, or t
cttggagaaactaacatcgttgacaaccatggcggnnnnnnnnnnnnnnnnnnnnnnnnnnnnnnnnnnnnnnngcgaagcacctgctgccgctcctgcccccgccgaaaccaggtcctcctcgaagaggtcctccaagaaagccaaaagagatgatatgattgttgtcgacatgtatgcaaattggttgaagacagatgtacaaaggcggaaccacaataagttgacattgtcattgatgtaatgatgtgcgagagactgggtgagagatgtggggagatagtagcaaaactccattattatgtggataagaaagaaaagagaattcatacgttttagagaaaatttagtagagaaaggttaccggagtcaggctgaaaaatacttacatattcaagccgaaaccatcagcccatgggcctgcatctacccagaggaaatgaacctaagtggtattgctgtcgtcgatgtgatgaactcaattgcccgaggacagaagagtcccactttctcagttgttgatctgtcaagtaaggatgttgctgcgcaaattagta

SEQ ID NO: 18140 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18141 - DNA, 334 bp, Diabrotica virgifera
  misc_feature (2)..(35): n is a, c, g, or t
  misc_feature (37)..(53): n is a, c, g, or t
  misc_feature (77)..(142): n is a, c, g, or t
  misc_feature (147)..(162): n is a, c, g, or t
  misc_feature (164)..(229): n is a, c, g, or t
  misc_feature (234)..(282): n is a, c, g, or t
  misc_feature (297)..(317): n is a, c, g, or t
annnnnnnnnnnnnnnnnnnnnnnnnnnnnnnnnngnnnnnnnnnnnnnnnnncaatgaagggttgaatgaaaaagnnnnnnnnnnnnnnnnnnnnnnnnnnnnnnnnnnnnnnnnnnnnnnnnnnnnnnnnnnnnnnnnnngactnnnnnnnnnnnnnnnnannnnnnnnnnnnnnnnnnnnnnnnnnnnnnnnnnnnnnnnnnnnnnnnnnnnnnnnnnnnnnnnnncctgnnnnnnnnnnnnnnnnnnnnnnnnnnnnnnnnnnnnnnnnnnnnnnnnnctttgatccaattannnnnnnnnnnnnnnnnnnnnaccttagcaataacagc

SEQ ID NO: 18142 - DNA, 222 bp, Diabrotica virgifera
atgaaaagttattcgtccttctatatctccattctgtatagatttagattatgtgattgattaacgagatattaataacaaaataatttaagattaataacaataaagagtattaggtaagggtttagaaaaatactggtattgaatgttaacctattatgaatagaaaacttcatttactataataacatataataggtgaatatctattatcatattcta

SEQ ID NO: 18143 - DNA, 207 bp, Diabrotica virgifera
  misc_feature (2)..(41): n is a, c, g, or t
  misc_feature (44)..(78): n is a, c, g, or t
  misc_feature (89)..(152): n is a, c, g, or t
annnnnnnnnnnnnnnnnnnnnnnnnnnnnnnnnnnnnnnngannnnnnnnnnnnnnnnnnnnnnnnnnnnnnnnnnnctgggggcgannnnnnnnnnnnnnnnnnnnnnnnnnnnnnnnnnnnnnnnnnnnnnnnnnnnnnnnnnnnnnnntcacattttttttgaacaaataaggaaaatattaaactaatggggaaaacggcgg

SEQ ID NO: 18144 - DNA, 187 bp, Diabrotica virgifera
aaaacgaaacgaattaaaaataaatggaaaagttaaccatatttgatttccttttttcttcacgataatttttctaagttcagagtttttagagataagaaattcctgtatgtctgtatgtatgtaaaatcaacataaatgtgcgtatgtatggacttacgaagaggaagatttcaattatacaatt

SEQ ID NO: 18145 - DNA, 105 bp, Diabrotica virgifera
  misc_feature (26)..(46): n is a, c, g, or t
gagaatttatttttaaggtaaaaagnnnnnnnnnnnnnnnnnnnnncaaaagaccctataaagttttataaaactattaaataggtttttctagtattaaattta

SEQ ID NO: 18146 - DNA, 1007 bp, Diabrotica virgifera
aacacatcagtagtaccacccaaaataacttttggttccttgccctacattcctgatctgacaccaaagctattcaacattttcaaaaatgtgaatggcttaaaaatcgcaacaaggaatgtgaaaacggtgtctatgttatacacaaaaactaaggatcccttcactatgcaggaatcttcgaatgttgtatattctataccttgtttcaattgtaacaacgtgtacattggcgaaacatctcgtaatttccatagtagagccatcagtcaccgtagtgacataaaagttaacaaaataaatgcatgtgcactaacagaacatgctataacattgaaacatgagttcaatttcgagggttcctgtattttggcaagggaaacaaaccactgtaaacgcgtttttgtggaaatgtgttgcataaaatctagcaactcatgtataaataaaaaatcagatatagaaaaacttagcaacatatattgttatctacttgcgcaacattaaaaaccaaaacataaaaatacttgtttgttttacaaaacacacatggacgtataatgagttgcatactcttaagtacagttagtgaatttgaacacaccttgtatgggcctctgatgttttaaaaagaaccacaataatcataacacttaattacttttttatttgatactttttaatttgattgtttcttctttctgttctctatgtgtcagagtttttgacttacattatcagtaggttaacatgacagaataattattgtatttctgctaattattcaaaaattttaaaatgtattgtgccctttggtttctggtttcaatatttgggttaatttgaaatgttgaacatcatcaagcttctctttaataatctcaacgactaaaaggtttactaaaacaatgtaaaatttaaaaaattacattttgttttaattacaaagcttgaaaaagggccaaacacccccaagttaaacaaaaagcaaaaaaggttcttttaat

SEQ ID NO: 18147 - DNA, 405 bp, Diabrotica virgifera
ctctatatcataaacattaatgatttgttaggactcaacgcacaaacatctccacattttttaattgcatcccaataaatcagaataaattaataactaaagaatatcacactgaacattttagaatagtatcacctaaatattccctgatgtactagctcatactgttcagatctatatccacctcaatctttaccaaataatacccctaaatcagctcacatgcctctgataccatccaaataaaattgccctattagaactatcctacttcaaactgatggaagcaaccttgagaatctacacctatttatatggatagaagttattgattacaatatagaaacagtacatttacaattttaaatgtggaggtaccataaaaatcattaccagatctacttt

SEQ ID NO: 18148 - DNA, 289 bp, Diabrotica virgifera
tttcccttacgggcccggaacaccacaacacacagaccgagcacgccttttcgggacaaacaagaccaccaaaccgaaacgcgaaagaggccgaaaagaaagacgacaggaaccggaaaaaatatcagaggaaaagcgagagaagagggccgaaaatgccagcgaccaaaagagggcttgttacaataacgtcatcgacaatagtaatgtatgttggatcggatgaatcggctactatattgtttcttgtgacattggtttttcctgatttcaaggagtatattgtgta

SEQ ID NO: 18149 - DNA, 416 bp, Diabrotica virgifera
  misc_feature (82)..(96): n is a, c, g, or t
attttagtataatttgtcacatatttgagcatcgcttgaactaaaataacgcggaaaatttaaattttttctacttttttcnnnnnnnnnnnnnnnaaaaattcggtaatttctttataaaacttgttttttacggagatacacataaatttgacattataatttttgtgttttatttaataattggatgatcagctgcgaaataataaaaatacataagttagttggcctttcatcgtgggaatgcaacaagagagacctggttacagatgtggagcccttggagtaaaaacacgtaaatattgtttaataaacaaagtcttttcctaattatttacatcaattttgagtgaatttttaaaagcgacacgctgaaataatttatcaccaaagatccgaaagcgtctgtctttctg

SEQ ID NO: 18150 - DNA, 909 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(843): n is a, c, g, or t
  misc_feature (851)..(908): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnngctcatcnnnnnnnnnnnnnnnnnnnnnnnnnnnnnnnnnnnnnnnnnnnnnnnnnnnnnnnnnna

SEQ ID NO: 18151 - DNA, 349 bp, Diabrotica virgifera
cagttaattgtgtaataaaacacgaaactcacgaccctggtcttagtcattgatagaactagcacgctatctaaaaaacaaatatgattgccgacgtttcactggttacccctgtgaccaaaattgtccggggagaacagacgaaatataattggaggcgacggacgtcggaagaaaaccaacgaaaacaatggggaagataggtgtagaatcacatataaatgcaactcccctcccccgtatccgcggttcccaggctccaccagtctccccacacatgctgtctgcgcgtaaattcataggcggtggatgcgccatcgctggcaccactggctccaccacatttatt

SEQ ID NO: 18152 - DNA, 162 bp, Diabrotica virgifera
cccccggctagtctgaataataaaccgtgataaccccttcatagattttattacttttttattgtagttttgtatttaaagagtgtagctaaaatagtacattgttatgtcgcaggatctgatcgtatgatccgggcgtatctgttggattatttggattat

SEQ ID NO: 18153 - DNA, 437 bp, Diabrotica virgifera
  misc_feature (14)..(314): n is a, c, g, or t
  misc_feature (319)..(333): n is a, c, g, or t
  misc_feature (335)..(352): n is a, c, g, or t
cctcccctcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgnnnnnnnnnnnnnnngnnnnnnnnnnnnnnnnnnctgttaaacatttttttggatgaggttaaaaccaccgctttataataaggtaagatctaaattataaagaaattgaaatcaagtg

SEQ ID NO: 18154 - DNA, 855 bp, Diabrotica virgifera
  misc_feature (397)..(421): n is a, c, g, or t
gagaccggtaacacgcttctggtagctggtaccagtgattgctgtgattaattgagaagctacgaagtatctgataacgcgtctgcccattaaaaaacgattttaggctgtagacgccactatccctgtgagatacttgcctccagtacactcggtgactcagtggctcgtacgtgttacaggcgtcgtgtaactgagcctttacctacataatccagtgaatttttttaaggagagaaacaaattggtcaacctttgagaataaatgataaattatttttattactctcattgtttataacagtagtaaaactacgtcaaaaactattaaattctttagaaatacaataagtgtgacctaaaacatattgcatcactgtgatacgggatatatagnnnnnnnnnnnnnnnnnnnnnnnnnctgcataattatatacacattaaaaaaacttacgttaggtaggcaaaatacgtatttttcaattgctacatacatgacatcaaacaaaagcacataacgatagatactatgtttaaattgatataagaacaatcatttatgatttaaatattctatactttatttgtttgcaactgacagctcgttgcaggtgcaagtcttcaaatagaggttaagggttaatatgcaaacaaatttatcctctcgtgttgaaatatagttttagatattatttttcaaagagtccaccctgtttgcatataaattaataacaatataaacctatggattatatactcaacaggtatgaaaattattggtcagtgttggagagtcaaaagatttatatgttaaataaaattaatgaaagtggatacattgtatatctaacattt

SEQ ID NO: 18155 - DNA, 103 bp, Diabrotica virgifera
gaacattgttttcacctgtgtattaaagacctggctttttgggattgaaacatgaagtctagccctgcccactgcataactttgaacggtcgcgcacctttca

SEQ ID NO: 18156 - DNA, 594 bp, Diabrotica virgifera
  misc_feature (13)..(33): n is a, c, g, or t
cacttcgcgtccnnnnnnnnnnnnnnnnnnnnntaaactccccttaaaaatcagactgccatttatcaccaacagaattcctgtcatttgacatgttctacgtgtctgacttattaaaatccccaacatatatgtcggacaagcatttttcacatattatacaaagtttcccattgaataaacttaaaaacaacctgctagttttcaaaatcattaacttgtcaggatgacacgttccacaattaaaatcacgttccacaattggagcttcccctcttccggggatccaatactttaaatttagttcaactaggtctcgttaatatcataacaatttttggcttgcttattaacattatatgattttgctacttgtactacaagatgaacatgtttaaatggcatatcctgccaccgtcgcacccgtaagaattgaaacataaaaatgttacaagtaatgatctttagattgatgagccagcattatcgcgtaatgatttcaccatatatatttgacgagggagacagaaggacactaatgcgacactgtagcttaaaatataacttagtgtaatctgttttttagatgcagtg

SEQ ID NO: 18157 - DNA, 158 bp, Diabrotica virgifera
  misc_feature (9)..(111): n is a, c, g, or t
  misc_feature (113)..(126): n is a, c, g, or t
caaataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnngatataatttttcttaatttaatgttactaat

SEQ ID NO: 18158 - DNA, 879 bp, Diabrotica virgifera
attatttttcagatgaatatttcatagtgaaattagaataactgtttaccttggtttaccttgtaaatatacttttttgatagaatggattccaaggagttaccaaaaggatggaagaagtgtgaaatatgtaacaaatcttttgtaagcaaatcaaactttagagctcacattaaattaaagcacccagatgatgtagaaaaattagatccaggagcaaaaccaactgcacaatgtaatgtttgcaataaatccattgataaaagatatatgaccaagcatctaaaactcaaacatccagaattagaagagacattgcctggtaaaaagctgtatgactcgacgctgtgtcacaaaaagttcgacacatcacatgcatctttaaaacacaatcataaatgtttgaaaatgttgacatgcagtttatgtgaatatgaaaatacatcacaaaacaaacttatatcacatatgaaaacaatgcatagtattgatataaaaagtcaagacttgatgtttgattcggtagaaaaatttgaacaatggaaaacagaactagaaagagacactgtatcaaaatataatattacacatggttcatatgtaacacagaaatataaaagatcccaatattattgccaaagatcaggatattatatcgcaaagggcaaacaactgagaggtttaaaatctcaaggcagcaaaaaaattaatggtttttgtccagctaaaatagattgcagacaagagggtgaaaaatgtagtgttacattcatttcaactcatgttggccatgctgcagatttaagacatttaactcttacatctactgagagacaagaaattgcaaggaaaatagcacagaaaatcccttttgagttg

SEQ ID NO: 18159 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18160 - DNA, 582 bp, Diabrotica virgifera
  misc_feature (2)..(175): n is a, c, g, or t
  misc_feature (183)..(286): n is a, c, g, or t
  misc_feature (292)..(367): n is a, c, g, or t
  misc_feature (369)..(435): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnngatttaaatctaccattgacgagagacttagaataaaaaaagtgtatatgtagaaaaaatatatagatgaaatcaaggaactcgcgaacagtcttttcacccgtgtataataaacctgcccctttgcagcaaaactaaagccccgcc

SEQ ID NO: 18161 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (161)..(189): n is a, c, g, or t
taacagnnnnnnnnnnnnnnnnnnnnnnnnnnnnnnnnnnnnnntgcgacctcgatggtggatnnnnnnnnnnnnnnggnnnnnnnnnnnnnnnnnnnnnnntgttcgactttaaaattttactgatctgagtttaaaaccgggtgaggccaggtgggttnnnnnnnnnnnnnnnnnnnnnnnnnnnnngacaaaagggac

SEQ ID NO: 18162 - DNA, 891 bp, Diabrotica virgifera
  misc_feature (15)..(32): n is a, c, g, or t
  misc_feature (627)..(627): n is a, c, g, or t
  misc_feature (650)..(650): n is a, c, g, or t
  misc_feature (679)..(680): n is a, c, g, or t
  misc_feature (740)..(740): n is a, c, g, or t
aatatgtccaattcnnnnnnnnnnnnnnnnnncaaatctaaaattcgcaaacaatttagaaaacgtcttaaagaggaagacagtgatgaaaatgagactgaagtaattgcaaaactacaagaaatgaaagaagttcagaaacttagagaaagacctaatggtgttagtttagttggtttagcgctaggaacaaaagtactaacggacacagaaatcaaagattcttttaataaaaacattggtggtttggtaaacttgcaggccttaaatagtggcaattggaaagtagatgacgcctatgatactggaataggaactcagttttctgtggaaactaataaacgagatgaggatgaagaaatgatgaaatttatagaagttgagctatcaaaaagaaaaggtaaagaaaagcaaagtgaaggtcaggatggtaatagcaaatatcatacaccagaagaaatagccctacagtcagtacccgaacatttaagggtatcttcaaagaaacaatctgaagaaatgttatcaaatcagatgttaagcggtatacctgaagttgatttaggtattgaggccaaaatcaaaaatatagaggctacagaagaagctaaacttaggttattgtgngaaaaacaaaataagaaggatgngccctcacagtttgttccatccaacatgnnctgtaattttgtacagcataataggtttaatacaggagcgagtgaaattcgccaaagaangctaaaatggaggaaaaaccgaagaaaaaagatgaaaaagctacggacgattattattatgaaagattcaaaaaacagtttaaaagatatattaaatgttttagtaaaaaaactataattttatcataaatatagtaataaactggatttg

SEQ ID NO: 18163 - DNA, 896 bp, Diabrotica virgifera
  misc_feature (794)..(794): n is a, c, g, or t
  misc_feature (825)..(825): n is a, c, g, or t
  misc_feature (875)..(875): n is a, c, g, or t
ggattatggtgcggctgtacaaattatcgatgaatgcgatactaataacatggagttggaaagattcgtggacgatatagacgacgcagaacagtacaacattaacgaagcaataacggggtacgatccgactgacgaagcgagaatatgcagatttaccagaccagatggaacatgtttcaaaaaacattgtaaactagaacatattcagtcgcgaaaagatggatttacaacagaccaggatgaagtttatactaaagctatgtgcccattaattcttcccagcatggattccaacgtccccatacttattacgggaaatatttcagtatgcagattctatgcccagattattaataatccgtacaatacaggaaggtatattatggatttacaattccacaacttagatcgagaaatgaacgccgtagaaactgttaagaagtacgaaacctttaaaatagacccagcgcttggagaaatagttttggtttggttggaccattggaagcgatggtcgagggcgatagtacgagaactacttttttcgggcgacgatagaaaagtccaggtgtacatgttggattacggggaatatcaaatcaggttaaccaatgagctgagaaaaatattgccgcaatttttattactaccattccaagcagtcgaatgctacattcaagattacgaattaaatacttcgtgtccattaaaagaagctaataagtttttcgacataaacatgcatcttcgcaactttactggcatcactaagtctgaagatgaacccttcnaaagtattctgagaaaccagaccaacaccanggacgtcggtcagacattagaagagcatggcttttgctagagaacagaanagacattaatgtctctgataa

SEQ ID NO: 18164 - DNA, 629 bp, Diabrotica virgifera
atttaaagtccacattaactgattatgaaaccgagagttagggttagaaatattggacgaattaaataggtcaaataaattatcaaatctttgaatgatctcagtagttccaacagcttcaagaggcagcatattaaaacgaatgtacaaggttaaaccagcagcaattgtgctactacgcacctgagttgatagtcaaatcttcaagattgaaagtatgcagaactggtatggaaagtgtcaatactgtttgttataaatactgggttgcgttgagagctgaaatacttttgttatatacagggtgagtgatgaggaacgcaccaagcttgaagactgtataatgtacgtaataataacaattgaaaataactcatatgttgttattcgattttcatttgtttccaagatacggggtgttaaaatttttcttacaagctggcgatttattttattgctttaaaaccgggtgagatgtgccaatgaggtttggcgggttttaagccgtagttattgcgcagtttttgacatacaggtgggaattttatattcaccattggcgcgcctacgcgtatggtctgaaattttttaaagataaaaatgatacgccggtgatatatattaaagaa

SEQ ID NO: 18165 - DNA, 360 bp, Diabrotica virgifera
  misc_feature (16)..(40): n is a, c, g, or t
atgtaataattatagnnnnnnnnnnnnnnnnnnnnnnnnngataataatgtagaaaatttattaatgaatatgaattttaagtaattttttagagaatagatggtaatagatatagaaaatagcaaagattttaagaaataagttaaatttaatgatgaagattatatttataatgagatagtgtaataagattagaatataaagagatttagtgataaattgagattaggagatgagtaaagaataatattgtgagaaaaattatgtataaaactttgcgtatgatataagaggatatgtattagatatacgaaagataaaaagtagttggaatatattgtgtattacgagagttcatt

SEQ ID NO: 18166 - DNA, 760 bp, Diabrotica virgifera
  misc_feature (202)..(220): n is a, c, g, or t
  misc_feature (732)..(732): n is a, c, g, or t
atgccagtgaagaatttgatgatcttgaacttaacagtaataatgaagatgatgaaactaatgataaaagtgaagaatttgaagacgatgatatagggagtgatgaaaatgatagtgaagatgatgaagacattgaatttgaagctatcaacaacaaaaataaaagcaaaaagagaaaactgaaggaagctgtagtaccaannnnnnnnnnnnnnnnnnngccattaccagatgtatctaatagtgcaagtgatgaaagtgatggaaatgatgattttgatgctgttgatacaaatgaaattgacccagaagatgaaggactatcagatgatgaggatggcagtgataatgaggattcagaagaaaaagatgtccacaaaggggctgccaaacagtttccggatggtacttgggaagacatatatggtagactaagaggaaaagatggatctattattacaaaaaaatcagagtccaaatatgtaccacctgcattgagaggaaaggaaactgacaaaaaaagatcagaacagttaagccgactaagaaaacaattgaaaggtttaataaacagattagcggaaagcaacatgcacagcatagcatctcaaatcgaagatctatacatgaacaacagccgaaacgatatgaatgatactctaacaaacctaatgatggaatcactggtagctgaggtactaactccagaaagactgatgattgagcatgtgntgctttctattgtactcacgctaaatgt

SEQ ID NO: 18167 - DNA, 930 bp, Diabrotica virgifera
  misc_feature (263)..(280): n is a, c, g, or t
  misc_feature (687)..(708): n is a, c, g, or t
  misc_feature (811)..(811): n is a, c, g, or t
  misc_feature (823)..(823): n is a, c, g, or t
  misc_feature (847)..(847): n is a, c, g, or t
  misc_feature (861)..(863): n is a, c, g, or t
  misc_feature (877)..(877): n is a, c, g, or t
ctctgggctatggccttgacaattatccagtaaccaggactaatataattggccaatataattaaaagtgcgagtaaagttgcagagcgtagaaataggtgtcgctttgccgaacttgcacggtcccaatacagcactgacacatttgtataattgttgaagctctggtttttctgactgcatctgtcggtttatgttattaaaaaatggcaacgaaaattctaagaattgcaaatatattttggtaaattgatcctttaacnnnnnnnnnnnnnnnnnngatgccaacgttcggtcattaaaagacgcatccgtgaagaataaaattaatggactatattgttccagaattctggagacaacagatttgatggagagccatctagtctgtgcaggatgtaagattttatgtacttttacattagaaaagtgttgaaagtcttttaaaatttcaactctttttggactattagagaaataagagtatatgtcacgtgccaaattttcaatgcctctaggcaattttaaacatgcatatgaagcgcatatgtggaaactgtgacatatacactttattatgtaaacgtgtcgtatgtccgctttcagtctggacacaaataagttatgttttccgaccataacattagctccatcagatgcaaatcctattaaattttgtcgatacgnnnnnnnnnnnnnnnnnnnnnntttctgactgctgtgtataaatcctcggctttggcctctttaagcggtagcaaggcgaggaaactatcttgaattctgcaagaatattgatttttagacttanataaagtaaggngttacatgggttttagggtataanaaattactttttannnaaatatatctcganactaaccattactgtcatttgcatttaagacataaagatagtacttaagcact

SEQ ID NO: 18168 - DNA, 878 bp, Diabrotica virgifera
  misc_feature (142)..(160): n is a, c, g, or t
  misc_feature (298)..(320): n is a, c, g, or t
  misc_feature (402)..(421): n is a, c, g, or t
  misc_feature (528)..(548): n is a, c, g, or t
gtcttataaatacaactaaaagaagaaaaaataattaccagaaaagtgtgttcaaaagttgccgaaaaacaagtataaaactgataaaaagtaattaaccgcattgtaaactttcacaacatgccctagccctaatgaacgnnnnnnnnnnnnnnnnnnngcaaaaatgtgtgtctaccgtccacagagaagatttgaaaaactatccgataatttataataatgaaaaatagacttaaatgacacataaaaagaagaaatgccaccagtattatacactgtacattaaataaagcannnnnnnnnnnnnnnnnnnnnnngcaagtgttaaattaagagtttttattgcaagagtttcccacatattacatatattatacgactgaaaaatggacaatgcannnnnnnnnnnnnnnnnnnnaacagctatggaagtgacttatctagtaagtatggctggaaagatcacaattattgatagatacagaaatgaagaaactagataagagataaactaaaaatatgtannnnnnnnnnnnnnnnnnnnngaaatagtttggctgatacggatatctaatggggatatacctatatttttttaaaggtctttactgaatgaatgccttcatttttttttctgattagaaaattttcaaattctgaaaactagttgacactggaaaatatttaaaggaatgtacaagaatatttttctctcagttttttctttgactgccttgttgttcggtctcttaacattatactacaggtaaataagaaaaaataatcctgctcaaagctgtcacaaatgtatatctgatgtttgtctgaagctatttcttttgtgaatttttgtaattaactattctaaatggaaa

SEQ ID NO: 18169 - DNA, 108 bp, Diabrotica virgifera
  misc_feature (4)..(5): n is a, c, g, or t
  misc_feature (13)..(88): n is a, c, g, or t
  misc_feature (93)..(106): n is a, c, g, or t
attnnattatatnnnnnnnnnnnnnnnnnnnnnnnnnnnnnnnnnnnnnnnnnnnnnnnnnnnnnnnnnnnnnnnnnnnnnnnnnnnntccannnnnnnnnnnnnnga

SEQ ID NO: 18170 - DNA, 108 bp, Diabrotica virgifera
  misc_feature (7)..(44): n is a, c, g, or t
  misc_feature (78)..(100): n is a, c, g, or t
taacagnnnnnnnnnnnnnnnnnnnnnnnnnnnnnnnnnnnnnntgcgacctcgatggtggattaagtttatattggnnnnnnnnnnnnnnnnnnnnnnntggtcgac

SEQ ID NO: 18171 - DNA, 694 bp, Diabrotica virgifera
  misc_feature (6)..(693): n is a, c, g, or t
gatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 18172 - DNA, 689 bp, Diabrotica virgifera
  misc_feature (8)..(491): n is a, c, g, or t
  misc_feature (493)..(687): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngc

SEQ ID NO: 18173 - DNA, 805 bp, Diabrotica virgifera
caagcattctccatacatcatatcactactttttttcttaagaacaaatagtattgtgtacaaattgtatgtcttgtcaatttccaggagaaactaaaattaaattttacttacattttagaaaaaccctccattctaaactaaacaaaattgtttacaattgtttctttctacgaaaccatttagaaacatggtctattgtccattccaaagcggcacattaactttctaaaactaccgttttctagttcattgttttgaaatgtattaatccgttcgtagaaactttaccactagactttgactcttccacgaaacactgcttacggctaaattattttatttacaaattttggtcatatacaaggcgataaaaatttacgatctcgtggtctttaacacaaaattaattctctaaattctccccataaaaattatttaacagtatatacattgtaggttatgattcgggtgtgctcctagtggcgtttggcgtgtcttggtttgtttatttctactgcatcttgattgtaaatttagtatatatcatgttaggaacagacaaccaaacaacatacaaacaacaacacataaacaaagagtatgactagcatgggtagcttatggaaaactgagggaagtgtttaaatcagatattcccatgtgcttgaaaagaaagattttacccatgtgcaccagaaaaataataaacaaaatacaagtagcacagagggccaaaacaatggagaggataatgttgaatatatctctcatagatacattttcaaaatcaaataggagaaaa

SEQ ID NO: 18174 - DNA, 846 bp, Diabrotica virgifera
  misc_feature (20)..(47): n is a, c, g, or t
  misc_feature (800)..(819): n is a, c, g, or t
aaatcgatataaagagtaannnnnnnnnnnnnnnnnnnnnnnnnnnncttcgtaaaactaatatttttcgagttggtcgtggttgaaagtaacagtttttcgacggaaaaatcgacatttttagagggttttttgagagtaactcgaaaaatatgcatttaattaaaaaagctgtagatatcaaaattgtatcttttattaacacaaacgaaactgtttttctatattatttttacgactaatacaaaccgagatacggcatgttaaaggttagtttttttagtcaaatgcataatttgaaataatcaaagccaaataaagggaaaactttgcatttttcctagaaaacttacatgatgttttttcaagcatacaataagctctttcaataaaaataataaaaagtttttagcataaaaattgagcaacttatgatcaaaaaaaagtcggtacctatttttctctatgaaaaaaaacagtgaaaacaacctcctaactacccttgtaactaaaaattggtcttcgcctttctgtaattccttttatattcatattatcaatacacccaagaagtttgacctattttcttcaaaatatctccgaaaatactggaggtacgaaaaaaaatgatagactactaaattgtagctattttaatagctaaaatttctttatgcatagattttcattacagtgaaaagttagcgagccccctttaacccacctcaattaaaaattaagagatcttacggaatttaatttacacagtcttattactcttcaaatatcctacaaaactnnnnnnnnnnnnnnnnnnnnatcgccaaaattaaggagctatgttta

SEQ ID NO: 18175 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18176 - DNA, 583 bp, Diabrotica virgifera
  misc_feature (14)..(39): n is a, c, g, or t
  misc_feature (57)..(76): n is a, c, g, or t
  misc_feature (553)..(571): n is a, c, g, or t
agaagaattgaggnnnnnnnnnnnnnnnnnnnnnnnnnntaaattgagtatcagggnnnnnnnnnnnnnnnnnnnnaatttataatcctcgaatagtaaatagatataatgttaaaattatcattgaaaaatgaatatttcacttaatttttactttatgactgttatgcgctcacacatatgtcttaattctcacagaaagaaattcatgttaatcattaacaatgtagttatcattaaaaatctgcatattataaaaattaattatctgcatgtacgggtcccttgataaagtttatacccaattcattgttacaacaaagattacgaacacaatttttcatatcttataatatgtctattattgattctgatatattattattttcagtttttaggatgattatatgatagaataagtataaaacaacagcatcagaattgatgataatataactgttacaaactcgtctatttagtataaatatataggcttaataacgaaatactgcaacagttttatcacccgtttattaacgtaatgtcttttcgnnnnnnnnnnnnnnnnnnnactgccctactg

SEQ ID NO: 18177 - DNA, 913 bp, Diabrotica virgifera
  misc_feature (739)..(753): n is a, c, g, or t
  misc_feature (796)..(796): n is a, c, g, or t
  misc_feature (803)..(803): n is a, c, g, or t
  misc_feature (833)..(833): n is a, c, g, or t
  misc_feature (840)..(841): n is a, c, g, or t
  misc_feature (856)..(856): n is a, c, g, or t
  misc_feature (879)..(879): n is a, c, g, or t
acaaatttttcacctcttgtcgcattgcattctttttcggcatggggaagtaaccaggattgtttagtccttcgtcatactttttttgattttgtaaatacactaatgtacctgtaatctcatagagacgccgttccgtgattctgttgcgtagtgcttctgatagatctgtattaaggctaaactcctggctatttagtttgtctaagacaaatttagctggttaaaagtggcgattaactcattgattattgaccactcgccagcagagaattttatgacggaatcaatgtatatcaacgctttatggatgcaaacttttaagctatagaaactttccagcatactgagctactgccatcgcaataaaatggcaagttgccgactcacggctttgaataaagatgctaatgaagacattaagtaacttatttcaaatttgacacgtttgcggatccgcgctgctggatcaggcatggtttgctggatccagcatgtgaaaaaagcgctggatccagctggattcctggatgctggatccagcaattgcaatctctattcgtaactctatcgacccaggaaaccctcataattcttctataggtccacatttcaaaggcgttaagtcgtctcattgtctctacatttaacgtcaatgattccactccatagtatagtacactgtatacgtaacatttagtcgaggaaatgaagcattttggctcgcaattttttcgtnnnnnnnnnnnnnnnttgaaattttcacagaaggtagggaatagtccaaggatcattntctatangtatcatgccgctgtacgctaaaccttggngggtggnntgcaccccatctcgngggcgggaatttttattacattngtactctacaaatcgatgtaaaaagtgattatag

SEQ ID NO: 18178 - DNA, 901 bp, Diabrotica virgifera
  misc_feature (252)..(273): n is a, c, g, or t
  misc_feature (275)..(287): n is a, c, g, or t
aaatttgcatacactcgtgataagtgacttgttcaagcccttttaactacagctctttcaaaaataagaactttgaaccggtgaagcttgcagatcatatgaccaatagatacgggagtaaaaaacttgtgaggtgttagcaattgagttcatttgaaatgctaattgggtggtgattttcccgatttcttgccaaaagaaggggaccagctttattttgagcttaacttgtttgcttttggtgctaaaagnnnnnnnnnnnnnnnnnnnnnngnnnnnnnnnnnnnctttaaaaaagtttaaaatgagttttccccacaagggtgctttgttttttggttattagtataggcgccaactagaggtcaccgtgtccttttcaattctgatggacagactcaacggtttcttgtggatttttggctgctgattgcgagtttcgagggtggatttcgatccgagtggtcagggagttgttataaacaatttaattgtttataaattgtttataaggctcataaactcaaaagatgggaaatggtgtttcaaatggaatttgtttgttaataaaaaccgaggaaggaacgtttactgaacttaaatccaacaattgggactcgggatattgtggaattggtgcacaatgcgaattgcaaattgagaaatgagtatttttggaagctttttcgatcgtaattcggctcctgcgcatgtatgtgagccttggaaggtctcattttgaagcttcgttaataggcttccaggcggattttgttagattgcttgatctttatttggttttggggtgtgcgcggtttgagggggaatttttcttaaaaaaggtgtacattggttggtttatggggggttcaagaaaatttgggctgggaacgtgtgaacc

SEQ ID NO: 18179 - DNA, 747 bp, Diabrotica virgifera
  misc_feature (52)..(52): n is a, c, g, or t
  misc_feature (59)..(59): n is a, c, g, or t
  misc_feature (92)..(92): n is a, c, g, or t
  misc_feature (95)..(95): n is a, c, g, or t
  misc_feature (98)..(98): n is a, c, g, or t
  misc_feature (101)..(101): n is a, c, g, or t
  misc_feature (149)..(178): n is a, c, g, or t
  misc_feature (194)..(225): n is a, c, g, or t
  misc_feature (250)..(267): n is a, c, g, or t
  misc_feature (269)..(291): n is a, c, g, or t
  misc_feature (396)..(414): n is a, c, g, or t
  misc_feature (445)..(471): n is a, c, g, or t
  misc_feature (627)..(657): n is a, c, g, or t
  misc_feature (692)..(722): n is a, c, g, or t
cttcaacatagtccgggtattttataaaattgtggggggcctttaaaaaaanttaattnaaggagagaaaaaaggagagggggagaggaatnaantanaanaaaagaaaagccccttttttgtggcttgtgtattaggtattattaagnnnnnnnnnnnnnnnnnnnnnnnnnnnnnncaacagagttatgaannnnnnnnnnnnnnnnnnnnnnnnnnnnnnnngagaatggttttgtgatgaactgannnnnnnnnnnnnnnnnngnnnnnnnnnnnnnnnnnnnnnnncatttattgattaactatatatctataattaaatatcttttatattatcgaatattagatattattaggctgtgagcttaaacaatactatgtgattaaaattcnnnnnnnnnnnnnnnnnnncgattagcaattatcatatgttaaaataagnnnnnnnnnnnnnnnnnnnnnnnnnnntgaatatccattacaaagttttgattaacgaaatgaggatatattagtgtcataaaattaaatgatgagaatataagtataggcctaatagtataattcggcaacatattttttcacctgattattagaaacatgtcatattgaattactcatctnnnnnnnnnnnnnnnnnnnnnnnnnnnnnnnaccgagtgattctgaccgtgctacggtagctaatnnnnnnnnnnnnnnnnnnnnnnnnnnnnnnncgactggatgaataaaaaactgact

SEQ ID NO: 18180 - DNA, 619 bp, Diabrotica virgifera
  misc_feature (2)..(381): n is a, c, g, or t
  misc_feature (388)..(425): n is a, c, g, or t
  misc_feature (445)..(458): n is a, c, g, or t
  misc_feature (461)..(483): n is a, c, g, or t
  misc_feature (491)..(513): n is a, c, g, or t
  misc_feature (544)..(575): n is a, c, g, or t
  misc_feature (582)..(618): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccaggttggttnnnnnnnnnnnnnnnnnnnnnnnnnnnnnnnngaaaggnnnnnnnnnnnnnnnnnnnnnnnnnnnnnnnnnnnnna

SEQ ID NO: 18181 - DNA, 909 bp, Diabrotica virgifera
ctctatattaatatgcgaatgtgtttagtatctgctatttaccgaatattactacaaatgacagtgtagttagcgccagacagcaccctagatacgattaaatatggtaattttctctccatttatctaccacgatcgtaaactctcctttcggccacacacctgaacaacctggatgtgcttttactgtcgattaaccgacgacttctaattaatgcacttgattccaatgtccgtacggaactacctataactgaatatttgtaacacatcaaaatccccactcatttatccgaaacaggagcatatgtatacgcgatcgattgacgacatacatgtaatcctttagagtatgctacgttcaatcctgatcttaaaattgattcgattattcacaaaatctgcccgcagatatcaagtggtcaaaatggaatgaactcctgcctatccttactgcagacgaagaaggctatcgataaattgtagaatattttttcatatttgttatttatgtcccatattacaactacaaataatgacatgacacctcttcatatggctgactgtaacgactacatcgaattatagattatttactgatatatcaagctcacgtgagcgtcaactgtgctcgttatcaaagtgtaattaattattcaggtgctccctccaccggtaccaccagttaaatctgagtctgcccaaggagaagctataaatgatgaagctgcagtagggaagcagaatatacagcataagggtagagttcagatagtagtgaaaaaagtactagaaccagaagaagatgatagtgacgatgaagaggaaactgtagtaagtaaagctaaaatcccagaagtagtgacgaaacacgaagctgatagtgatgatgacgatgttaatgaagag

SEQ ID NO: 18182 - DNA, 78 bp, Diabrotica virgifera
  misc_feature (2)..(70): n is a, c, g, or t
gnnnnnnnnnnnnnnnnnnnnnnnnnnnnnnnnnnnnnnnnnnnnnnnnnnnnnnnnnnnnnnnnnnnnngttttttt

SEQ ID NO: 18183 - DNA, 402 bp, Diabrotica virgifera
  misc_feature (304)..(319): n is a, c, g, or t
ccagtttattctccgccaacagccgtgactctctttaaaagaagcctactgactaaggtgatcgtgtgtgcattatcgagtgtccctgactctaccattgcatttctttctatcacctggggcaactagacgccgctgtgtagagaaaagaaccaattgcagatacaagcagagtatgacggctgagcaacgagactgtcataggcccactatgtccgtagtttgcggtctagacggagaccacacacgtggtttctgcgcctaagatgattgtcgacgctgctgactcaaatgaagtcatgannnnnnnnnnnnnnnngaaaaaattgaaggtatggtcttcaaggaacgcttgaagcactagacacacacaactattgatcacgaacgattacttaccga

SEQ ID NO: 18184 - DNA, 659 bp, Diabrotica virgifera
tgtacttagtaaatcgatagagttcattgtttggtttattttggccagcaagctgttccgctgactgttgaatcgggtgatttgaaagcagcctatcaggatgaattaaagaatcatgcttggtggcctgactcgtggattagataacaatggcaccaaacacgtcaatgcccaccggtgttcttcatgaacacgatgacgaagtccaagcaaaaatgattcccgcggaaattgtaaaaccaagcgagcgcaaacttgaactggtttggcgcaacatcattctttttgcttatcttcacatggtagcgctgtatggattttatctgatgatagcacaggcgaaagtatttacttcgatattggctgtagtgttatatatttgcggtggtctgggaataacagctggtgctcacagactgtgggctcatcgctcctatcaagcaaaatggccactgaaaattatccttaccatctttaataccttagcatttgagaactcagtaatagaatggtccagagaccacagagtacatcacaaattcagtgaaaccgacgcagatccgcacaacgccaagagaggattcttcttcgctcacgatggatgtctactctgtcgcaagcatccgcgaagacaggagccatggcaaagtaatcgtcat

SEQ ID NO: 18185 - DNA, 752 bp, Diabrotica virgifera
  misc_feature (289)..(306): n is a, c, g, or t
caagaaattatgaccagtataaaaagtcacctattaaccaaacaagttcagtcgcatctaatcgaggcagcgacaatatcacaaggaggcagccgagtaagttttccatattttattgcatttaactccttattaaataatatggaattggtcaaacgcatttaccttaatgtcaccaacggtcatagaacacaagaagtcagcaaggaggaatttatgcattcagcccaggctatgtcacaaatgacgcccttagaagtcgacatattgttccaattgtgtgacgttnnnnnnnnnnnnnnnnnnatcgtgtataacgatttatacgccattgcacccgagcaatactttaagcaaattacgaatcgattggccgaaatccacgctgtttcgagcccggaagatagaggagttgttattcaaattttagaaagtacttacagatttgcattgggttcgattgctggtgccgttggtgctactgcagtataccccatagatttggttaaaacacgtatgcaaaatcagagagcaggctcctttattggagagttgatgtaccgaaacagttttgattgcttcaaaaaggttattagacacgaaggtgtatttggattgtacaggggactggtacctcaactactaggagtcgccccagaaaaagctattaaattgacggtaaatgatttgatcagggacaaacttatggacaaaaatgggaatcttccaatatgaagtgaaatactggctgg

SEQ ID NO: 18186 - DNA, 531 bp, Diabrotica virgifera
  misc_feature (2)..(297): n is a, c, g, or t
  misc_feature (299)..(336): n is a, c, g, or t
  misc_feature (341)..(367): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnaatgnnnnnnnnnnnnnnnnnnnnnnnnnnnacaagttgaatgaccgccgtacactgaccgggctaacgcagtgaactcattatcttcattatcaacacagcgggtggaccgagcgcctagaaaagccaacatgatccacttcgcccaacgttgaacgtccttcattcacctattacgccatccatcgacactcc

SEQ ID NO: 18187 - DNA, 172 bp, Diabrotica virgifera
  misc_feature (39)..(57): n is a, c, g, or t
gcgaggtattttgagccgtgctaagggagcattaattcnnnnnnnnnnnnnnnnnnngagaggaaaggaagggcggcgagacaaaaaaacgtctactttactttcatgttataaaaaaatttaaagttggaatcaatcccaaattattattgctttaaaggaacgtgacaca

SEQ ID NO: 18188 - DNA, 222 bp, Diabrotica virgifera
  misc_feature (23)..(58): n is a, c, g, or t
  misc_feature (60)..(101): n is a, c, g, or t
  misc_feature (111)..(129): n is a, c, g, or t
  misc_feature (131)..(183): n is a, c, g, or t
gacgaagaggacccttatagagnnnnnnnnnnnnnnnnnnnnnnnnnnnnnnnnnnnngnnnnnnnnnnnnnnnnnnnnnnnnnnnnnnnnnnnnnnnnnnggggtgggannnnnnnnnnnnnnnnnnnannnnnnnnnnnnnnnnnnnnnnnnnnnnnnnnnnnnnnnnnnnnnnnnnnnnnccccaatcttttttttgagataataaagtaaataaaatt

SEQ ID NO: 18189 - DNA, 216 bp, Diabrotica virgifera; identical to SEQ ID NO: 10770
  misc_feature (6)..(28): n is a, c, g, or t

SEQ ID NO: 18190 - DNA, 658 bp, Diabrotica virgifera
  misc_feature (15)..(15): n is a, c, g, or t
  misc_feature (21)..(21): n is a, c, g, or t
  misc_feature (23)..(23): n is a, c, g, or t
  misc_feature (31)..(32): n is a, c, g, or t
  misc_feature (58)..(58): n is a, c, g, or t
  misc_feature (61)..(118): n is a, c, g, or t
  misc_feature (120)..(135): n is a, c, g, or t
  misc_feature (137)..(176): n is a, c, g, or t
  misc_feature (240)..(260): n is a, c, g, or t
  misc_feature (262)..(354): n is a, c, g, or t
  misc_feature (373)..(392): n is a, c, g, or t
  misc_feature (394)..(417): n is a, c, g, or t
  misc_feature (454)..(482): n is a, c, g, or t
  misc_feature (511)..(536): n is a, c, g, or t
ttctacataggccgnggaggngngggaaagnnaaattataaacctttaaaaagaaganaannnnnnnnnnnnnnnnnnnnnnnnnnnnnnnnnnnnnnnnnnnnnnnnnnnnnnnnnncnnnnnnnnnnnnnnnngnnnnnnnnnnnnnnnnnnnnnnnnnnnnnnnnnnnnnnnnattggatagttaatgattaatttgaatggaagtggtattttgaaagggataaggtagaataatnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaagattatatatgggnnnnnnnnnnnnnnnnnnnngnnnnnnnnnnnnnnnnnnnnnnnnatgtagattaattttgttgttttgaaatatgaaatgnnnnnnnnnnnnnnnnnnnnnnnnnnnnnaagtatattgtttgtagtattgtataagnnnnnnnnnnnnnnnnnnnnnnnnnnaagataagaagaggatttggaaagttgatatttagtgaaaatatgtaaggttaatgaaggaattaggaaatagttttgttgagtgtttattagagaaatgatgtttttgtattatatattaa

SEQ ID NO: 18191 - DNA, 114 bp, Diabrotica virgifera
  misc_feature (3)..(28): n is a, c, g, or t
  misc_feature (34)..(59): n is a, c, g, or t
  misc_feature (70)..(113): n is a, c, g, or t
agnnnnnnnnnnnnnnnnnnnnnnnnnnaagacnnnnnnnnnnnnnnnnnnnnnnnnnncttattggcgnnnnnnnnnnnnnnnnnnnnnnnnnnnnnnnnnnnnnnnnnnnnt

SEQ ID NO: 18192 - DNA, 112 bp, Diabrotica virgifera
  misc_feature (2)..(30): n is a, c, g, or t
  misc_feature (33)..(52): n is a, c, g, or t
  misc_feature (97)..(110): n is a, c, g, or t
tnnnnnnnnnnnnnnnnnnnnnnnnnnnnntgnnnnnnnnnnnnnnnnnnnnacataatcattagattttttattgaaggctggcaagaagggttgnnnnnnnnnnnnnngc

SEQ ID NO: 18193 - DNA, 926 bp, Diabrotica virgifera
  misc_feature (2)..(24): n is a, c, g, or t
  misc_feature (33)..(678): n is a, c, g, or t
  misc_feature (680)..(726): n is a, c, g, or t
  misc_feature (733)..(770): n is a, c, g, or t
  misc_feature (792)..(792): n is a, c, g, or t
  misc_feature (806)..(828): n is a, c, g, or t
  misc_feature (836)..(858): n is a, c, g, or t
  misc_feature (888)..(919): n is a, c, g, or t
cnnnnnnnnnnnnnnnnnnnnnnngctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttaaaccggtgtgagccagggtggttnnnnnnnnnnnnnnnnnnnnnnnnnnnnnnnngaaagga

SEQ ID NO: 18194 - DNA, 862 bp, Diabrotica virgifera
  misc_feature (49)..(69): n is a, c, g, or t
  misc_feature (129)..(152): n is a, c, g, or t
  misc_feature (651)..(677): n is a, c, g, or t
  misc_feature (767)..(767): n is a, c, g, or t
atttcaatgatgaaagcgaaacgagaatttctcctttttcgttaatacnnnnnnnnnnnnnnnnnnnnnaccatacaattaaaaacaattttaaataatgaattcggtagttcaatagtactgcctacnnnnnnnnnnnnnnnnnnnnnnnnattcataacgaagtttataatctataggctaacattattcttcttatccatacacatattccttttaagatattttaaaagtacttataagtatgtgtcaagtatatacttttatggaatattcgataagggtatattctaagaataaacttttttgaatattccgagatactacttacacgaatgtactcagtatattcggtacgagaatattccttaaagtatatgcaaagaacatgaaatttagaatgttttttatggtacatgctacgcttgtactacgcatatactaaaaagaatatactccgacgaatgttggtagtatatgctttgaacatgatgcgaacatcattgttatgtgggtagtttcgtctattcagtctgctgttgtatcagtgtgatgaaatgatgaaaccagtgatacatttctattcttggtacatgcgatggcaccataatatgtgcatgcgcataaatgaacaacggtggtctatcaggnnnnnnnnnnnnnnnnnnnnnnnnnnngacatttttggtaaaatgagaacaaaagacgaagagcagataacctgtgcaggcagaaaaagagaaagtacgaaaaccaacggatactanacatagagagggagtttaaggaaaacgaaacacgtagtgcataccaacttattaaacattttagacagggatataaaccgaagactagcctctgc

SEQ ID NO: 18195 - DNA, 890 bp, Diabrotica virgifera
  misc_feature (861)..(861): n is a, c, g, or t
gatgtagcttgtgattcttatcacaaatggcaagaagatgtacatattctaaaagacttgggtgtggacttctacaggttttccatttcatggtccagaattctacccactggctactctaataaaatcaacgaagaaggtgttaagtactatgagaatctcattgacggattattgaaaaatggcattcaaccaatgataacgctgtaccactgggacttaccaatgcccatacaagaactaggtgggtggacaaacataaaaaccgcggaatattttgaagactacgccagaatagtgttcgagcgttttggaaacaaagttaaatattggatcaccattaatacggctttgttgggttatgctgactcagaatttcctccttacattaatcaaccaggcataagtaactatatgtgtatttacgttactcttctggcgcatgctaaagccttcaggctctaccacaatgagtttaaacaatataaaggacaagtgggtattgtagtagatggacgctggtaccaaccaggaagtgattcagataaagatgttgaagctacaaatagagcactcgaatttgagattggcatttggttgcaccctctccttagtccaaaaggagatttccctgaaatagttaaagaaagagtcgcagctatatccatggctgagggctaccgacaatcacgattattaaagttttccacaacagatatagatcttctaaaaggtagcgttgattttgttggtttaaatctctacacatcgcatttggtagagcatgtggaagatgagcatttcaagggcacgtcaactataagagatgaagggattagattatatcaagatgcatcttgnaaaggtcacagtcaacttggttaaaggtc

SEQ ID NO: 18196 - DNA, 980 bp, Diabrotica virgifera
  misc_feature (2)..(20): n is a, c, g, or t
  misc_feature (50)..(67): n is a, c, g, or t
gnnnnnnnnnnnnnnnnnnngttttaagaaaaatccttcaaaagttcgannnnnnnnnnnnnnnnnncactttctgggtaaaatttggctccctctctgactactttaaggtaacaactatccaaatttttttaagcgaagaaggtagcgtctagcacaagattgtttatttttgtatgttaaccagctactgtactgtttcttattcttctagtgtctattcgttatcgaatgatcgtcatgatcgtttaacgataattttatttgttgctgctctgactagtccacatatattccaatttactgtgtaaattatttctctttctttattcagtgaagtctatattatatttcttaataacttcagatactttgaccattaaaagctataattcgtgtaacaacttcttagaaaattgtctctgagtacatggtgactatgagtgatgaaaaaatacatcctggtcgaacatcgcacataactgtcactccctctgttgaaatccttgttgtggacttcaacagaagctgattgattccactataaatttcggaatatacgtaggtgctttactattttgtagaacttccatagttttattgtggtgaacttcgttgatataaatccagcattctctggaggtcatcctcatcctcattggtgctacaacgctgtcttccaatttttatgagagatatcacatctttaccaccaatcacctattaatagttgtaccttctcctccaaataccgttttcacagattcctcttaggattttttgttaaaatatgagcaaaaaattttcatctgtcttggagatggtccatgtttccgatgcatgtcacttccgaagcatcgcaacatacattatctttattttagacaaacatttagcagcaaaaacatatattttacttttttataaactttactcctatatttacacttaatataattcttgattttttttccccgggg

SEQ ID NO: 18197 - DNA, 978 bp, Diabrotica virgifera
  misc_feature (15)..(34): n is a, c, g, or t
  misc_feature (225)..(298): n is a, c, g, or t
  misc_feature (303)..(368): n is a, c, g, or t
  misc_feature (386)..(404): n is a, c, g, or t
  misc_feature (413)..(427): n is a, c, g, or t
  misc_feature (429)..(445): n is a, c, g, or t
  misc_feature (448)..(466): n is a, c, g, or t
  misc_feature (481)..(501): n is a, c, g, or t
  misc_feature (639)..(688): n is a, c, g, or t
  misc_feature (693)..(801): n is a, c, g, or t
  misc_feature (804)..(849): n is a, c, g, or t
  misc_feature (857)..(976): n is a, c, g, or t
acctattcgtactgnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntc

SEQ ID NO: 18198 - DNA, 517 bp, Diabrotica virgifera
  misc_feature (29)..(51): n is a, c, g, or t
  misc_feature (72)..(91): n is a, c, g, or t
  misc_feature (209)..(232): n is a, c, g, or t
gctatttcttaaataataaacaatatccnnnnnnnnnnnnnnnnnnnnnnnattagatcgtatgaaaatagnnnnnnnnnnnnnnnnnnnntcccctttgcagttttctgcgaataaaccttttttcgatgaataaaaataacctgattttgtttttaatgaaaggggagcatctgttgtacagatctagcaaacgagtcatagttagnnnnnnnnnnnnnnnnnnnnnnnncatgttttattttgtcgacttagtttgtaagcgcgttgagaataattttcccatgtgaatagagtctgatggtgatagagttgaggattccattgataggaccgatctaaagaatgatcacgagtcgtagaggcaaagaatcagaatcagatagtatgaggtgagaggaaggggcgtgatagagatgtttgtcatagagcgcatccgcagacgtacttctgatcgatagagactgattcgggagtcaagactaaccggatcactcgtacaaagaaaaatatgata

SEQ ID NO: 18199 - DNA, 476 bp, Diabrotica virgifera
gtgaagtgtattttcaaaaataatcatggctaaaccgcaatttagtcccagtaaaggaactcctgtgaataattttgggactgacaacgatgaaccctacccaagtctatcagattatcatgattatgagccaaatcttgagtttgacgactctgaacttcaacattctacaactgtcttagcccacacagttgatatgatccaggtcgaatccaatagcatgggttctccgatatcggacttcacggacgactacttcgaagaagaactagctgaagtttgggaggttaacgagggcagccgagagggtatgagggatttcttacatattttatatggtattggaagcttattggtatagtgctgagggtcacaccgtgcaggtgtaccctctgcacgagtaataggattataactttggtaaagaaggcttgcgcgtgtatatgactaaggactagccacagctgtcgggttga

SEQ ID NO: 18200 - DNA, 818 bp, Diabrotica virgifera
  misc_feature (525)..(542): n is a, c, g, or t
  misc_feature (665)..(682): n is a, c, g, or t
  misc_feature (718)..(718): n is a, c, g, or t
  misc_feature (762)..(782): n is a, c, g, or t
ctaattccatcagttttaccaattagaaatacgttcagaaactaccaccaagaactaatatacccatctaaagatctgtttggaagttcactatctctagattttccactcggcttgagtttaaagaaaccgaggattgagataccaccgttcacacagttcgctctttttgagtcaccaaagattaatggtcctcctgtatttccactgtttactccaaatacaatcgatcaaagacctgagactgttggacaaatcgaagaatacaagaaagctttagcagaagaagcggaagaaaaactaaaggaacaacaagaaaatgttatcccttcatcatttagacaattttccgggcttggcagtttcgatttgaccacaaaaccgacacattatgtaaatgtaaaatctgatgcttatacgtataaatatagagtttaaccttatagtctaagagccgatataagaacgaacttccccgatctgttgaatggataaaaattatttgatataaaatttagcatgttnnnnnnnnnnnnnnnnnngaggttcccgatataattttattcagactataattacagtgaactcttccttgaagtcgttcctcataaagtgtccgtttaaaggaggtgtccgttgaagagaaaaaaaatatgttaacttgnnnnnnnnnnnnnnnnnngcatgtatgtatatatataaaaagagaatatagtcntgttcgcttggactcagacgccaactggctacatattttagtcnnnnnnnnnnnnnnnnnnnnncccatttctgcaaaattttgcaaaaattactaacta

SEQ ID NO: 18201 - DNA, 887 bp, Diabrotica virgifera
  misc_feature (176)..(193): n is a, c, g, or t
  misc_feature (480)..(502): n is a, c, g, or t
  misc_feature (628)..(844): n is a, c, g, or t
  misc_feature (851)..(865): n is a, c, g, or t
  misc_feature (867)..(886): n is a, c, g, or t
aaaataaactgatgcacgtgtaatataatgtactagaatttaatattaaactacaaatatgcgtatagaaacgtgttacttctgttcttcaaggatatatccaggccatggaatacaatttgtacgaaatgactgcaagatatttaagttttgccgttcaaaatgccatgcagcannnnnnnnnnnnnnnnnnccacgtaaagtaaaatggaccaaggcgtacaggaaaacagtaggcaaagagttaacaatagatccatcatttgaatttgaaaaacgtagaaacataccacttaaatataacagagaaacctggtcaaaggctgtagaagcaatgaaaacggtagagaaaataaaacagaaaaggcaaggagcctacatcatgcaaagattacgtaaaggtagagaaatcgaacaagaacgagacatcaaagaggtacaaagggatctgtctcttatcagatccccagctgttggacnnnnnnnnnnnnnnnnnnnnnnntctatggcgcaagatcacagagaaagtgacgaagaaatggaaggtattattgaagatggtggagaagttacactgtaaaaaatacaatttgttgtcaataattataaacaatataacatttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaannnnnnnnnnnnnnncnnnnnnnnnnnnnnnnnnnnc

SEQ ID NO: 18202 - DNA, 85 bp, Diabrotica virgifera
  misc_feature (9)..(38): n is a, c, g, or t
ctatagagnnnnnnnnnnnnnnnnnnnnnnnnnnnnnnagaataaagttaatttatataataaattcatttaaattgccctgatt

SEQ ID NO: 18203 - DNA, 770 bp, Diabrotica virgifera
  misc_feature (49)..(67): n is a, c, g, or t
  misc_feature (324)..(341): n is a, c, g, or t
gcgttaggtactacctataagtaatttgccgccgaggattatgagagcnnnnnnnnnnnnnnnnnnnataataacgtacatttatcagaaaaatgaaaaacaaggaaggatcgtgttttacaagacaaagtaccatgtatcacgtaaaagatatgttattgtgtaggacagcgataatgtcgtactgacaacatgtattgttgatataatgatgaatcactacctaactcttgctcatgaggagcgtacactatagatagtattatatgcacttgtatcgaatatgagtgttatcgcgacgagattgatactcttacttattcnnnnnnnnnnnnnnnnnntcatcgacacttttaagatatagctatattctacacatacaatagtagtcgaatcttacaccaagttctattcctctttgtactctaagtacgacgacgatgatctcatatccaaaaaagatataactagatgaccatgtgactaacctacacgagtcattaaattatataaatgggagataatgcttctcgtagatttacaaaattgctaacatgatggtcgtcgagcaatcagcgcatatatgacaagcttacgtttatagccatataatttattaaagcaattaagttttaattatcgaatttgagctaaaacctgatcataatttcacagataacagagtcatattttgtaggtccctctgaaatttccttgtgcagcgaatagtaggtgtgaacttctctactacgttagaatagaattctaat

SEQ ID NO: 18204 - DNA, 187 bp, Diabrotica virgifera
  misc_feature (3)..(55): n is a, c, g, or t
  misc_feature (57)..(79): n is a, c, g, or t
  misc_feature (103)..(116): n is a, c, g, or t
  misc_feature (118)..(159): n is a, c, g, or t
  misc_feature (161)..(174): n is a, c, g, or t
cannnnnnnnnnnnnnnnnnnnnnnnnnnnnnnnnnnnnnnnnnnnnnnnnnnnncnnnnnnnnnnnnnnnnnnnnnnncattaaaaaactgtatatttagcnnnnnnnnnnnnnncnnnnnnnnnnnnnnnnnnnnnnnnnnnnnnnnnnnnnnnnnncnnnnnnnnnnnnnncattaaatataaa

SEQ ID NO: 18205 - DNA, 843 bp, Diabrotica virgifera
  misc_feature (677)..(707): n is a, c, g, or t
ggcttttcatcgattgtcatttgtttcgagcttctgtcgtatgttgtataatgtgtgtataatattaatatacacgggttatatgacacatgacggaggctcgacacaaatgactgagaatgaaaagccctattctcactgccttaaatgaaacacagctcataatattttttataggaagttattgccataccacaaagtacaggcttcgtctgcagatatttttatggtaatagttttaacaattactcttatatcatggtataggttgtctggctctaaacagtgtcgtgtttattcttaagtatacaaagaatgtttcatttaagtaatttttaaactttgctgtgatattgtattaccattttcttgttcatatagcatcatgattctagaagtagatatgcgcttggctatttattattcaatattgcgcttgggatatgatgtttagaactatcctcttttattaggcaaaaaatgcctaataaacattaggcaactcaacatttatcttctttatgacgtcactgacaattgacgttagcgctaccagtagtagaatcatcacgaatcacgaaacgtaaacataaatatttcaccattgggatcatgatgatggttcatttcttattgttattatgaatagagtacgttaagttaacaatttcttatannnnnnnnnnnnnnnnnnnnnnnnnnnnnnnctgcatgtatctaggtatgcctagaaacccaagtcttagtaattaaatgtaaaaataagtcattttaatatttgttttgtactatattataaagtatattaggcaatggtttgtaacatatttatttttaaagaca

SEQ ID NO: 18206 - DNA, 144 bp, Diabrotica virgifera
  misc_feature (37)..(64): n is a, c, g, or t
  misc_feature (86)..(99): n is a, c, g, or t
  misc_feature (102)..(124): n is a, c, g, or t
gaataaattacccttagggataaccgcggaattttannnnnnnnnnnnnnnnnnnnnnnnnnnntggcgacctcgatggttggatnnnnnnnnnnnnnnggnnnnnnnnnnnnnnnnnnnnnnntggtccactttttaaaattt

SEQ ID NO: 18207 - DNA, 588 bp, Diabrotica virgifera
  misc_feature (5)..(30): n is a, c, g, or t
  misc_feature (429)..(441): n is a, c, g, or t
  misc_feature (444)..(464): n is a, c, g, or t
  misc_feature (562)..(585): n is a, c, g, or t
ggagnnnnnnnnnnnnnnnnnnnnnnnnnntcacgtttgatgagaagattcgcatgtcatgaaattcgataggcaaattcaatatcggtgtatttcggagaatccctattctcttttcttatgtatgaatcacaggattacgttattataaacgaaaaccaaacgaaattgtcttatttggtttggtactttctttatacttagctaagtattaattattgaagtttagagcagggtagttacaattaaaaaacatgcattaatcttcttcttcttttagtgcctagtcgtttcgaatattggcgggcattctgtctattcattattttattaactgatgctttaaattcattgttaactgatgcaataatggattcagactaattatagttctttttttatttcagcttggtcattaagcgtaacacnnnnnnnnnnnnnggnnnnnnnnnnnnnnnnnnnnnaggcaaattactcattgttatactgaatttcacgatataaattaggctagtaaacaaataacctgcgaatattactgaataaacaaatcctatgcttnnnnnnnnnnnnnnnnnnnnnnnngat

SEQ ID NO: 18208 - DNA, 59 bp, Diabrotica virgifera
  misc_feature (10)..(48): n is a, c, g, or t
gtaaaaagcnnnnnnnnnnnnnnnnnnnnnnnnnnnnnnnnnnnnnnnttataaatatt

SEQ ID NO: 18209 - DNA, 326 bp, Diabrotica virgifera
  misc_feature (8)..(25): n is a, c, g, or t
  misc_feature (37)..(57): n is a, c, g, or t
  misc_feature (72)..(130): n is a, c, g, or t
  misc_feature (132)..(150): n is a, c, g, or t
  misc_feature (167)..(203): n is a, c, g, or t
  misc_feature (245)..(264): n is a, c, g, or t
  misc_feature (268)..(313): n is a, c, g, or t
gccggggnnnnnnnnnnnnnnnnnnaagcataatcannnnnnnnnnnnnnnnnnnnngtggaatggaagggnnnnnnnnnnnnnnnnnnnnnnnnnnnnnnnnnnnnnnnnnnnnnnnnnnnnnnnnnnngnnnnnnnnnnnnnnnnnnngcaaaaaccccattgannnnnnnnnnnnnnnnnnnnnnnnnnnnnnnnnnnnnttaaatcttttttaataacacaaatttttttaaattggccgnnnnnnnnnnnnnnnnnnnnaccnnnnnnnnnnnnnnnnnnnnnnnnnnnnnnnnnnnnnnnnnnnnnncgccaagcttttt

SEQ ID NO: 18210 - DNA, 908 bp, Diabrotica virgifera
  misc_feature (78)..(101): n is a, c, g, or t
  misc_feature (716)..(734): n is a, c, g, or t
  misc_feature (758)..(758): n is a, c, g, or t
gccgaaggtgtagaacgtcgttaaaacaatttaggaggctaatattgaacaagaaacaggctttaaagcctacatacnnnnnnnnnnnnnnnnnnnnnnnntatcaacatagccttgaatgtgttcatatagagataggttgctggctattaccttgggatcgaaatattgaagctttggtaggtagtaataggtagtaagtacctattaccacggtattatcagcacaaatatttctggtataattgccaacgaatgtgttgatcatacactttcttctattaacggctcattaacctcttctatttcgcttatatttcttatatctttggcttttagcttttcagcatatgaagttttgtattatgagtaaaatattgtcatttcatacccattatgatttgtttttgtgtttgttttgtctccattaactttttatgttaattgatgttttgtctcttacatctgttttggctggattgttttctatgacaattcatattgaatcggctgctattaaatctggtagctataattctagttggtagttttagggttctatctaggaaacttattacccgtattgctaggatcttctcatttttaattgcttgtttgttttatcgaacagagtgaattagtagttgtaagaaatagtaaataatataatatacacgtgttcgtttaaaccaacattgtgatgacaaggcgaaatnnnnnnnnnnnnnnnnnnncatatcatcaattctccttattgncatataatcttttggtagaaatcacaatacgagcttcactagactttacttgcatattacagctatattaaatctcatgtatagttggtatttatcagaaatacaggatgtttcattgatgattgagaaatatttactgtagactcttac

SEQ ID NO: 18211 - DNA, 828 bp, Diabrotica virgifera
  misc_feature (17)..(34): n is a, c, g, or t
agtgattttgttaaagnnnnnnnnnnnnnnnnnngaatttatgttaaattatgattatttcatagtttgctaagtgtgagataaaaaatgagcgtagctttaagtgataaattcaactttttcaaaaatggaatggaaggaaagtatacaatgttataagtcaattatcctttgcttcttactatctgttacctatttacttagtcttcatatatggaaaaatcctcacggcagagaccacccatcaacgataaagaaaaggttcataagtgcttttattatgttgtttatatcaccttgttttctttacattggtcttgatcaagagatgctacagaagcatacatttattgaaatactaggactgagaactcagggactatgccaggctattttcatgcctctatttctaacaatgatcctatttttgggacccatatccatggaactgtacagtggtttatcgaaagtctacatagaagagatgtattggttttctaatcttaaaaacctaatatggctgagaaatcatatcgtagcaccatttactgaagaatttacatttagaagttgtatagtacctatgttactgaactgtttcactccccttacatcagtactaagtagcccgttatttttcggggtggcccattttcatcacatgtgggaacgtatacatcatatgggaatggcatttgatttagctctaaagatttcctgctttcagttcatatataccacaatatttggaatgtactcagcatatatcttctacagaactggacattttgtttctgtatttattgtgcacgccttctgcaaccatat

SEQ ID NO: 18212 - DNA, 109 bp, Diabrotica virgifera
  misc_feature (2)..(106): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagc

SEQ ID NO: 18213 - DNA, 603 bp, Diabrotica virgifera
ctttttatccaatgatacagaggattaatattatatttgtgtcaaaggaactactacctatacaatgaagattatattaattggaaagataattgttaaacctttgagcacacggatgcgtgaaaaacaagtgataactctaatattggaaactgatcaagaagcttaccttgatatgttctcaaccaggtgtcttgattcaggtgagtacttaatcaagtctgatgacatgatatgttacgtctattgctgcctagttaccggttaccacttctacaatatatatcgactcttctttacctacatgacataaatatgatttccaagatacttacttcgatggaactcgtagagaaaccaaaatctgtaaatggtctatcggaaattatacatatattctggatagaaaatcgagaataattgtgtagagaatatctattatgatatacttcatctgacagacacctcttggcaagatcttgttctatctttaatcagtgaacttgcccaaatatacagattagacttagaacgttatagcttgaattacaagaataaagacctcgcagttcattataaaatcttagagcatgctacaggatc

SEQ ID NO: 18214 - DNA, 680 bp, Diabrotica virgifera
  misc_feature (260)..(281): n is a, c, g, or t
  misc_feature (449)..(468): n is a, c, g, or t
caagatctaaaatatgtagtctaataaatattcctaatattttgaggaccaagccaaatctgcattataaatcaagaattcttaattaataatttatacgaaacccccaccccacctccagaagagtagtgttggacgagaaagatatcattcaatatatttgtgaagaatatgtgataacgtatttatctatatttacgatcttatgagaacatttcgagaaatattactatcgacttgttacttttgaaacaccctgnnnnnnnnnnnnnnnnnnnnnngtactagaatcagttacaaatcagaattgaaatccatcatttaaatatttgaaaccagcgacgaggatagaaaaatatcacatattgatctgaattagtgatcactcactaaccatactgtatgcatgtttatttctgactagtttgactgtatgctgtaacaaaccnnnnnnnnnnnnnnnnnnnngacgacatgataatgcatcagaaaaagatcatcatttagacgaaaattcattatctcactcaatcgaatacactcacatacatatcgcctgacgatcgtacctacggcatactgtctaagagatacggtatcggctgaccactgagtaactggactgctactgagatattcaccgtggataggaagcatagtcacttattatgaatattgaa

SEQ ID NO: 18215 - DNA, 811 bp, Diabrotica virgifera
  misc_feature (271)..(290): n is a, c, g, or t
  misc_feature (301)..(325): n is a, c, g, or t
  misc_feature (375)..(401): n is a, c, g, or t
  misc_feature (567)..(567): n is a, c, g, or t
  misc_feature (645)..(680): n is a, c, g, or t
  misc_feature (696)..(697): n is a, c, g, or t
  misc_feature (737)..(737): n is a, c, g, or t
  misc_feature (754)..(754): n is a, c, g, or t
  misc_feature (781)..(799): n is a, c, g, or t
gccaaaatgtattaaaaattcgtgggaaatactgaaaagattcatttcttactttgctatgagaaaccgtgacgtcgacctcgagtattttttcattaagtgggtaggtgccaaatttgcttgcagtgctttttaaatgcattcatttttttggaatcatgaaaactcattagtatttttgaaaaatttaactccggaataaacggttacattattaccgagggccgaaaatccctgaaaacctctatgtttatttgaataagttacaggnnnnnnnnnnnnnnnnnnnntttcaaatatnnnnnnnnnnnnnnnnnnnnnnnnngttctgactttcggccctcggtaatatgtaatgtaatctttcaatctggnnnnnnnnnnnnnnnnnnnnnnnnnnngtttttccaagattcgaaaaaaattaatgcatttgataagcatcgcaagcaaattttgcgcctatcatttaaatcatttaaaattctgcgctaaatggcatttgagatatgggctatgcttcatctcacgcacttttaatgaatgatattaaagtatgagatgttngggtggatttttctacttaagccagacagtagaacttttgaaagtcggctaggaggttcatcgtatgtgctcatattnnnnnnnnnnnnnnnnnnnnnnnnnnnnnnnnnnnnttgaatcctcgctacnntggggtttcgggttgttattacttcttctatgaattttanacaagatttccttgtgntcatcgaagagtcatcacaattgacgnnnnnnnnnnnnnnnnnnngttaatattatc

SEQ ID NO: 18216 - DNA, 217 bp, Diabrotica virgifera
  misc_feature (36)..(37): n is a, c, g, or t
  misc_feature (77)..(77): n is a, c, g, or t
  misc_feature (89)..(89): n is a, c, g, or t
  misc_feature (94)..(115): n is a, c, g, or t
  misc_feature (126)..(147): n is a, c, g, or t
  misc_feature (175)..(175): n is a, c, g, or t
  misc_feature (177)..(204): n is a, c, g, or t
ataatttacctagggataacagcgtaaatttattgnnagagtcaaatcgataataaagattgcgacctcgatgttgnataaaagttatnattgnnnnnnnnnnnnnnnnnnnnnngtctgtcgacnnnnnnnnnnnnnnnnnnnnnnagtttaaacccgtgtgagccagggtggntnnnnnnnnnnnnnnnnnnnnnnnnnnnngtaccaaaagaac

SEQ ID NO: 18217 - DNA, 132 bp, Diabrotica virgifera
  misc_feature (7)..(44): n is a, c, g, or t
  misc_feature (79)..(101): n is a, c, g, or t
  misc_feature (110)..(130): n is a, c, g, or t
taacagnnnnnnnnnnnnnnnnnnnnnnnnnnnnnnnnnnnnnntgcgacctcgatgctggattaaagttataattggnnnnnnnnnnnnnnnnnnnnnnntggtcgacnnnnnnnnnnnnnnnnnnnnnag

SEQ ID NO: 18218 - DNA, 584 bp, Diabrotica virgifera
  misc_feature (122)..(147): n is a, c, g, or t
cgagcgcgtgagactgactatgatgctgcttgccgctgtcctaattgagtgcacgatcgacgagctagaggccttcgaagaatgaactatgtttattgcatcccataataaatcttacaagnnnnnnnnnnnnnnnnnnnnnnnnnntgatttccatgacaacctcaacaaaatcgaggaacacaatgctaaatacgaaatgtcgcagaataaacctactacttgtatgtgaactaattcgtcgactagaaccatagctgaattcttagataagacgtccagaaacatgtctctcaccaccagacaaatacctttatgtgcgaaacatcatgccatcatgcctcgaatagtaacgactagatatttatacaaacaatttgtaaaagaggactacacggtaagaatagttgatgaaggacgctgattctgataatggatgctattctctagcaccatcgtcatctttgatatatagaagatggtgcatcctgtctccttacaaaagttggtattagtaatacaaggattgctctactgaaagacatagatatatgacatgtatacatgtccaagaagtgctgact

SEQ ID NO: 18219 - DNA, 873 bp, Diabrotica virgifera
  misc_feature (622)..(656): n is a, c, g, or t
ttttgagttgtcttgtcacttgtcagagttgtttatctagatatctgattaaattgtagcgtactatattaaaaaaggagtattggagatatattttaatgttatttgtgttcatcgttaaattgtattaaaatggacgagtcaaagacagtttggattggtaatttgtcaaataaagttactgaagaactcctttttgagctgttccttcaagtggctcccttggaaaaagtaagaattccaacagataaagaaggcaggcagtccaatttcgcattcgttaccttcaaacatgaacaatctgtagaatatgcagtacgactgttaaatgggattaaaatgtatgataaaaaccttaatataaaacctaaaaacccaagtgctatgacccaaaaccatttccctgaaagaaacttcagtcatgagaatcaatatggtcatatgaacaaccagaatcagttttataataatgaaagagacaacagacaaaatagacataactttcgtgatagggataattatagagatgatagatacagggataatccatattctaggcatgatgatagggataggtacgatcataatagacagaaacaacattacaatgagagaaggggtnnnnnnnnnnnnnnnnnnnnnnnnnnnnnnnnnnntagctccgatggccgatattttgcaaaccataatgcagaaacctaatgttatgaagcaggattagcagcagccaatactgaacatctagcattcaagctggcatgtattcctgctttggcaattgtgactctaccttgttccataacttcgtggaatggcagttctatcaacatcactctttttatcgaattcatcaatacaaacaactcctctatc

SEQ ID NO: 18220 - DNA, 915 bp, Diabrotica virgifera
  misc_feature (835)..(835): n is a, c, g, or t
  misc_feature (880)..(880): n is a, c, g, or t
cggacgcgtgggttgtttacaaaacgtataattactgtattttttagcatttggatttgatagaatagaactttaggaattattgataaggaacaggtagcaaagtaaatttagtattcataaataatataatggatgatattgataaactctgttaggatggatgatgacagtgccagtttgtgttgctgtgaatattatgatataaactatgaaaggaaccatattttagcatgctgctgcaactgtgaagatttagatgaagcctttgaaagtctaataacaagacagggagtaactgaaaagaacaaaaaaggactaatgatgactatgaaggatagatttcgcattccatggaaaggtggagcaaagcaggtggcctttgatgctatcttaccaatttttatcctaccaactactctaattctagctagtataagcctttggtggacaatatttgcatttacatcagtcataatttttctaatactgatatcaagtttcctaattaggaccttaccacataccaagttcttttttgtctggtctttaacatcactgataattttatatgtgatatttgagtttattgtcataccatttttggagattcttttggaagaaaacatagctttgagcatactaatatttggatttctaatatgtgggtttatcatgaagaaaagaaccaaacagctgcctcgcttgggtgagaatgaacttgagaaaggattaattagtaaaagctactacaggctagtcaattgctcaatttgtcaagttagagttcctgataaagatcaccattgtgtttggtttgactggtgcgttgggnaacataaccagtgtgcttttatttctgtcctgtttttcgcattgntgccctactgtacagctcaaatttgacacttactt

SEQ ID NO: 18221 - DNA, 350 bp, Diabrotica virgifera
  misc_feature (18)..(38): n is a, c, g, or t
  misc_feature (44)..(44): n is a, c, g, or t
  misc_feature (61)..(88): n is a, c, g, or t
  misc_feature (109)..(109): n is a, c, g, or t
  misc_feature (268)..(288): n is a, c, g, or t
cgtggctataaggggccnnnnnnnnnnnnnnnnnnnnngaaggnaccccttaaaaggatgnnnnnnnnnnnnnnnnnnnnnnnnnnnnagaaagagagggagaggaganaaaaaaaagaagttttttaatggtgcttagagtttaagaaacattatttgactttgaatgtgaaagtttaagtgaaaaatctaattggttagaaataaaatgatatggtttatattgataaatgtttaatgagaggatgtggtgtgatggagaactgannnnnnnnnnnnnnnnnnnnncaaagggagtggtgaatttgggttgtaaatgaattatgtatttgaagatttggagttttttt

SEQ ID NO: 18222 - DNA, 637 bp, Diabrotica virgifera
  misc_feature (8)..(554): n is a, c, g, or t
  misc_feature (556)..(605): n is a, c, g, or t
  misc_feature (607)..(624): n is a, c, g, or t
cccttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnngnnnnnnnnnnnnnnnnnngtattaaaaacat

SEQ ID NO: 18223 - DNA, 961 bp, Diabrotica virgifera
  misc_feature (2)..(19): n is a, c, g, or t
  misc_feature (30)..(57): n is a, c, g, or t
  misc_feature (689)..(707): n is a, c, g, or t
  misc_feature (779)..(779): n is a, c, g, or t
  misc_feature (791)..(791): n is a, c, g, or t
gnnnnnnnnnnnnnnnnnnatattgaaacnnnnnnnnnnnnnnnnnnnnnnnnnnnncattgtgtacacaaaatattttaatttgctaatataacgatttctgctaggtctacaaaaaataaaagttttcaaaaaaacttttgttaatttgcaccgtttacattttttcaatttttcatgatccttataatatatgtttgtacgttctaggttccgtatcgctccaatatatgcaattgttttcattaaaatggccgtttaaaattaatctacgagaaaaagtctcttgtttgtaaaatggaccatatttacctttagcattatactttcagaaaattatattctgcgatcaaaatcatcacgagtcgtataccaccataattttataagcgtgtatcttagttttttgggaatactaccaacggacctactcccaacgtcattatttaactcttcattattataatatttaacttttaaattttgtcaaaattttgttaatgtacgtattcttttgacttgtcaaaaacgaaagaaattttgtatatttgattgaataaattctattctatgcatcatgttctaatgcatttttctgtagggatggtgaaaccatctgaaccaccatttccagcgttttctgtcgaagaaatcttcagtttttaaatctctggcggacattgcatctnnnnnnnnnnnnnnnnnnngtcttggtctacttcgttttcttctagtggacggactccaattttatatcttttttgtccatttattttcangcattctttgcnagtgtcaataccagttgagtcttttggcttcattgtctctattatgtctagatcaatttttatttctctctgaatatcttcctttctcgccctacaaatctagtgagtcgtctctaataattattttcatggatttaattttgatttaatctttgatttattcccctttt

SEQ ID NO: 18224 - DNA, 884 bp, Diabrotica virgifera
  misc_feature (6)..(43): n is a, c, g, or t
  misc_feature (45)..(823): n is a, c, g, or t
  misc_feature (825)..(883): n is a, c, g, or t
ctcttnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnc

SEQ ID NO: 18225 - DNA, 129 bp, Diabrotica virgifera
  misc_feature (8)..(101): n is a, c, g, or t
  misc_feature (103)..(116): n is a, c, g, or t
ataatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnagacgagagaccc

SEQ ID NO: 18226 - DNA, 820 bp, Diabrotica virgifera
  misc_feature (321)..(339): n is a, c, g, or t
ggtggctgtgacgtgtgattgcattgccgacatgctttcttgattgacgacgttttgtgcttgctgaaaaaacaccatcagatattgccagttattaacgacggcgtttttggcgaaaggattacgtaagatccgcgatatctacaaccgatcaacgctatttattttagtacaaattatgtaaaccaagatcaaaatctgcaataaattctagaaaaagtaaatactttcaaggctatcgaaatcagtgatgagcttccaggtggaggaaaatgttcgtcacatggttcggatcacttgcgtatagcgaagtaaatgggnnnnnnnnnnnnnnnnnnncactttcgttagaaaatacacagaaggtttatataactgtagaaattgcagtttgatagttaaaagtgttgtaaaaacatagaaaaaatgctaaatttttgagcgataataacttcatatttagagaaaagtttacaaaatttgcgtaaataagtgaattatgtcaaaaaaatgtgtaaataatagaaaacttgataaaaacaatgaatatgtactgaatttgatagaaaaaagtttttggaaatatttcgtagatgatttttctcaaattgtacaagcattataatagttatgttcctgaaaagtcgaataagggataacagttactgcaaaggacatgatcgcatctttatggatcctagttttcagtttcttgttgaggatcaccaatggatacgaagaactagttgaagtgaccggttgcgacacctgcaagttgatgctaacgtgtcgccatctgacagcagttatagcaatattg

SEQ ID NO: 18227 - DNA, 729 bp, Diabrotica virgifera
  misc_feature (26)..(46): n is a, c, g, or t
accattgctgtaacgttgacgaaatnnnnnnnnnnnnnnnnnnnnngtctgcttatacttaattatctcaagaataccgccccaaatgcggtgattgtattacatatcacatactcctgctcacaagtcttctcccatgtaccggtttgaaatattgccactgaccacacaatgaaaaccacaccattatatgtgaaattcacaaagacataacgtatcatcagaaatgatgtcaagaaacagataaccatgaaccccatgaacgactactttttgatcgaccaacgttctgtattggcttgctcatcttatgatcacagtgctgccacagactgatatgaagcattagccatttgaagtaacacttgatgaacatcatccatacattgaagctgaatacgaggaataagacatatccttctacccaaaataagctcgctccatggaccttacacaaaggaaggaaacagcaaaataatacttatgaaagagtgtcacctacgctgacatcacagtatctgcatatttcattgactctctagaacaagctaccacaagatgctggaatcattgctggactccaggtattacagtattattaacaaacccaccgatgctgccatcgcctatgatctgatacaacatacggccaatgctgaaagaaacgttctcattttcgatctgcatcgtgtgtactttgtgatgcatcaatcttaacaaatgtagatg

SEQ ID NO: 18228 - DNA, 925 bp, Diabrotica virgifera
  misc_feature (160)..(181): n is a, c, g, or t
  misc_feature (747)..(747): n is a, c, g, or t
  misc_feature (863)..(885): n is a, c, g, or t
  misc_feature (890)..(909): n is a, c, g, or t
gatattttgtctatttaatctctgtataatgacacaatgttgccaaatcataatttaaataggtactatctacctatttttataattggtagttggtagttataccaaagaatattatatactctcaggtctcagaaggtctatattctttctttttacnnnnnnnnnnnnnnnnnnnnnngccaaagatacggtaaaacggtggacatgtactaaaaaacctgcaaaacatttgtgaaaacacagggatgtgaaaatacgatagttgaatcaatattaggtcataaccacgagaagtttacaatagaaaagccgtaagcaattcaataaaaagagcagccgtgaaagatctcaacgaaaaaccaatgaagctcatctgtaaagaacttatgaagccaaatatagagacatttactaacaatgatatcaatagggtgagacaaaatttgtattatgctagaaccacttattctttaattaagcctcccaaatatatatctgaatttcataaagctcttgatccatcttctattattacaaatagaaacgaaaattttataattaaaaatgacaaagataaatcgtattgttatattaatgtttttcaaatctttgttttctttcgcctgtttccaattggtatgttgacggaacttttgaatactgtcctcgttttttcactcaattgtttagtatacatggcttaaaaaatggacaaaatataacctcgcttttagatatatcatnagaagaatgttttaaaattaattgtcctgtatccgctactaaagtaataacttcagactttgaatttccatttcatatagtgtgctgtaattgctttttacgcggttgactctacnnnnnnnnnnnnnnnnnnnnnnnggcannnnnnnnnnnnnnnnnnnnggaagacttacttata

SEQ ID NO: 18229 - DNA, 764 bp, Diabrotica virgifera
  misc_feature (2)..(652): n is a, c, g, or t
  misc_feature (662)..(662): n is a, c, g, or t
  misc_feature (668)..(702): n is a, c, g, or t
  misc_feature (704)..(734): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggatggnaggggnnnnnnnnnnnnnnnnnnnnnnnnnnnnnnnnnnngnnnnnnnnnnnnnnnnnnnnnnnnnnnnnnnttttaaagacgagagaccctatagagttta

SEQ ID NO: 18230 - DNA, 210 bp, Diabrotica virgifera
  misc_feature (176)..(196): n is a, c, g, or t
caagttcaatttgttgaagaaagcactagaagaacataaagccagcaaaaaattagtactttttacggattcctacgatgtgatatttttagggaagatggatgagatcattaggaggctcatgctaaatgatgtgagaactttttattgaacagttaacattgccatagctatannnnnnnnnnnnnnnnnnnnncaatgatcctatgg

SEQ ID NO: 18231 - DNA, 937 bp, Diabrotica virgifera
  misc_feature (730)..(747): n is a, c, g, or t
  misc_feature (810)..(810): n is a, c, g, or t
  misc_feature (825)..(845): n is a, c, g, or t
  misc_feature (864)..(865): n is a, c, g, or t
  misc_feature (873)..(873): n is a, c, g, or t
  misc_feature (881)..(882): n is a, c, g, or t
  misc_feature (898)..(899): n is a, c, g, or t
  misc_feature (908)..(908): n is a, c, g, or t
agcatttctaagatgctgaagttaaaccatagctatagcctcggactttcttaacattctgttttttgattagatcccttatgttgagtaataaaaaggttgggtactttaacaactagccatgttcttcataaatacagtttgctttataaacatatgtcagcaaatgcttcgtttcggagatacggaatgttgaaatttttctggcaaactgatgatttatttagtgctctaaaactggttgagatatgcaattgaaatttggtatgttttaagatgtagttattgcgaacttgcaaattttgtttgcatatcgcaaccggttttacagcaataaataaatcgttagtatgtaagaaaaatttcaacaacccgtatcttggaaacgaagcatttacgtttataaagcaaactgtcatttctttttcatgttggattaccgtttaaagtttgccgcacatcctgtattgatgaaaaacatggctagttgttaaaagtgccgaacttttattgtccaacttaggcgattgaataaaaaaaacagaatgttaagagggtctgaggctgtagttgagttttaatttcagtattttataaatgctagaatgttccatagggtgtggcgagcttaaaaaaaacacattttgattggtacaccccgtgtacagtgacggtttacctgtctagcaacaatattattttagcgatattgttaaagaataaggctatnnnnnnnnnnnnnnnnnnatttaaatcgaacgacagatttagaaaattcgagacgtcaaaatgagggtgcgtatttcttgnagtacctagtgtatnnnnnnnnnnnnnnnnnnnnngtaatattacccgatgtgnncatttttnaaactcanntttgatatttttattnngtatctatnattatatgaaactaaaaatatatatcgtt

SEQ ID NO: 18232 - DNA, 397 bp, Diabrotica virgifera
gagaaaaccgaagatgtgcagccgatattcactgtgatatccccaactgtccacaacttgtggctatcaccatttaacacaagaaaagaagatcactatgatatggtgttggttgggtgtaacggatgataagggaaataattacattctttaaataaaatcaaacgtactgacacaagaaattttgaatcttaagaaattgcttcatcgtcgtcgcaaaaatccaagttactcagttcctggattagaccgcgttgtttttgcatacagcaacatcactcccttcaatgtgaaccgtaatcactctctcctacccttaaacttcaaattgttctatatttgtgtgaaagcccttttgaaccttattgctttaatttgactattctgccccgtccgt

SEQ ID NO: 18233 - DNA, 895 bp, Diabrotica virgifera
  misc_feature (383)..(395): n is a, c, g, or t
  misc_feature (398)..(410): n is a, c, g, or t
  misc_feature (501)..(526): n is a, c, g, or t
  misc_feature (849)..(880): n is a, c, g, or t
aaaatgttcagaaaatacaacttaaaactgttaatacatgtgctgcaaatattataaacagacacaatgtttgacagtttgcctcccaaacgtcagtcttgaaatgccctattcagtttctatacattttctgacgttctaaacgtcactggacatacaaataaacattgcaacaagtgaagggtccaggactataatagctcaatgttcctatggatctagtagggtggcggtggttactgtatagcaatattacagtatttctcatgatcatttttcagtgcgtaacaaatgataggaaggggggtaagtccgtgataatacacatttatgacatttattctaacatgacattttagttaaatctgacagttgtcacattnnnnnnnnnnnnnggnnnnnnnnnnnnncaaaagtgtttcttgcatttataaaatggtattttctttgatttgtatagtcttataaattatacagattatatttgtaatattattatcnnnnnnnnnnnnnnnnnnnnnnnnnnggcgccatctatcgacaactagaataactagaataaatgttataaaaatgtccccgacgaaatgtaatcaccgacgtgcctttttttctgtcacatacaatttaatgcgttagaaagaaatcgaaaaactgtgacgcactgaaggatgatcatgagaaatactgtacatacttattttttactatagctacatttttgcgataccagttgaagagaacgtgactagaaatatattcttgtattgactactttgaacaaaagcttacaactttgcttgtagtttgattccctgtgaattttttctccaaccgatacatttttgnnnnnnnnnnnnnnnnnnnnnnnnnnnnnnnnccaaggacaatccaa

SEQ ID NO: 18234 - DNA, 749 bp, Diabrotica virgifera
cggacgcgtgggttcgagagtacttaccgccttcagtcggtgacagtcaatggtgttctggatgtatacgagaatgactttcctctgtgtactacgtggatatggcattattacttgctcattatatattcatgattgtcaaactctaaatgaataactatatatcttgtttattgtgaatttaatatgtggagtaattcttatgtaatgaagtgttgattcgttgttaaagagtatactatttatctattagcaaatccattaaatataggaatcatcaatatattgataacaactgatgtgtatgttatgaatattacaacaagattgggtatgaatatcaaaagtactgttgtattataaatgtcgacattaatgaaaataatgaatgaatagttgtcgtacagtaaaggtatgaatgatgttgatttctatatactgttgatattgagtgtttagctcactgttattaagatataactatacattatttagatatgcctgtgaaagaaaatattataattaaggaagtggatagtgaatagctgtatatagactagaaaagaggaatttggatacaatctgttcacccgggtcaagatctcatgaattatcctgctacaatcatcgagtctctccatgccccctgattactttggatagatcgtccatcagttatccgatgtataggaatgtcatgcatcatggtaaccaatgaagcgtgttaagaagacttcggagctaaatat

SEQ ID NO: 18235 - DNA, 807 bp, Diabrotica virgifera
  misc_feature (224)..(261): n is a, c, g, or t
  misc_feature (276)..(294): n is a, c, g, or t
  misc_feature (361)..(441): n is a, c, g, or t
  misc_feature (443)..(567): n is a, c, g, or t
  misc_feature (575)..(590): n is a, c, g, or t
  misc_feature (592)..(625): n is a, c, g, or t
  misc_feature (627)..(645): n is a, c, g, or t
  misc_feature (657)..(674): n is a, c, g, or t
  misc_feature (713)..(742): n is a, c, g, or t
  misc_feature (751)..(769): n is a, c, g, or t
acctatagtggataacagcagaaattttattgtagagttcaaatcgataataaagattgcgacctcgatgttggattaaagtttataattgtagaagaagatatattattaagtctgttcgacttttaaaattgtacatgatctgaggataaaccggagtgagacatcgtggttgctataatgattttattagtatgttttagctatattattaacaaatgtannnnnnnnnnnnnnnnnnnnnnnnnnnnnnnnnnnnnnagttagatattatgnnnnnnnnnnnnnnnnnnnaatgagatataaaaataaaaggttattacgcatctaaagttttaaataataacttaggattaaaagnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttgnnnnnnnnnnnnnnnnannnnnnnnnnnnnnnnnnnnnnnnnnnnnnnnnnannnnnnnnnnnnnnnnnnnagcatatcatannnnnnnnnnnnnnnnnnctggaatgaaaggtagaatgaaaaaaaaactggctttgnnnnnnnnnnnnnnnnnnnnnnnnnnnnnngcacaaagnnnnnnnnnnnnnnnnnnncacaaaaccctattagagtttataaatttctaataagc

SEQ ID NO: 18236 - DNA, 480 bp, Diabrotica virgifera
  misc_feature (24)..(205): n is a, c, g, or t
  misc_feature (294)..(313): n is a, c, g, or t
  misc_feature (330)..(356): n is a, c, g, or t
  misc_feature (381)..(407): n is a, c, g, or t
  misc_feature (414)..(455): n is a, c, g, or t
gacatgttcttaataaacaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaagagattctctttttataatatatcatcttatccgatacaaatttaatttattattcaacactatatttataacaaaatatacnnnnnnnnnnnnnnnnnnnncatttgcaggtatgagnnnnnnnnnnnnnnnnnnnnnnnnnnncaattttatgtaacagagatagatnnnnnnnnnnnnnnnnnnnnnnnnnnngattacnnnnnnnnnnnnnnnnnnnnnnnnnnnnnnnnnnnnnnnnnntatcaaaatattcatttagataatt

SEQ ID NO: 18237 - DNA, 720 bp, Diabrotica virgifera
  misc_feature (34)..(61): n is a, c, g, or t
  misc_feature (77)..(89): n is a, c, g, or t
  misc_feature (92)..(115): n is a, c, g, or t
  misc_feature (147)..(177): n is a, c, g, or t
  misc_feature (298)..(338): n is a, c, g, or t
  misc_feature (371)..(392): n is a, c, g, or t
  misc_feature (394)..(423): n is a, c, g, or t
  misc_feature (434)..(494): n is a, c, g, or t
  misc_feature (497)..(515): n is a, c, g, or t
  misc_feature (529)..(543): n is a, c, g, or t
  misc_feature (546)..(560): n is a, c, g, or t
gacagcgactcgaagtgaggttgtctgtggtgtnnnnnnnnnnnnnnnnnnnnnnnnnnnntcccttgaggatttannnnnnnnnnnnntcnnnnnnnnnnnnnnnnnnnnnnnnggaaagaaagtagctgcagctcctcttgcagnnnnnnnnnnnnnnnnnnnnnnnnnnnnnnncccactttttgaaaagaggactagaaattttggaattgaactgaatattcaacctcgccgtgatatatctcgataagtataacgaattaaattacaaaagaatttaaagttatttattagnnnnnnnnnnnnnnnnnnnnnnnnnnnnnnnnnnnnnnnnngatatttttaggtatgagcttagaaataaatgnnnnnnnnnnnnnnnnnnnnnncnnnnnnnnnnnnnnnnnnnnnnnnnnnnnnataaaatatgnnnnnnnnnnnnnnnnnnnnnnnnnnnnnnnnnnnnnnnnnnnnnnnnnnnnnnnnnnnnntgnnnnnnnnnnnnnnnnnnnggaatgatgatatnnnnnnnnnnnnnnngannnnnnnnnnnnnnntatatatagtgttaataaaggaatatggcaatattgttttctcctgtttattataaacatgttctttgtgcactgaatattaagactggcctgcccactgataacgttgaaaggactgcgaagcttgaccggttctaagtgaacttgtcatcgaagtttt

SEQ ID NO: 18238 - DNA, 95 bp, Diabrotica virgifera
  misc_feature (11)..(64): n is a, c, g, or t
  misc_feature (68)..(68): n is a, c, g, or t
atttatttaannnnnnnnnnnnnnnnnnnnnnnnnnnnnnnnnnnnnnnnnnnnnnnnnnnnnnaatnattttttgatcccatttttttgattat

SEQ ID NO: 18239 - DNA, 190 bp, Diabrotica virgifera
  misc_feature (25)..(63): n is a, c, g, or t
  misc_feature (85)..(145): n is a, c, g, or t
ctatactaatattatcatcattacnnnnnnnnnnnnnnnnnnnnnnnnnnnnnnnnnnnnnnnactaatattggcattcttactnnnnnnnnnnnnnnnnnnnnnnnnnnnnnnnnnnnnnnnnnnnnnnnnnnnnnnnnnnnnntccactgcttatgttgattggacgcgtgattttgaccgtgctaat

SEQ ID NO: 18240 - DNA, 64 bp, Diabrotica virgifera
  misc_feature (2)..(32): n is a, c, g, or t
  misc_feature (34)..(60): n is a, c, g, or t
gnnnnnnnnnnnnnnnnnnnnnnnnnnnnnnngnnnnnnnnnnnnnnnnnnnnnnnnnnnggaa

SEQ ID NO: 18241 - DNA, 216 bp, Diabrotica virgifera
  misc_feature (2)..(104): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcattcaagaaaaattatacttaaattagttacagacttgaacagatgttattatttctattcagacagtcctctcgcaaccgctaaatcggcggttcgctaagaatat

SEQ ID NO: 18242 - DNA, 959 bp, Diabrotica virgifera
  misc_feature (69)..(901): n is a, c, g, or t
agtcattgctgtagtgcacacgtaatttaagtatttatttaagaattgtctgcaaataattaattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccagccagcattgaaatcgattctctatttgagggtattgacttctacacctcaat

SEQ ID NO: 18243 - DNA, 130 bp, Diabrotica virgifera
  misc_feature (2)..(15): n is a, c, g, or t
  misc_feature (33)..(52): n is a, c, g, or t
gnnnnnnnnnnnnnntaaggcagccataaatcnnnnnnnnnnnnnnnnnnnnaaagctcgcgacgaagggtgtggatgacaccatcaaacttgtgtttatttaaatttatacacatattttaattctcta

SEQ ID NO: 18244 - DNA, 461 bp, Diabrotica virgifera
  misc_feature (5)..(460): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 18245 - DNA, 661 bp, Diabrotica virgifera
  misc_feature (92)..(118): n is a, c, g, or t
  misc_feature (248)..(273): n is a, c, g, or t
  misc_feature (275)..(334): n is a, c, g, or t
  misc_feature (345)..(396): n is a, c, g, or t
  misc_feature (407)..(531): n is a, c, g, or t
  misc_feature (533)..(567): n is a, c, g, or t
  misc_feature (614)..(636): n is a, c, g, or t
ggtaaacttgaaatttgtattataaggtcaaagataagtgtggaatgtttctattagcatagtgaaactcaccaaaatggcttcaaccacgnnnnnnnnnnnnnnnnnnnnnnnnnnngagtcttgtgttaacgcagtaaagaaaagcttagcaaacattgatggggttcagaatgaacaagtttatttggatgaactttgttgaaaagatatgttattcttacctacgcttctcgagtttattatgnnnnnnnnnnnnnnnnnnnnnnnnnngnnnnnnnnnnnnnnnnnnnnnnnnnnnnnnnnnnnnnnnnnnnnnnnnnnnnnnnnnnnngaaataaaagnnnnnnnnnnnnnnnnnnnnnnnnnnnnnnnnnnnnnnnnnnnnnnnnnnnnataaaatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnngttttcccctgtttattaaaaacgtgttctttttgcattgaatattnnnnnnnnnnnnnnnnnnnnnnnttttgtatggacgcggaattttgac

SEQ ID NO: 18246 - DNA, 574 bp, Diabrotica virgifera
  misc_feature (63)..(83): n is a, c, g, or t
  misc_feature (162)..(181): n is a, c, g, or t
  misc_feature (246)..(294): n is a, c, g, or t
  misc_feature (434)..(454): n is a, c, g, or t
catgataagtagctaatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 18247 - DNA, 334 bp, Diabrotica virgifera
  misc_feature (27)..(41): n is a, c, g, or t
  misc_feature (44)..(64): n is a, c, g, or t
  misc_feature (102)..(114): n is a, c, g, or t
  misc_feature (117)..(137): n is a, c, g, or t
  misc_feature (152)..(166): n is a, c, g, or t
  misc_feature (169)..(196): n is a, c, g, or t
  misc_feature (279)..(325): n is a, c, g, or t
ctctacgcgtccgcaaaataaattggnnnnnnnnnnnnnnngcnnnnnnnnnnnnnnnnnnnnngaataatatgaaatataccttttttatctactttaggnnnnnnnnnnnnnccnnnnnnnnnnnnnnnnnnnnnccaaaataaattggnnnnnnnnnnnnnnnggnnnnnnnnnnnnnnnnnnnnnnnnnnnnggatgatttgaatattatggaagttcaggtgtaataaaacaattaaataatagaatatttttacagttattttctcttaatcnnnnnnnnnnnnnnnnnnnnnnnnnnnnnnnnnnnnnnnnnnnnnnnctattagat

SEQ ID NO: 18248 - DNA, 542 bp, Diabrotica virgifera
  misc_feature (3)..(24): n is a, c, g, or t
gcnnnnnnnnnnnnnnnnnnnnnntggcgcatgcagctccagccggtggacgtggtggattccgaggaggttttggaggtggtggccgtggaggcggtatatgtttcttgagaggccctggtgtatgacgtgtgagaaagcgagaatgagagatccatctataaatcaaagtgaatagagagaaaacaaatttaaatctactggatgaatattatctataattattggtgagaggtgaaatgttattaagtattttgtaggatctatgtcgttataagataaaattaaaatgatttattcaacatatcatttataactacagacttctagattgtgtatacaagtaacatttacgcaagagggaaggaagaaaagcttattaagattttgcttttaacaaaagtacagtcttccactttgtcatatgatgatggaggatactaattatttctaaacattatatctcatatacaaaatacattgtttaataatgcctaaggtcgaaatttatgtaaagatatgcctattgtcgatactattta

SEQ ID NO: 18249 - DNA, 526 bp, Diabrotica virgifera
  misc_feature (2)..(300): n is a, c, g, or t
  misc_feature (309)..(339): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgctannnnnnnnnnnnnnnnnnnnnnnnnnnnnnngagaatgtgatttttaaatttaacaaattcaggaagttattacatttatctttcgcccaatatagtacttacagattaaatgcgctatctctacttgcctactagaaagatgcaagagttactgatatacatatactaagcagtagagacttacgaaaagactttgccattatgccatattttgtcc

SEQ ID NO: 18250 - DNA, 693 bp, Diabrotica virgifera
  misc_feature (3)..(253): n is a, c, g, or t
  misc_feature (277)..(296): n is a, c, g, or t
  misc_feature (309)..(337): n is a, c, g, or t
  misc_feature (339)..(359): n is a, c, g, or t
  misc_feature (370)..(421): n is a, c, g, or t
  misc_feature (432)..(511): n is a, c, g, or t
  misc_feature (516)..(546): n is a, c, g, or t
  misc_feature (556)..(593): n is a, c, g, or t
  misc_feature (648)..(666): n is a, c, g, or t
gtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgttgacaaagtcataaccgnnnnnnnnnnnnnnnnnnnncaatatatttagnnnnnnnnnnnnnnnnnnnnnnnnnnnnngnnnnnnnnnnnnnnnnnnnnngaaataaaagnnnnnnnnnnnnnnnnnnnnnnnnnnnnnnnnnnnnnnnnnnnnnnnnnnnnataaaatatgnnnnnnnnnnnnnnnnnnnnnnnnnnnnnnnnnnnnnnnnnnnnnnnnnnnnnnnnnnnnnnnnnnnnnnnnnnnnnnnnaagannnnnnnnnnnnnnnnnnnnnnnnnnnnnnnatatttagcnnnnnnnnnnnnnnnnnnnnnnnnnnnnnnnnnnnnnngttttcacctgttaattaaaaagatgtctttttgtattgaatataaagactcggnnnnnnnnnnnnnnnnnnntatggacgcgacagtttgaccgtgcta

SEQ ID NO: 18251 - DNA, 933 bp, Diabrotica virgifera
  misc_feature (444)..(462): n is a, c, g, or t
aaaaaaggggtcgcgggttttatctaagaccgtacaaaggttacggaataaaacgtcgcggcaaaggtttccatttaaagccgtattcaaaaaactcccgttaaagctacctaggcgagcaatgactgatatagatcttgttaaatatgctagtttgttaaatattcctcattttcgtggagtttttatgcgtgattctttacctaatgtaatacgaaaacatgaatcaggtatagtaaaccacgatactgaaagcggaaatggtacacattggactgcatatactaaacaaaatacgttaattacttattttgatagttatggaaatttaccacctcctactgagttagtacgatattttaaaagtaatggaaacgctattatagtatataactatgatgtcattcaaaattttaattcttttaattgtggtcaaaactgttnnnnnnnnnnnnnnnnnnnctataattaatcattgagcatcatttatacttgaaccatcatgtcagtcacatttacccttagtggagaatcatcaattctcagtgatgattacaatcctgccatttatcttgatgagaatttcgattatgaaattggtgttgcaaattttgatacttttaacagtattccaaatgttgatgttcataataatgtttttgtgtggggtaaaaacagcgagtttaccttcaaaattcctgtaggtgcgtacgaagttggtgatataattaaaatgattaaatatgaaatgattcaaacagctagcgcaattcgtataaggccaaatataaatacaaacaggataagtattaaaagtagtgattggattaattttgatgttgataattctatagggaagttactaggtttcgaaaagagtaaacttaaaccaatacacttcatacatccacgaatacagtaaatattttaaaa

SEQ ID NO: 18252 - DNA, 517 bp, Diabrotica virgifera
  misc_feature (47)..(91): n is a, c, g, or t
  misc_feature (101)..(129): n is a, c, g, or t
gtcgttacttgtgcttgttcattgaagttctgtgacgtgtctttggnnnnnnnnnnnnnnnnnnnnnnnnnnnnnnnnnnnnnnnnnnnnnttagtcgtannnnnnnnnnnnnnnnnnnnnnnnnnnnnttttgtcggagatgctgcatctagaggtggatttatgtgataggtaacgtcgattagccatgatatctcttgactagattcggtgccgctgagaacaccgtgagtgtgaccagagacgacatagcaggtacagaggtatcctaatatgcaaacgtcaattctagtattcacatatattagcaaaccagttagcgaacctcctcaaaaaaattgacagatgattcctaatgctacctacgtatactactgtgataaagagactgacgatggtgtagaatatcattacattctagaaagcattgtagttctattagtcactgttttgatatccataataatgtacaatattctagacatctctagattcggctgcaacattgctggtgtc

SEQ ID NO: 18253 - DNA, 397 bp, Diabrotica virgifera
  misc_feature (2)..(16): n is a, c, g, or t
cnnnnnnnnnnnnnnngaatttttagataaaaattatgataatacagtttcctatgttataacatgagactaatgtatgttcaccagtaaactgtccaatattctagacatctctcactccagctgccacattgatggcgtcccacaagaatatcgcacctgagggtggagtacaggtcattgcccgggaggacttccacggaatcccatgacatgctgtccagcggtactgaaattgactcctaagcccaacgactaactcctgatcataacctccagcagaccttctctgagaaccggatggatcaggggcttctaatgaaccaaaaagagcggacccctccgtcaccatgcaaaacaaagccatacaaaaaagagaaagttcattgacaacccc

SEQ ID NO: 18254 - DNA, 269 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(194): n is a, c, g, or t
  misc_feature (202)..(261): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnnngaaaggannnnnnnnnnnnnnnnnnnnnnnnnnnnnnnnnnnnnnnnnnnnnnnnnnnnnnnnnnnngccgctct

SEQ ID NO: 18255 - DNA, 702 bp, Diabrotica virgifera
  misc_feature (79)..(105): n is a, c, g, or t
  misc_feature (216)..(239): n is a, c, g, or t
  misc_feature (280)..(301): n is a, c, g, or t
  misc_feature (305)..(429): n is a, c, g, or t
cctttcgcgtccgtcacgtttggatgtttataaattattgcctttgtttataaacgtatataaaggcttattcgtaagnnnnnnnnnnnnnnnnnnnnnnnnnnnaacgaaaaatccttgcttcaatgttacaatagaggttgtgggcaaaaattctaaccaaataaaaataatgaatatactagtttaccacatccagagagaatcagtattccnnnnnnnnnnnnnnnnnnnnnnnngtaaatactgtttctgtaatgtaatgttattcatctgtacnnnnnnnnnnnnnnnnnnnnnncaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattcaaaagcttcagattttaacgtctgttataatttattttgatatagtataatttttattacatagactgcctttataagaatgtatgcacaaaataattataattaccactgcagataatctcaacttataaacatgcatacctagaaaactaataacggagaaccgaagtcttagagttctactttattatcaagaatatctataataatattatgtcattcccactgcaatacatgataagttacattatactatttcatatgccat

SEQ ID NO: 18256 - DNA, 805 bp, Diabrotica virgifera
  misc_feature (87)..(108): n is a, c, g, or t
cggacgcgtgggattgtcaagaatgtactgtcataaattaaaaactaatggtttttaaaacgtttatttattgaaattctatgatcnnnnnnnnnnnnnnnnnnnnnncaattttaccttaattattgttagtagtgcaacacgttatggcagatgcaagttccaaggctaaaaaggatgaccctgatgaagaatacgatccatacttgcatagaaatcttcccaatccgaacaagagcatcgaaaccctaggtcatctagtcaaaggtattattggcactggcatattggcgttacccgaaggatttaaattggctggaatgttagttggaataatttctaccattcttataggtttattgtccacatattgcctacgaattttggtacaatcccaatacgaattatgtaaaaagaagagagtagggctcttaacatatccagaatctatgcagtatgcttgcgaagtgggtcccaaatgttttcgcagattttccccctacgcaggtggactcacaaatttcttcctagttacgtttcaaattggaacctgttgtgtctatgtggtcttcgtagcagtgaacattaaatttgtaggtgacgaatacaccgacccaaaaattgcgttaaacttattacatattaatgttcttcgtcccgtttttgtgtataataatggtgaggaacttaaaaatttttgcacccttctctattgctggaaataataataacattattgaaaattgggcgtttgtggctactatatatgtcaagattttgccacccgttttccaaaccgtccata

SEQ ID NO: 18257 - DNA, 133 bp, Diabrotica virgifera
  misc_feature (3)..(30): n is a, c, g, or t
  misc_feature (40)..(77): n is a, c, g, or t
  misc_feature (83)..(131): n is a, c, g, or t
aannnnnnnnnnnnnnnnnnnnnnnnnnnnggttttttannnnnnnnnnnnnnnnnnnnnnnnnnnnnnnnnnnnnngggggnnnnnnnnnnnnnnnnnnnnnnnnnnnnnnnnnnnnnnnnnnnnnnnnnaa

SEQ ID NO: 18258 - DNA, 926 bp, Diabrotica virgifera
  misc_feature (362)..(379): n is a, c, g, or t
aaagacagaaaagtaaagtatctataccaatgcaaccctgagtaagttaacttatttgttgtttttaacaaacaacaataaaatccccttttttggcctgaggatggggcataacctgtaagtcccgaaactggtagctactatttaacatcaataaaatttaaaaaaccggcaataaatacttcaacgaatttaagaccacaaaacgcttattgcagggatgctctacatctccgacactgttcaagatattcgtggaacaaatattaaaaccatgaaaaagaaaatgtaaagggatgggaataccaatccgggacaactttttgtacacattagttttgcagatgactaagtggtaacgnnnnnnnnnnnnnnnnnnctgtcgtgtatgctccgaaaattagaagaggaatacacaaaaaatggactggaaataatcctagaaaagaccgaacacttaacaacagaacaagaaccagtgagaatcttgaaaatggacgatgatagggaaatcaacggcactaaaaaattcaaatagctaggattcatactatcaaagaatggaatcaccgagcaagagataaccagcacagacaagaacatgtattaaacaaatgaaccgggtactgtgggatagacagattaccagaaatacaaagagaatatataaaagcttggtacatagtgtaatgacctatggagcagagaattgggtaataaacaaccaaaacaagtccaaaattacagcaactgaaccggagttcatgagaaaaaactgcagagtgacaagaataaatcgcattaaaaatgagaagataaaacgaagaatggcagtggaacaagacacactcagctacatcgaagaaaacgtttaaatttggtatggacatgtgaaaagagcagatcatacaaggtggatatcaaag

SEQ ID NO: 18259 - DNA, 645 bp, Diabrotica virgifera
  misc_feature (138)..(157): n is a, c, g, or t
  misc_feature (311)..(323): n is a, c, g, or t
  misc_feature (325)..(344): n is a, c, g, or t
  misc_feature (508)..(526): n is a, c, g, or t
acattttacaaactcaggaaattgttatacgtatgataaatttacttaaagatatggtaaaagcagttttcttcttacaactaacagcaagtaggtattaaaacaatatctatactttgttaatttttagaaattccnnnnnnnnnnnnnnnnnnnngcaaatgcttgctggtcgagaattattttttcagtttatggtgtgatattgataggatttttaattttgaagcaaacttcagggcatttaaaacattttttgttcttaaagaaaatagtattctaaaaattctcatttatgttaatattagtcnnnnnnnnnnnnngnnnnnnnnnnnnnnnnnnnncacaagaatttaattttttttagtcgttttaaaaatatttggttttggtatatatttacgagaatcaaacctctttgttgtacattttatacaatatgttaattatctggaaagtgaggagctcaggaaattttgtaaaaaggttttcaaaattttgtactcannnnnnnnnnnnnnnnnnngatagctggagaacaccaaaggtttgtgttatgcaatttttccttgctgtacgtataacctgaattagacaaacgagctactgtgttgagtgagaatgtaaggactcgaattagagaga

SEQ ID NO: 18260 - DNA, 588 bp, Diabrotica virgifera
  misc_feature (12)..(51): n is a, c, g, or t
gattttgattgnnnnnnnnnnnnnnnnnnnnnnnnnnnnnnnnnnnnnnnntagaaaggggggttggtaccggatgagcagttgatacgcctctgtgaacaacaattgtccatggtgatgcataaagagaacttgttattggtaagacttctaaccaactgacacatttatgggcttaggaagaaaacatttaaattttacgtgcacgtattggaggactagtaatgatgtatgactggtccttgtgtttgaggctaagtactgataagcatgtgataattttgctaatctatgagtgagagatcgggatgccaattaaatacatgaattattagacgtttctactgagattttctctaaagtactgaaagcacgccaagagtgtgtttaaataacaactagtgcgggaaatgattcttctttcttgtgccttagtatactactgagagttaactgcattgttcgaggcagattacgagattaatacaacagctacgtttatacgttatacgtaagataggagagtcttagaaaaagacattgtcacattcggaagtatgtttgtcctagactacgagacataccaag

SEQ ID NO: 18261 - DNA, 798 bp, Diabrotica virgifera
  misc_feature (613)..(639): n is a, c, g, or t
gaaataatttttcccttccattttgtgtctttgggtagggatgaagtgagactgtcattgaaaacgacatttgaaatgacgactaagtcacagtataaagagggacagtagaaccactctccgaaaaattggaagtaaaatctgtagtcgcacatggcgaccgcgcaatgttggcagtcgcttttgccccactctcgcatctattcacatagaaacgtacggcttttaacagggaaaacccgcatccaccactggtgaattaccaattgcgtactgccggtattacttcctgagatcaaagcgccgacaaagagtgattttactgtggaacctctatatactgtgaccaagtactatgaagtagcaggcgtgtttcgtattgaaatacagatatttacagagtaagaatatacagggtacgttcagtatgttcaatttatgatttagattttagatgaaaagagatatagtaaatagaagataataaaagaggataataaaagaggataataaaagagaataataaaagagggcgccaagcaagtttttaatgaaaaagcaagttacaacgaatagaagacaattattaatgatatattaaagaaaatagaannnnnnnnnnnnnnnnnnnnnnnnnnncaaagatgtgacgtttgtaacgttacaacatgaccgtcaaaagaatacctggcaatgaaaatattatcactacagacaattattggcttgaacgggtggatgcctttccctatctgggcaccgaaatcaattcagaagaattccgtaagtagcgaaatg

SEQ ID NO: 18262 - DNA, 825 bp, Diabrotica virgifera
  misc_feature (40)..(334): n is a, c, g, or t
  misc_feature (336)..(553): n is a, c, g, or t
  misc_feature (560)..(597): n is a, c, g, or t
  misc_feature (617)..(630): n is a, c, g, or t
  misc_feature (633)..(655): n is a, c, g, or t
  misc_feature (663)..(685): n is a, c, g, or t
  misc_feature (715)..(746): n is a, c, g, or t
  misc_feature (753)..(789): n is a, c, g, or t
cggacgcgtgggtagtaatactaatattatcatcattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattaactaataaaagctggaatatgaacaatagaac

SEQ ID NO: 18263 - DNA, 69 bp, Diabrotica virgifera
  misc_feature (5)..(67): n is a, c, g, or t
ggggnnnnnnnnnnnnnnnnnnnnnnnnnnnnnnnnnnnnnnnnnnnnnnnnnnnnnnnnnnnnnnntc

SEQ ID NO: 18264 - DNA, 929 bp, Diabrotica virgifera
  misc_feature (2)..(728): n is a, c, g, or t
  misc_feature (735)..(772): n is a, c, g, or t
  misc_feature (806)..(829): n is a, c, g, or t
  misc_feature (831)..(831): n is a, c, g, or t
  misc_feature (837)..(859): n is a, c, g, or t
  misc_feature (864)..(864): n is a, c, g, or t
  misc_feature (871)..(871): n is a, c, g, or t
  misc_feature (884)..(884): n is a, c, g, or t
  misc_feature (896)..(921): n is a, c, g, or t
  misc_feature (923)..(923): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaagttttataatgnnnnnnnnnnnnnnnnnnnnnnnntngtcgannnnnnnnnnnnnnnnnnnnnnnagttnaaaccgntgtgagcccaggntggtttctatcnnnnnnnnnnnnnnnnnnnnnnnnnngnaaggac

SEQ ID NO: 18265 - DNA, 198 bp, Diabrotica virgifera
  misc_feature (15)..(80): n is a, c, g, or t
  misc_feature (83)..(124): n is a, c, g, or t
  misc_feature (126)..(169): n is a, c, g, or t
gagaagaccctaatnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnncnnnnnnnnnnnnnnnnnnnnnnnnnnnnnnnnnnnnnnnnnnnnacccttgaggaaaaaacggcatttttttt

SEQ ID NO: 18266 - DNA, 541 bp, Diabrotica virgifera
ccttcgcgcccgcatgcaggaccaacgacaaaggcaaaccttatacatcgatgctgtctagaattagatgaaagatgagcacgaaggtgcaagtgtctctcgtgctcccaccgaccccatataaacatcaagagagaacctccaagaaagagaaattacactgatccactagtctcctacttgctttcataatctctcgaatcagtgataaaagaagctttccgaaatatggaccccgataaatcgggggtgttcttcgaacagagatttgagagccacctacgatgcagatcgactatctcgccagtgatcatgacctcagtcagatgatcaactaattttgccaggatcagaacacttcactccacgggaggaattgaatgatcaccgtataactgtttccggtgtgcactgcggaagaggaagttgtcgcgacgtatttgatatccatatgatgaaagaggttcccttgacgtagacatattgcggcctgccattatgacgtggagagaaccatgctccggcaaagaatgcgacgacg

SEQ ID NO: 18267 - DNA, 762 bp, Diabrotica virgifera
  misc_feature (2)..(560): n is a, c, g, or t
  misc_feature (567)..(604): n is a, c, g, or t
  misc_feature (624)..(637): n is a, c, g, or t
  misc_feature (640)..(662): n is a, c, g, or t
  misc_feature (670)..(692): n is a, c, g, or t
  misc_feature (722)..(753): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaacggtgagagccaggttggttnnnnnnnnnnnnnnnnnnnnnnnnnnnnnnnncgaaggacc

SEQ ID NO: 18268 - DNA, 861 bp, Diabrotica virgifera
  misc_feature (9)..(772): n is a, c, g, or t
  misc_feature (776)..(776): n is a, c, g, or t
  misc_feature (780)..(781): n is a, c, g, or t
  misc_feature (787)..(821): n is a, c, g, or t
  misc_feature (826)..(859): n is a, c, g, or t
catctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgnaatnngagggnnnnnnnnnnnnnnnnnnnnnnnnnnnnnnnnnnngattnnnnnnnnnnnnnnnnnnnnnnnnnnnnnnnnnncg

SEQ ID NO: 18269 - DNA, 267 bp, Diabrotica virgifera
  misc_feature (2)..(115): n is a, c, g, or t
  misc_feature (117)..(130): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnttactaaatttaaataatttagcgatggtgagaatattagcgttaaatttagataagttaaatgtagatgttaatgaaaaatttatagagaatagatttaaagtatgtagatttaatgctaatattagcatcatgac

SEQ ID NO: 18270 - DNA, 901 bp, Diabrotica virgifera
  misc_feature (50)..(67): n is a, c, g, or t
  misc_feature (633)..(655): n is a, c, g, or t
  misc_feature (767)..(767): n is a, c, g, or t
  misc_feature (877)..(894): n is a, c, g, or t
atgtttttgtgattgtgatttttgttgtttttgatacatttgtggaatannnnnnnnnnnnnnnnnntcatatcatttagtggtagtcaaacattaagaatggttaagttacttggacagaaagaagctcagtcaattgacttagaactttttaatggctattcattttctgttgatcagctaatggaattagctggcttaagctgttcttcagctatagctaagagttatcaacacactgatattggtaataagtcgatactggtttgttgtgggcctggtaacaatggtggagatggtttagtttgtgcaagacatttagtactttttggatataaaccagttgtatactaccccaaagaaacaaaaaataatctctacaataatctcatcaagcaatgtcagttaatgaatatatctgtaattaagagtttaccagataaatccaactttgaatctgaatttggtattatagtggatgctttatttggatttagctttaagccacctgtaagagaagaatttataccagttgttagtctgatgaaggaaacaaaagtacctatagcaagcattgatatacctagtggatgggatgtaaattcaggacctcctgaagatggcatcaaaccnnnnnnnnnnnnnnnnnnnnnnncccccaaaatgtgtgccaaattttttgagggaaaatatcattacttaggaggaagatttgtacctccagccttagaagaaaagtacaatctacagctacctaaatatcctgntacagaatgctgtgtattgctgccggcagtacatgatgctaaagagtgtaacaaaaagtaggaactagaaataagaaaaatatgtttgtttgtttattttgtatctcacnnnnnnnnnnnnnnnnnngtaccat

SEQ ID NO: 18271 - DNA, 1096 bp, Diabrotica virgifera
  misc_feature (23)..(23): n is a, c, g, or t
  misc_feature (192)..(209): n is a, c, g, or t
  misc_feature (280)..(319): n is a, c, g, or t
  misc_feature (321)..(335): n is a, c, g, or t
  misc_feature (355)..(372): n is a, c, g, or t
  misc_feature (420)..(466): n is a, c, g, or t
  misc_feature (519)..(534): n is a, c, g, or t
  misc_feature (536)..(567): n is a, c, g, or t
  misc_feature (684)..(704): n is a, c, g, or t
  misc_feature (732)..(755): n is a, c, g, or t
  misc_feature (758)..(777): n is a, c, g, or t
  misc_feature (779)..(797): n is a, c, g, or t
  misc_feature (803)..(815): n is a, c, g, or t
  misc_feature (817)..(879): n is a, c, g, or t
  misc_feature (882)..(944): n is a, c, g, or t
  misc_feature (948)..(981): n is a, c, g, or t
  misc_feature (995)..(1008): n is a, c, g, or t
  misc_feature (1011)..(1042): n is a, c, g, or t
  misc_feature (1062)..(1087): n is a, c, g, or t
tttaaagaagatgatggagaaanttgatgtagagataatagttaataatgatgatgatattattttgaatattatgaatgatgaatatgaattggataaagtgttagaagagttattaaagaataaagatgaagaaattgttgatgaaattaaaagagttgtaattttgaatgttgtattgttaaataaagnnnnnnnnnnnnnnnnnngagatattaagttaataaggattgatgatgtttatgatttaaatagataaataaatgtaatttattaggannnnnnnnnnnnnnnnnnnnnnnnnnnnnnnnnnnnnnnngnnnnnnnnnnnnnnngtgtaaagataaatttgtannnnnnnnnnnnnnnnnngtgaaatataggaatgaaaaatataatagtttatgatatgttattagnnnnnnnnnnnnnnnnnnnnnnnnnnnnnnnnnnnnnnnnnnnnnnngatataaattttgattatttaaatttaagaatgatgttaatattagtagtagnnnnnnnnnnnnnnnngnnnnnnnnnnnnnnnnnnnnnnnnnnnnnnnntatattattgtgtattgtttatttgaaatatgtaattttgaattaatataaagatttaagtggtaagtgataatttggatggatgatatattttgaaggtggtatggtaaaataaannnnnnnnnnnnnnnnnnnnngtgaaaagaaaggttgaatgaaataaannnnnnnnnnnnnnnnnnnnnnnntgnnnnnnnnnnnnnnnnnnnngnnnnnnnnnnnnnnnnnnngaggannnnnnnnnnnnngnnnnnnnnnnnnnnnnnnnnnnnnnnnnnnnnnnnnnnnnnnnnnnnnnnnnnnnnnnnnnnntannnnnnnnnnnnnnnnnnnnnnnnnnnnnnnnnnnnnnnnnnnnnnnnnnnnnnnnnnnnnnnaatnnnnnnnnnnnnnnnnnnnnnnnnnnnnnnnnnnggaaatttttaggnnnnnnnnnnnnnntgnnnnnnnnnnnnnnnnnnnnnnnnnnnnnnnngagaataaatgttttgatgnnnnnnnnnnnnnnnnnnnnnnnnnnttgggtggt

SEQ ID NO: 18272 - DNA, 202 bp, Diabrotica virgifera
  misc_feature (77)..(100): n is a, c, g, or t
  misc_feature (108)..(130): n is a, c, g, or t
  misc_feature (171)..(189): n is a, c, g, or t
taacagcgtaattttattggagagctcaaatcgataataaagattgcgacctcgatgttggattaaagttatattgnnnnnnnnnnnnnnnnnnnnnnnntggtcgannnnnnnnnnnnnnnnnnnnnnnagtttaaccgggggtgacccaggtgggtttcaatctttaannnnnnnnnnnnnnnnnnnccgaaagggcccc

SEQ ID NO: 18273 - DNA, 312 bp, Diabrotica virgifera
  misc_feature (260)..(288): n is a, c, g, or t
  misc_feature (291)..(307): n is a, c, g, or t
aattttaactcgttttttctgtcgcattgcaaactctcaattatttttttagcataacataatatgtatacaagtgaataattttcatttatatttataccctttgctgataagatctggggattgctccagtgcaattacaaaagaaatcctaacgactttatcttcctctaataccacaaatgaaaaaatagaagtaacacttcgtgttcttcgaaacactagaaaaaaaagataatattatttaatattataaaggnnnnnnnnnnnnnnnnnnnnnnnnnnnnngtnnnnnnnnnnnnnnnnncgttt

SEQ ID NO: 18274 - DNA, 461 bp, Diabrotica virgifera
attgtaatatatattaagattaacatatctcttttgtttatcattgaagaaattcgtattaaacgctagatgatcacgattgacaaagtgtattttgtgcttataccgtaaacacttatacttcgaacctagcctccgagaaacatattaagccctgaagcatcagtttattattatgctaacttaatttatttaacaaataacaaattatagtgtgccacaacagtccccctaaatatattgggcatgccttgtccttcgttgttaggtccacctaatttgttgagaaataaattcagactgtgttgatcaacgttagaatatataattaactatttttacattattagtactaaccattccatacggatgagctgaacgataaacgtatagtaagccttcgtttttattgacgaagtagggactagacgtgttcgatattttaaaccatgtgattaaag

SEQ ID NO: 18275 - DNA, 895 bp, Diabrotica virgifera
  misc_feature (14)..(31): n is a, c, g, or t
  misc_feature (797)..(797): n is a, c, g, or t
  misc_feature (840)..(840): n is a, c, g, or t
aaattttactgaannnnnnnnnnnnnnnnnnataaaattatgtattaaaccgctgcttttaaataaaattcacaaatggaaaactctactgaaggtttaagttccggaagactcaagaaaattgaaaagaagttaagaaaattacaacatgtaattcaaaaggaagttggggcccaatgttctgtagataatgctactaagatattggtcctagctaatgctggcttaataaatggactcactgaagaaatagtatttgaacacttttcaaaatatggaactataacaaacattctattgatacctggaaaatcctgttgttttcttcagtataaagaagaaggctcggctgtgaatgcgtatcataattacaatggaactctgaaaattgcacaagattctaaacctatatatttgttgtactgtgatgccttaccgaaagtggagttaaatagaacatggaacggcagtgtgccaggattagtaataattgacgattttgtttctgcagaagaagaacgattgttgctacagttgaataatttcgaggttgaagataccggccaaatgaagcacaggcaggttaaacattttggatatgagttcaggtatgacattaataacatagacaaggataaaccttggaagacaaaattccagaagaatgtaacttttggagaaggctagaaaatatggaatttaaaggctttatcccagatcagttgacagtaaatcattatctgccaggccagggaattcctcatcatatagatacccacagtgcctttgaagacccnataatgtccttatctttaggatctttcagtataatggaatttnaaaaagatgatgcacatgtttgcgtattattgccacaaagatctttaacgattat

SEQ ID NO: 18276 - DNA, 844 bp, Diabrotica virgifera
  misc_feature (102)..(120): n is a, c, g, or t
tttgaatagcagttttggcaaagaatacagtcagttttaatggtgtgtcccaacaatcatgcaggaagtaattttctagtggttaaaattgtacaatttacnnnnnnnnnnnnnnnnnnngctattaagggcatgggcgcaaagtgtcgcctgtcagggtgttcaatgtgttttaaatgaacgtattcatttgtttcgaatcttgagaaaactaataaatgtttttgaaaggtttaaacccagaatgaaagattacattattactgagggccgaaagtacctaaaaacttctgtaatgtttattttaataagttacaggggtgaaaataaagaagacaatttagtgtgatttttaattgcaaatatttcattcaaaagaaagtttttatttattctacgggactttcggccctcggtaataacgtaattaacttaataaacattatgcgtttgaattttttaaaaatgcttattggttttctcaggatccgaaaaaaaatgaatacatttaaaacgcattgaacattttgacgggcgacattttgcacctttccccttgatctagaaatgattattgttgctaattatgtatttttttcgaaaaatttgccgccgattatactataatccattcaacgaactctctttggtgaattaggtataatgaccataatatggagacggcatatcttttgttgtgtaacattatgctaagatggcgaccacaaagctccgtcctcaaaatggatggagatggccagattagttgacaaatcgatgcctcagaagccaatcggtgtaagtcaataagtgttttaaaatgagatactaacatgtttctgac

SEQ ID NO: 18277 - DNA, 735 bp, Diabrotica virgifera
  misc_feature (637)..(657): n is a, c, g, or t
cgcgagcggccgccgcgatctaaactagaaaactactcatattatgttcctgctactttaatgaagaagataaagaaaatcttctctcaccatattttcaaatagaactggtgaagatgctgaagaaatgtagtagcactatcttgtgtttaaatccttgattttgtgtaatttataaaattgaaatcaatatgatatgactaacaaggattgtgtctataaaaaatgtgtatcacagtgtgcaaactacaagcaggagcattaaatatcagaaatgtttaccactgttttttttggttttattcaatggatttaatggattgtagatgtagactctctacatcttcattaccacttgaaagtcaaccagaatcatctcattcaagtggtatcacatcaagtagtgcacaacaagacacagaaatgtattttcttgaataagagaatactcagctgaaactaaaattagataatttgtcaaatatagatttccatttcagcatatcaagaacgataataatttagtgaaagtgtacgtgggaataacaactactgtatattgaaatactgattaatatttaatatgctaagtaatattcagttagaatattatcatgggtgggtgaaatatcacagnnnnnnnnnnnnnnnnnnnnngtgttgtattttgtacgcacctaagaagttatacttctattatatgatttcaatgaaataaacattttaaacagttta

SEQ ID NO: 18278 - DNA, 643 bp, Diabrotica virgifera
gaaaatattaaatccaatgtaatacaatttgttttaataatattacagtgattatcattctgtggcgaatttaacatggcggattggatctgctaatcaataatgcagcaataggctttggtagagcagctacagaatctccatttgtccaagcatcaaaaactatagaagccaattactttggaaccctaagagtttgtgaagctttgttttctttgttaaggaataacgcaaaagttgtaaatctttccagcgctttaggacatctgtctaaaataccgacagagaatctcagaaatgaattttcgagaaaggatttaaccatatcagaactcagtaaattacttgaaaagtttgtaaaagctacagaaaataacacacacgtagaagatggctggggaaactccacctacgctgtttccaaagtgggtgtaactgcactgaccattatccaacagagactcttcgatgaagaacagcccaatcgtaatatttcgatcaatgccgttcatccgggatatgtcaaaactgacatgaccagccataacgttcttttaagtatcgaggaaggagccagaagtgccttgttagctgcatttgatgctgttttgaacgaaaaatatatctgtaaagcttgtacatt

SEQ ID NO: 18279 - DNA, 554 bp, Diabrotica virgifera
gtgtttgtgctttcttctcttgtttcttttcttccttcatcttacctttacctggtgttgaagctgtagaagttaaattctccaggttgagcaactgcactgcaaagtctaacttctcgcaagtacttatctgaaatgtgttcgactaatacgatgaatagaaacctctaatgatgggacgaacacatctacaaaagatgaagatcaagcatatataatcacgacaccgacgaaggtatctacaacaaaaatgatgaatcactacagagtctcccttgacatcttcaattgcgtcattgaagactacattgtggggagtcaagaacaccgactataagccccccaagaactcgatgcgacgttagtgtattcgacgcattaaaccccaccgaatgagattgatgaggacgacactgagacaacagggtacggtacgatgtattatacctattcaatgcatgcttgaccgaaaaacattatacggaaatgtataaataaactgttagcactctctctgtatttgaaattacatgtagtggaacattctacccatt

SEQ ID NO: 18280 - DNA, 87 bp, Diabrotica virgifera
  misc_feature (2)..(24): n is a, c, g, or t
  misc_feature (27)..(86): n is a, c, g, or t
annnnnnnnnnnnnnnnnnnnnnnagnnnnnnnnnnnnnnnnnnnnnnnnnnnnnnnnnnnnnnnnnnnnnnnnnnnnnnnnnnnna

SEQ ID NO: 18281 - DNA, 257 bp, Diabrotica virgifera
  misc_feature (2)..(99): n is a, c, g, or t
  misc_feature (101)..(231): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaagggataaacagcggaatttt

SEQ ID NO: 18282 - DNA, 642 bp, Diabrotica virgifera
  misc_feature (163)..(181): n is a, c, g, or t
atacgattctcgatatgattaccggtactcaaatacaaaagtcatcatagcaatcaaagtaacgaatactgtaaatgattactttatacaaaagtaacgatttgtaacgaatactcgacagtaactataatcaacatcactaatagtcggaagaacgtggacnnnnnnnnnnnnnnnnnnngataatattagaaggaaatgccgaagaccaagaagaagatctcgaacacgatggacagaccaaattaagactctggtgggaaaatcacaatatgaaagcgtccatctggcacaggatcgcagccattggatacagcaagctaacaatatttagagtatcaccacgccccgacaaaggctcaaggaatgaggaggagagggttttcatattgaaactaattgtaaaggtgcgtcaggatatgctccgaatgccgtatcgaacctcctcgcgaacttaaatgtggacggaaccctgcaacaacgtactgaacctcgtcgcgatcaggatgcaacgtcgaactgttccactagattccggtgagtacatccacatcaaagtaaagggtcaacaaagggatccgaaagagttttgctgcacctgcacatgagaactagtttgtttagtattaggcataaaggctc

SEQ ID NO: 18283 - DNA, 237 bp, Diabrotica virgifera
  misc_feature (123)..(169): n is a, c, g, or t
ccttttgtattaatataagtctccgcctgccactgataagttgaaagggccgcgcattttgccggctaggagatatcattaggtttttttgaagtggaagaaggtggagaaaaaaaaacggcnnnnnnnnnnnnnnnnnnnnnnnnnnnnnnnnnnnnnnnnnnnnnnngtaaacccaatggtctataaacattaaaggtttttaagctcactctcaaaaaaattactatggcgcct

SEQ ID NO: 18284 - DNA, 983 bp, Diabrotica virgifera
  misc_feature (938)..(959): n is a, c, g, or t
  misc_feature (962)..(975): n is a, c, g, or t
atactacatcttaaagagaaaccttaaagataaataaatcttaaacaatttaaacaagtttttgtttccaaaagcaacttgatattattttgttttctttttaattaaagccaatacattttatgccaagacttctaagacatacttacgttaatttcaacggtattatggccatcttcaatgtgaaaataggcataaaaataagtaaaagacatggtaaagtatttttgacttggcggaaatatctgagcaggtgaaaggattaaggaaaagtgtaaaaacatatcctaattaacaaataaccatttagagaccttacggattgaaacactggctattcttatttttttaggttcattcctctctattttttgatgcatggacaggaaatttattgtctgccaggaccataaccacatcctattgtaagctacaaacagtaatagtaaaaatataatgtaaataaaataactaaagacataaaaaactattcatctattcctctccagccatgatgtttgggtgaaattcccaagccatgaacaaagttttaatgtgcttgtaacgtttttgagacagttttttcatattcctctgtttgggggttgcatgagaaacaactagagctaaataaataaataaaggactgttatatatttatattgtaatgccgttagaattattgtaatgtttaataagatgctcacgcatacgaccctaagtgctggtacttctttttatattgaccattagctctgatgatgacagttttgtcgaaagctttttaccgaaggaaaaaataattaatacacactttgatataccaatgtattcacttcctaaattcatttcaagcgggacaaaattgatcacttttttaaacaacttttacctttgctttaaaaacaaaaacccatgggcttttctacctaccaaannnnnnnnnnnnnnnnnnnnnnatnnnnnnnnnnnnnnattggaac

SEQ ID NO: 18285 - DNA, 694 bp, Diabrotica virgifera
  misc_feature (6)..(44): n is a, c, g, or t
  misc_feature (51)..(693): n is a, c, g, or t
cctttnnnnnnnnnnnnnnnnnnnnnnnnnnnnnnnnnnnnnnntaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 18286 - DNA, 808 bp, Diabrotica virgifera
  misc_feature (652)..(675): n is a, c, g, or t
ctggattatacttttgtagcttaataactccaaacggcttaaccgattttgatcagtaaacatgagtttgaaacgtattgaccagtagtattggatggatctaaggtcaagtatgataactgaagctattacaggaattattgagcttgagaaaccgtttttcccacatgaaatagattttgtcgtacttatgaagcctataacctaaaaattcgaattttcctggatatgaggtatacaccgttagattcgttttgagtccttctacaaacgctaagttattggcgcaattcgtaggttgaaatgttgagtaattgtcgaaaaaccaaaattttcaaagtttagtttttcagtttttcggctatactgagtcgtgtgtatgtctgatcctgacggcttagacaccatttgaaagcttaagtcaacactattgatttgatgtatttgcggttctcctgcctcttcttgatccgaatatatatacccccaaaaatatgccgttttgtacatactaagtcctatagctggcttatgggtggtcaaaagtgacaaactacaccggttctaaatcggccctgacctcctcttcaaacacagagaaaaaatatcaaatcggtttaactttcaaacacacatacatatccacaaacannnnnnnnnnnnnnnnnnnnnnnngagtcacatttctaagctctataacttttgaatggtataaccgattttcaaaattagacatccgttagaaaggttaaaattagacatcagtactgttagagccgcaaagattgactaaaattttcgagttttt

SEQ ID NO: 18287 - DNA, 108 bp, Diabrotica virgifera
  misc_feature (3)..(89): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagtttataaattat

SEQ ID NO: 18288 - DNA, 710 bp, Diabrotica virgifera
  misc_feature (223)..(242): n is a, c, g, or t
  misc_feature (355)..(372): n is a, c, g, or t
  misc_feature (388)..(405): n is a, c, g, or t
gtcgctgttccttactcttcttggccattcctttctgtttatcgtgtcttcttcatttaaacctttctctctgaactcctctgcccacagttcttccatcttcttatcggttttcttctacttctcttaccctcaacttctaacagctctatgctatatgtactgttctgttgaatttaaatttagatggattagatttgatctgacctttttagaccttgcnnnnnnnnnnnnnnnnnnnnctaaaattgacattgataggacgaatgatttatctctggtttctcgaaatttaagtctaaaaatgacgtttctcatgtgatatgtgtgaattatagtgataaagtaactacannnnnnnnnnnnnnnnnnggaatgcgacgacctnnnnnnnnnnnnnnnnnngtaaatctaaagactgttacacatatgtatgtctaagttaaaacttttaaattttgaagtgtttcaaggtataaatacatcctgaatacaatacattacgtgccatccatatgcctttaaaatagaatttgatattcaggtataaaagtttatttattgttaatatttgcaataactgaatttattagaaaagaatttttgcgtcaagcaaataaagttggaagattttcaactttgcgcctatcgatggggctgaagaaaagctgtacatagattttgatcaggattttcgtatcactttacct

SEQ ID NO: 18289 - DNA, 249 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(192): n is a, c, g, or t
  misc_feature (201)..(235): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccaggtggttnnnnnnnnnnnnnnnnnnnnnnnnnnnnnnnacgaaaggnnnnnnnnnnnnnnnnnnnnnnnnnnnnnnnnnnnttttttaccggaag

SEQ ID NO: 18290 - DNA, 937 bp, Diabrotica virgifera
cagataactcagtaatgtctacagcagtgcattcctgtccaatatatattttctttggatgtccgattgggaactttccgtacttgcatacccacggataaagcgaacaaacatcaacgtatttaattttttcaccatctttacacttgtaatactctacagtattgcctgtacgaccaccatataaagcatctctaggattcaaaggtaaactagccataagaggatgcccctcggtatacgcctttatctcggccgtcagcattttacggaattgacattcccatatttcaaccacctcatatcctattgatctgagatgcttaactttagcaattgttttatcatgacgattctccatacaatctgaaggatcgtcatgaaggggtgcagttctatctgtagggtaacaagtaggacaaccgtgataataacaaccttggaattcaaagatggtgttttcgtaaagaccgtccaccctacaatttccaataagagcttcaagtcccctggcggcatgctgaattttaatacagcgttgcttctcttcccacaataaccactgcaaagctattttcgactgattatctttgaatcgatagcccccttttggaataagggctattgtgtttggttgtaagaaattacgcctgaataccttgttacacgtcgatgcaacagttgttgcctcgaaaaacggacagacatttgaagtatccatcaactgttttctgaaagtgagacaagccttagtcaaaatctcaacatcgctaatacaatattcaacaatttccttttgaaatcaaaaacgtatccctcatctactctttcagcgtgccacgcgatcagcttgtcacgtgcatcatcttttaaattatcgggatcgtaaaattttagatcaggcatagggccaacataagattgattttcctctctg

SEQ ID NO: 18291 - DNA, 176 bp, Diabrotica virgifera
  misc_feature (2)..(21): n is a, c, g, or t
gnnnnnnnnnnnnnnnnnnnnctaagttttttgatccattttttctgcttataacgatgcattaccttagggatagcagcgtagcctcattgcaaaggtccaatccacaataaatattgccgaccacgcatgttggcctaaacttcataaatgacgtaggcacctagagcatcaag

SEQ ID NO: 18292 - DNA, 790 bp, Diabrotica virgifera
  misc_feature (2)..(42): n is a, c, g, or t
  misc_feature (47)..(79): n is a, c, g, or t
  misc_feature (84)..(591): n is a, c, g, or t
  misc_feature (598)..(635): n is a, c, g, or t
  misc_feature (655)..(668): n is a, c, g, or t
  misc_feature (671)..(693): n is a, c, g, or t
  misc_feature (701)..(723): n is a, c, g, or t
  misc_feature (753)..(784): n is a, c, g, or t
cnnnnnnnnnnnnnnnnnnnnnnnnnnnnnnnnnnnnnnnnnctaannnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 18293 - DNA, 691 bp, Diabrotica virgifera
  misc_feature (2)..(67): n is a, c, g, or t
  misc_feature (79)..(119): n is a, c, g, or t
  misc_feature (121)..(150): n is a, c, g, or t
  misc_feature (152)..(176): n is a, c, g, or t
  misc_feature (187)..(258): n is a, c, g, or t
  misc_feature (262)..(287): n is a, c, g, or t
  misc_feature (291)..(332): n is a, c, g, or t
  misc_feature (356)..(397): n is a, c, g, or t
  misc_feature (446)..(467): n is a, c, g, or t
  misc_feature (493)..(542): n is a, c, g, or t
  misc_feature (553)..(574): n is a, c, g, or t
  misc_feature (576)..(596): n is a, c, g, or t
  misc_feature (651)..(668): n is a, c, g, or t
annnnnnnnnnnnnnnnnnnnnnnnnnnnnnnnnnnnnnnnnnnnnnnnnnnnnnnnnnnnnnnnnncgttaatcaggnnnnnnnnnnnnnnnnnnnnnnnnnnnnnnnnnnnnnnnnncnnnnnnnnnnnnnnnnnnnnnnnnnnnnnncnnnnnnnnnnnnnnnnnnnnnnnnncaatttaaacnnnnnnnnnnnnnnnnnnnnnnnnnnnnnnnnnnnnnnnnnnnnnnnnnnnnnnnnnnnnnnnnnnnnnnnnttcnnnnnnnnnnnnnnnnnnnnnnnnnncaannnnnnnnnnnnnnnnnnnnnnnnnnnnnnnnnnnnnnnnnnctatattatcaccattaaatatcnnnnnnnnnnnnnnnnnnnnnnnnnnnnnnnnnnnnnnnnnncttcaaatacaaattaggattacaacctttcatactttacaatatgtcnnnnnnnnnnnnnnnnnnnnnncatttttattccttatacatttttcnnnnnnnnnnnnnnnnnnnnnnnnnnnnnnnnnnnnnnnnnnnnnnnnnnctcttaaaacnnnnnnnnnnnnnnnnnnnnnncnnnnnnnnnnnnnnnnnnnnnccaacatctttttcacctgtttatacaaccatgtcttcttgtctctaatataacnnnnnnnnnnnnnnnnnnctaatttgaatgtgcgcgatatc

SEQ ID NO: 18294 - DNA, 75 bp, Diabrotica virgifera
  misc_feature (2)..(60): n is a, c, g, or t
gnnnnnnnnnnnnnnnnnnnnnnnnnnnnnnnnnnnnnnnnnnnnnnnnnnnnnnnnnnntcgcgggattttgac

SEQ ID NO: 18295 - DNA, 204 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (167)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccaggttggtttctannnnnnnnnnnnnnnnnnnnnnnnnnnncaaaaggacc

SEQ ID NO: 18296 - DNA, 181 bp, Diabrotica virgifera
  misc_feature (2)..(22): n is a, c, g, or t
  misc_feature (90)..(106): n is a, c, g, or t
annnnnnnnnnnnnnnnnnnnnatttaaaattgcatattgatgataatattataagtaatatattggatatctagaacatttatataggnnnnnnnnnnnnnnnnngtaatattgttttcacctgtttattacaattgtgccctgttgaattaaacagaacgtctcgtctgcccagtgatt

SEQ ID NO: 18297 - DNA, 888 bp, Diabrotica virgifera
attcttataacaatttctgagctgctatagaccaaaaatagatgtagatgtgttcaatatatttacctttggtccatacgttaacattatagaagtaaaagaagtttttgaatgtatatttcttaacagagatttttatttctcgacatgagagaagaaaaaaaatgataaggttataatactgaaaatagggaactggattagttactgatttttttgaagaagtaatgatatcatcaaagatattaatttcagagaagtcgtgagtggtgaaggttgtagcaataattatctgttttgatggaataaaagacctcggtgtatctgtcatgtggtgaaagatcagagcttttattgaaggatcttgtgagttttgtctgatgttgatgacaatatcactaaaccagagataatgataaaatcctaatttacaaccaacacgctgaattctcttataaatcaagttattctacgctgctatcgaacatccgaaattaatcgttttatcagactattaagtaaggtacaaacaaaattcctttcgtatccccaagaaaatgatgtgcacgatccttcttgcgtagcaccaggttcacaaccccctatttctcctcttgttttgaatgatggtcaaaaaccaagtctcattcatagtgatgagtcgagaaggaaaatttactttatgctcaagaacggtgagaaactcctattttgaatgaggttttgttccattgttagcgaatacgacggccattgtgaacacagctttctgaaatccaatccttcagtcaaaaatattgcttaaactgctccatgcaaagtttttggctctattaaaactctaagtcaattgacggttttcccaaaaacctaatcctgtattttttt

SEQ ID NO: 18298 - DNA, 484 bp, Diabrotica virgifera
  misc_feature (142)..(169): n is a, c, g, or t
gaatatggccgatttcgcagtttttcggcttttggtagcttatatgtcagaaactatcaactttggggaggggtcactggagaccttttctgtttggaatggtccaaaagacctagaaaagctttgttccatgcaagggggnnnnnnnnnnnnnnnnnnnnnnnnnnnngtttgaaggatttttgacccacgtttggtcctgccaacatggggatttgttggaggggtccttttggagtgggattgtgcgtttaatccgagccagagtgttaattactggaggatgatcggtgtattttgctggacaaaatatcagttagctgatgtgtatattgatttatctatgcatagatgtaagggctagttgacaccaataagattagtatcattagaattgcgattggcagtaaaaattagatattttgtgatacttcgtaagatgatatacgctattattaataaatcatctatcactattttcatg

SEQ ID NO: 18299 - DNA, 134 bp, Diabrotica virgifera
  misc_feature (2)..(92): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccttaggaataacagcgtaattttattgtaaagttcaaat

SEQ ID NO: 18300 - DNA, 805 bp, Diabrotica virgifera
  misc_feature (83)..(103): n is a, c, g, or t
  misc_feature (152)..(171): n is a, c, g, or t
  misc_feature (185)..(234): n is a, c, g, or t
  misc_feature (256)..(283): n is a, c, g, or t
  misc_feature (287)..(305): n is a, c, g, or t
  misc_feature (333)..(389): n is a, c, g, or t
  misc_feature (407)..(427): n is a, c, g, or t
  misc_feature (436)..(481): n is a, c, g, or t
  misc_feature (483)..(502): n is a, c, g, or t
  misc_feature (504)..(519): n is a, c, g, or t
  misc_feature (528)..(551): n is a, c, g, or t
  misc_feature (553)..(617): n is a, c, g, or t
  misc_feature (627)..(640): n is a, c, g, or t
  misc_feature (642)..(667): n is a, c, g, or t
  misc_feature (669)..(683): n is a, c, g, or t
  misc_feature (696)..(716): n is a, c, g, or t
  misc_feature (761)..(790): n is a, c, g, or t
agtcatgtttaagataataggatattctttatctagagctatgagcatgttatttactgataggtccgtagtattgtgcgagnnnnnnnnnnnnnnnnnnnnnaagaatttagattttgcaccttgcgcagcagcgattattacttagtagnnnnnnnnnnnnnnnnnnnnaatttatgcgagcnnnnnnnnnnnnnnnnnnnnnnnnnnnnnnnnnnnnnnnnnnnnnnnnnngtaatgaaaggttattcataannnnnnnnnnnnnnnnnnnnnnnnnnnncagnnnnnnnnnnnnnnnnnnnctgtatttataattaactatttttatgnnnnnnnnnnnnnnnnnnnnnnnnnnnnnnnnnnnnnnnnnnnnnnnnnnnnnnnnngagttttaagtagaaaannnnnnnnnnnnnnnnnnnnngttataacnnnnnnnnnnnnnnnnnnnnnnnnnnnnnnnnnnnnnnnnnnnnnngnnnnnnnnnnnnnnnnnnnncnnnnnnnnnnnnnnnngtacggagnnnnnnnnnnnnnnnnnnnnnnnncnnnnnnnnnnnnnnnnnnnnnnnnnnnnnnnnnnnnnnnnnnnnnnnnnnnnnnnnnnnnnnnnncaaacacggnnnnnnnnnnnnnngnnnnnnnnnnnnnnnnnnnnnnnnnngnnnnnnnnnnnnnnncatattgaccgcnnnnnnnnnnnnnnnnnnnnnccttttttattgagagcttgaatgaagggttgcacgaaaaaaacnnnnnnnnnnnnnnnnnnnnnnnnnnnnnnatgtttaaggtaaaa

SEQ ID NO: 18301 - DNA, 682 bp, Diabrotica virgifera
  misc_feature (539)..(557): n is a, c, g, or t
aaattacgtaaattccagaaattacataaattacattaagttacgggtatcatgtaatattaccgtaagttacgtgtaatttatgtaacgtaagttatgtaattttacaactcacatcactacttatataataataattgagttatcctcccacttaaaggggtccggaacgttgtttaaataatcaaaatgtcgggaaattaaggaaagattcgacatttttcttcttttttcgattataacaactttaaacgttttaacttctgagaaaatttggacagacataaaagttgcgtaattggatttcctacaatgtgtgattggttggaagttttaaacattgtcacccttgttgcagggtagcaataattgcgaatacttgtttttttatgttttttttcgaaattattgctttcttgcaacaagggcgaccatttttagaatttttaaccaatcgtatattggggaaaatttaattacgcagcttttatgtcggtacaacttttctcggaaatgaatacttataaagttataatcannnnnnnnnnnnnnnnnnngaatgtttccttcattttttgacattttgattgtttaagcagtgttccggacctttttgcatggaaagataaattaaatattattgtatgagttgggatctcgcggtttctgaaagagatatgag

SEQ ID NO: 18302 - DNA, 696 bp, Diabrotica virgifera
  misc_feature (27)..(27): n is a, c, g, or t
  misc_feature (30)..(30): n is a, c, g, or t
  misc_feature (54)..(56): n is a, c, g, or t
  misc_feature (59)..(59): n is a, c, g, or t
  misc_feature (61)..(61): n is a, c, g, or t
  misc_feature (66)..(66): n is a, c, g, or t
  misc_feature (70)..(70): n is a, c, g, or t
  misc_feature (73)..(75): n is a, c, g, or t
  misc_feature (77)..(77): n is a, c, g, or t
  misc_feature (79)..(79): n is a, c, g, or t
  misc_feature (86)..(86): n is a, c, g, or t
  misc_feature (129)..(130): n is a, c, g, or t
  misc_feature (134)..(134): n is a, c, g, or t
  misc_feature (299)..(299): n is a, c, g, or t
  misc_feature (325)..(325): n is a, c, g, or t
  misc_feature (362)..(363): n is a, c, g, or t
  misc_feature (417)..(417): n is a, c, g, or t
  misc_feature (446)..(446): n is a, c, g, or t
  misc_feature (486)..(486): n is a, c, g, or t
  misc_feature (513)..(513): n is a, c, g, or t
  misc_feature (521)..(521): n is a, c, g, or t
  misc_feature (549)..(549): n is a, c, g, or t
  misc_feature (581)..(581): n is a, c, g, or t
  misc_feature (590)..(591): n is a, c, g, or t
  misc_feature (594)..(594): n is a, c, g, or t
  misc_feature (614)..(614): n is a, c, g, or t
  misc_feature (642)..(642): n is a, c, g, or t
  misc_feature (648)..(648): n is a, c, g, or t
  misc_feature (658)..(677): n is a, c, g, or t
ttatcaggtggtcgatattttttttanatngtgaagaataattcataaaagtcnnntgntnttatnttanttnnngngnggcggtntttgttatgttggtggtggtgtttgttttgtctttaaaaatgnngatngtaatgatttggagaagaggttgttgaaagttaaaggttgtagaaatattagagttaaggaagttaatggatgaattagttttatgaatagtggtgattggtttattttggatgttggaagagatatttatgtttatgttggtagtaaggttagaagagttgaanaagtgaagggtattaatggtggtaantaaattagtgagttttttttgaaggaaaggagaaagnnaattttggggatagataaagtgtagaaagtgattatagtagattgtttgaaganttgggtgaaggttgaagagattgagtttntgagtatatgattagtgatgaggatgaatattttgaaagnatagaggaaaatgatggttgagtttanaaggtatnagatgttaatggttgtgttaaagtaagnaaagttggagaaaaatgtttggaagttagttnattggagannagngagtgatttattttggatantagtgatgtgttattgtatgtatggatnggtagnaaatgtgatnnnnnnnnnnnnnnnnnnnngatgaataaagttgatggg

SEQ ID NO: 18303 - DNA, 326 bp, Diabrotica virgifera
gtgcaaggtccaatgggagttcctggagttggggttccaggaccaatgggagagagaggagaacctggaagacaaggtactccaggactaagaggagctcctggcgcacaaggtcctccaggctattgcgagttctgcaataactataacgctgctgctcaaaactatcaagcctatatggctagtagtggcaacaacaaaggcccgtaaatcacctgtttgtgttcaacaaaaagtagtaattttaaagtagtaatattaaataagatttaagtttaagtacatatgtatatgaattatatcttgtaatatatttttttgtagat

SEQ ID NO: 18304 - DNA, 944 bp, Diabrotica virgifera
  misc_feature (136)..(149): n is a, c, g, or t
  misc_feature (152)..(164): n is a, c, g, or t
cattacgcgtccgaaatgttcaaaatttaaattaattggagaaatatggaaagtccagaggtttttaatttcagtgcgccaggttattcatttaccatagataaatttaaaggaaagttacccataaatcattctnnnnnnnnnnnnnngcnnnnnnnnnnnnnggtttctattatagcatcaaattcaactgtattagatcaagttcttgacagttccagagacaagtccatattctataaagtatatgattttagtttagtagatttagtgaatgtcgaatttttgtccagctttacacaaaatggaagactcaccttgctcagcatcaatactagaatagactgtgataattgcgtaggaatcacaccaaacaataagcttcacttaaatttgaacaaggagagctaccaatgcctgggagtagatggaagttcttcgcactttactaaaaaactggaaaacagatatactgccactgtagatcttagtgatgggaaattattaaccaacaagaagaagtttgaaagacttaggtcatgtctgcaagttttagaaaagtttacagtgttggtatcctgggaaccaccagatgaagaaatatgtccatcttcgattgctaaattctttgtggatcttggttacagggtgaaagaatatagagccacgaattatttccacaaaatcaatacgaaagttttcagtccaaatcttgagagtgatgatgaatttgatactttggagtttgtggagtggttgggaatggtcatgcttggttgtaacttgaagcgagatccgaacgaacctatttatctagttatatagcagatattgaggataaaaaggaacaacaagttaagtgtttgcaattaaaaaggttttttctcatctaatgatgtaaaacagatccattgaaaagaactataaatggcttcctacttgtt

SEQ ID NO: 18305 - DNA, 646 bp, Diabrotica virgifera
  misc_feature (9)..(30): n is a, c, g, or t
  misc_feature (194)..(415): n is a, c, g, or t
  misc_feature (605)..(624): n is a, c, g, or t
ccctccggnnnnnnnnnnnnnnnnnnnnnnctactcgtacttcctttcatttcaagaaggttgtctattttatggaaatatttaaacgtgtgttgaaattggagagttttctaattacactgttaggttttgtgaagctttatacatttgtatttgcttttataatattgaacaaaaatatacgaattttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccacaaaaaaaaataacttacaagggattgtgtgtaaatgaatgaaagaatgataagctggggggaatcacaaattaaccgcggctttgagatgccgccctctttgaagagtgacagccaaagcgagaaagaccccctagtggctgctttcttctcccttttcttttccttttttggttagattgcnnnnnnnnnnnnnnnnnnnntgctttttttaagggggggggg

SEQ ID NO: 18306 - DNA, 60 bp, Diabrotica virgifera
  misc_feature (32)..(32): n is a, c, g, or t
acctttagggatacagcgtaattttaattggnagaagtcaatcgataataaagattgcga

SEQ ID NO: 18307 - DNA, 375 bp, Diabrotica virgifera
gtttgatgactcattaagcactaaattgcaacttgatacgatatacacggattttataaaagcgttttgaccgctattaatcatgatgtgttactaaaaaagttaagtacttatggcttgtctaataattttattaaactcatcaaaagttatctggaaaacagacgttttatagttcgacacaaaggtaatgtatcaggaaagttttacgtcaattccggagatcctgcagaaacaagttaaacggcctccactatttattagattcagtagcaatgatagtgacgatcggcttatatccggagtagtgcgtcaatcagtatgagtcataaataatgtcatacggccaagagcactatatactccaggtttcac

SEQ ID NO: 18308 - DNA, 424 bp, Diabrotica virgifera
  misc_feature (59)..(73): n is a, c, g, or t
caagtaataaaatcgaagtgaaattataaaaatgttaaggagcttttatttttgtgtannnnnnnnnnnnnnnctatggcagccccagcagaagaggcagatcatgcagctggcttacaaccagcggcagttgatttagaaccagctgatttggaaacagctgcatctgcgtatcgaggacatggctatcatggaggacatggctatcatggaggacacggctatcatggaggacatggttatcatggaggacatggctatcatggaggacatggctatcatggaggacatggccatcatggaggacatggataccatggataaacaataaaaacacatcgcttaattaatttaatgtacttaatgtgtaaataatgatgtaaataatagagataatttaagaaataaagcatataataacttt

SEQ ID NO: 18309 - DNA, 439 bp, Diabrotica virgifera
gttgtgaccttagtatatgatctctatccaagaaactaaccatttattgtaccttgagtatcaacaaaatattaactacagaaaaatatattcgaaaatattcgagttacaattacagttacaggatcacaattctttactagtgaaagatgccttatatgcagatttttttatgacagaaacgacctttcatttacatagttcataaaatccttctaagtcatattttatcccttaaatttactaatcttgtctttaatctttaagttgctaccagatgcattagtagggaaaattataaccgcatctatgcacaatccgcagtaggtaatgacacacttcagaccattaaaattcagatttcatttaactgtattattctacacctgagtgtgaggtcccctcagctgagtcatgcacacactatttttatttgaat

SEQ ID NO: 18310 - DNA, 688 bp, Diabrotica virgifera
  misc_feature (248)..(269): n is a, c, g, or t
  misc_feature (279)..(302): n is a, c, g, or t
  misc_feature (304)..(433): n is a, c, g, or t
  misc_feature (595)..(632): n is a, c, g, or t
tcagggactttcggccctcgataatgtaatctttcattctgcgtttggatttttcagaaatatttatatattagctttctcaggatagggaaatgaatgcatttaaaaagcattggtccgaaattttgcgtctatgctctttagcctagtcctgcatgataaatttgaaacgcaatatttattgttgcatttataaaatgtattttttatttgattttaatatctaatgttgcatgtttatcaaagtnnnnnnnnnnnnnnnnnnnnnnctgctgtacnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttaaagggacccagtttaacgacgggggggtggggaggcaaaatttttttaaaggggcccccaaatttaattcccggggccgggttttaaaaccgggggggggggaaaacccggggggtacccaaattaatgcccttggaagaaatcccccttttccccnnnnnnnnnnnnnnnnnnnnnnnnnnnnnnnnnnnnnntcccaaaaatttgccaaccctaaggggaaaagggaacccccctggaaggggccatt

SEQ ID NO: 18311 - DNA, 352 bp, Diabrotica virgifera
aaaagatggttgaaattttgaaagttgaagggtgtggttgtgattgcttactcaagtgcttgctgagtagccccagagccgggcattggttgtgattatgattcggtctacattgttttgaggtaatattgaaaaagctattacttcaaagtaatgtggattgaattgtaattgcaaccattgtttggttctggggctgtttagcaagtatttgtgtaagtggtcatagccacattttttgactttcaaaatttcaaccaacttctcaattttagattcactgatgatggactgataggtccgataatgatctgaattggacatattgtattcaaaacattgtaatttttaa

SEQ ID NO: 18312 - DNA, 726 bp, Diabrotica virgifera
  misc_feature (33)..(62): n is a, c, g, or t
  misc_feature (147)..(168): n is a, c, g, or t
  misc_feature (444)..(458): n is a, c, g, or t
ctatctaggttagatcatcatgcactttggggnnnnnnnnnnnnnnnnnnnnnnnnnnnnnntggaaactacaacagaagaattaggtaaaactagtccaatcaagaatgatttaaataaagattccttagagttagatacctcacnnnnnnnnnnnnnnnnnnnnnnccaatttgaaaactgtgacgttgcatatagaaaaaaatggttattggaggaacatattagaaaacataataaagagagacctttcgtatgtacatcgcctgactgtaataaaacattcacgaaagattcccatttgaaacgtcacaaagttatggtccatgaaaagtcttgtgaacaaatatgtgactttgaggattgtgggaaaatcttcaataataagtacagtttgaaaaaacacaaaactaaagttcacgacaagaattattcctttatttnnnnnnnnnnnnnnnaaggattcctcaagaggtgccatctaacacagcatatgtttgtccacactggagaacctccattcaagtgtcatacgtgtaatctcggatttttgttatcaagagatttagctaaacacaatcgaaatcacaaaacctacacatgtgaatgtggagaaatttttgatcgatggtccaagcttcgtgctcataaaagaggatatttgcagacttatagaaaagaaatgtagaaattgcggtactctatttactgataaaaagaacttgc

SEQ ID NO: 18313 - DNA, 668 bp, Diabrotica virgifera
  misc_feature (30)..(57): n is a, c, g, or t
gcgactcgaagtgaggttgtctgtggtgtnnnnnnnnnnnnnnnnnnnnnnnnnnnntcccttgaggatttaatttccaagatggtccataagaaacctaagaacaaggtaggaaagaaagtagctgcagctcctcttgcagagaagaaaattgaacagaatacattacattaacccactttttgaaaataggccaagaaattatgaaatagaattggatatacaacctcgcagttggttatattgctttgtaagtggtctagacagcatacgtaaatgatttatgatgatgtattgtatatcagatttacaggagctttaatagtttatggattgtcacagaatgcgagacagatttcttttaagaacatttggatctgtttgtgagcctccatatcgaatattaccatttggatgtgtttgaatatgaattagattctgcaatgtttatatatggagaattacgagtggtttatgctcattctcctaaacgaagcattggtgccttttggttaattgctgccgaaacttgggttgttatcaacaataataaagatggaattgttatgttctatatagtaatcttagtatcaggttataaatttgaaattaaagtagatgtccctttcatgagtgactccgttgttgttgaactttttatttttgtt

SEQ ID NO: 18314 - DNA, 662 bp, Diabrotica virgifera
  misc_feature (504)..(519): n is a, c, g, or t
cagcgtttctaaggcatggcgttttcaaaacaggacgagttgtctcttcaaaaaacgtacttttgaggtcctttgccacgaaagctgagaagaggaaaggaatcgacagaaaagttggcccaaaaatagactccacagctcaatctttagcttcaaaagggtttctgaggcaacaaagagattattctccacctgaagatgttaattccaagttagaagcaatcttccagaccgtcgtcggtagttcagatatatctaccgaactcacagatctgaatcaaaagtttactttattcatgcagtgtgaacagcaactaggccatagtattcctaattcgttacttcatcacatgaaaacattgaaggacgttcaaatattctataacatgcccgtagatacaagaacgccactggaaagaatgaaatccatggacttgccggaaaatttacatgttcagtacgaatataaacgatttaatgctgatactgatacgatgtttggannnnnnnnnnnnnnnnctaagagttctacaattgttacaggatgtaaaatacaaagataagtacaaaggacaaaagcaaccattacctgatttttagtgtttgtttctagaacataaagatatttaatatgaaaaatgaccgcgcccctgccgaatgat

SEQ ID NO: 18315 - DNA, 469 bp, Diabrotica virgifera
gtaactgtattactcatacgaggtattttttctcaaaccactgtggttatatgttatattacgttagtcctggttgctggataattgtcaagggcatagccctgaaacaaatagtaagaagaagaaataagattcaggttatgtgttgaaaacgtaaacaattgtatgtactaaataaaatatagatattaaaatggagtactgctagtgaaataaaattaattaaagttacctttatataataattgcatatcataccaatatttatgtatttatgtattcactgattaggcctattccgatataaagattactgtgtttcattatgtatagacttattttaagagtaaataagcctgtatggtaaacgatcatattagatattagttgataatataggcagataagataataagatattacaagtttataatatgagtatatacattgtttgtatgtcattatagaa

SEQ ID NO: 18316 - DNA, 866 bp, Diabrotica virgifera
gaaggtactaaagaggagcagaaaccgaaaatggttaggaagttgtccattgaaaatagtggtgccagagataaatattcgacagctgtacctggcagtttgactccagtgactcaggaagaaattggtgaattgacccccgtttcagttgaagttaataaaaatttcgaatctcccgataactctgatgaaatactagagcttcctactgatattagcgcagtgttgagcgccgttgaaactaaaaacaaggaagagatagacaagagagaggagaagatcgagatgttgacgaaagagaatgattcgttaaaagaccaagtcaagaagtacctaagcgctatacaaatgctcagaaatgacgatgatgagattagtgatattcttgaagatctggaaatagaagcgcaaccaaattataaggtagaggccaaaatgtttgagaagaagttagtgcaggttgcagaaatgcacgcagaattaatggatttcaacgtcatgctccaacagaatatatgtcaaaaagaatcgttattagaaagactcaggggagaactggaagccctaagaggccccatgccctctgatgagatgaatagtgaaggcaactttggtagtgtcaatatttggataccgtcggcgtttttgacaggtaccgggtcaaattcgcatcacgtatatcaaatatttttgagagtcggaaacgatgagtggaacatttatagaagatacgctcaattccatgcgttacatacggatctcaagaaactagatcctattgtaggcacttttgattttcctccaaagaaaagtccttcggaaaaaggattctaccttggttgaagatagaaaaaaacggctacaaa

SEQ ID NO: 18317 - DNA, 590 bp, Diabrotica virgifera
  misc_feature (14)..(39): n is a, c, g, or t
cgccctttcgcgtnnnnnnnnnnnnnnnnnnnnnnnnnnattctcctattaatataaaaataacgcgaccgagacataattgctcttacacaaaccatatcttaattgtacatcgcacaaaattttccccctagagcattgagaatgattgagcaacggtccagaagttatacctcacaaagaaagcagaacaaaatgacgaagaatatcataaacaagaacttgaatgtaagatacaggtaatcgaccgagaagacaacagcagtccataatagaacactaaacatatgtacttaaaatgatgattgatgaaacagatatccagaagacatatatagttaaggtctctgacatcccatgctctacaaattaactataataacgacaggatgtgaaggtgtcaattcatatcgaccaatgcaatatgtatgtgctcacaacatgtattatcttatcccatgtttatattcgtgataattaacagttgtataatgcccactcacctaaaccgagcattattgactatatgttaatagcggaccacaatagtttttatatcaacaaaaattacgatgtaatagataagtata

SEQ ID NO: 18318 - DNA, 760 bp, Diabrotica virgifera
  misc_feature (14)..(30): n is a, c, g, or t
  misc_feature (32)..(44): n is a, c, g, or t
  misc_feature (94)..(111): n is a, c, g, or t
  misc_feature (268)..(280): n is a, c, g, or t
  misc_feature (282)..(300): n is a, c, g, or t
  misc_feature (310)..(330): n is a, c, g, or t
  misc_feature (370)..(402): n is a, c, g, or t
  misc_feature (409)..(421): n is a, c, g, or t
  misc_feature (423)..(473): n is a, c, g, or t
  misc_feature (526)..(545): n is a, c, g, or t
  misc_feature (652)..(671): n is a, c, g, or t
cttttagtaacagnnnnnnnnnnnnnnnnncnnnnnnnnnnnnncaggattgtgagagaacattctatttttatacaagcaaaattcattttcnnnnnnnnnnnnnnnnnnccttatcaattaatacttatatctttattattctcgaattcaaaagagctaacaacctaaaccttttattgtaacaccaacattttacatacttcttctgtcatgaactgttcttcgttcttaaccacctctaactttttaacaaataacttaaccnnnnnnnnnnnnncnnnnnnnnnnnnnnnnnnnctttatatcnnnnnnnnnnnnnnnnnnnnncggatgagctcaaacataaaattttattaacatttaattnnnnnnnnnnnnnnnnnnnnnnnnnnnnnnnnnccctacnnnnnnnnnnnnncnnnnnnnnnnnnnnnnnnnnnnnnnnnnnnnnnnnnnnnnnnnnnnnnnnncaacttacattatttacacttactaatgacgataatattcgtattaaaaaacnnnnnnnnnnnnnnnnnnnnctagctgtaataacggccttcggcaacatctttctcacccgtttattaaacacatcgtctttttgtatcaaccatccactctcgcctgcccactgaccaatttgacnnnnnnnnnnnnnnnnnnnncgctaaggtcgcatcatcattagattttttattgcccgctgaaacgcacggttggatgatatcaaaaactgtcttcatttgatttataa

SEQ ID NO: 18319 - DNA, 810 bp, Diabrotica virgifera
  misc_feature (470)..(495): n is a, c, g, or t
  misc_feature (498)..(516): n is a, c, g, or t
  misc_feature (535)..(558): n is a, c, g, or t
  misc_feature (560)..(579): n is a, c, g, or t
ggtatcactaaggttttgttttttgaattatccgaatgtctcttttcttgtgggagctgtaaataaaaacactactttgaaggtttttttaattaaagctatcaaacgcactaaaattaacaaaacaaaattaacaacaaagcaatacaattcaatagcggggatgtttacctcttgcagcaacgactgctcgctatcggattggcatcgaataaagatgagttatccttagggcctattttaccactaggcccgtgaggcacctgcctcgaatccgtattttagtggggcccggaaagataaccaaaaaaaatgtttattacaataacaaaataaattttcaaaattctttcattttacgaacaggaaatgataaatgataacaatacgaggtataattacatattgtttaattgtttaaggacattttgagcctgataacgacatcttaacatttaacattttaacgnnnnnnnnnnnnnnnnnnnnnnnnnncgnnnnnnnnnnnnnnnnnnnctggtgcaactacatttcnnnnnnnnnnnnnnnnnnnnnnnngnnnnnnnnnnnnnnnnnnnnggggcccgaaaattgtgtagtgcctcgggcctgattttaaataaaataggctctggttatccttgcctgggtaatagcccgatattcctctacctgagccatgtctgtaccaaattttctggaggactaggatgacggcgaatagctttttttaattcattccacaaatactcaataggattgagatctgagctgcatgcgggccattctaatctcttcaatcctacctct

SEQ ID NO: 18320 - DNA, 496 bp, Diabrotica virgifera
gggatggtagatatatggttgatggttgttgaataagtatagaagagaaatgtttgtattattaattgtgatataggaagatatgtatgttaatgattagaagagaagaatatatataatgatagttggactgtttttgttgtattgttttggttgatatataaatgatgtgaaattttatgatgcataaattatggaagtgtttgattaaggaaacagttagtggagatatgaagatagttatattcatgaaaaaaatggatgaatgttagcgagattatcgtgataatgatgtctatttcttatgagagtgaatacatatatgggattattttaagaggatgatgaaaaaatgtttgtatataaattgttgaatattaagatatgtgtttgagttttgaaaaagtattatgatatcaatctagtgagatgttgttatattagatcgtcttgaggggtctagattgatgggtgagatgtacattaattagattat

SEQ ID NO: 18321 - DNA, 218 bp, Diabrotica virgifera
  misc_feature (2)..(70): n is a, c, g, or t
  misc_feature (72)..(216): n is a, c, g, or t
cnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnct

SEQ ID NO: 18322 - DNA, 657 bp, Diabrotica virgifera
  misc_feature (297)..(336): n is a, c, g, or t
aaggacctcgcgcctgacgctacatcccaacgaagcgatccttttattctacaacctaatttctaacagctgcattgactttatttccaaacaatcaatatgaaaatccaacctactcatattaacatcggtggccttgtacacggaaattctgctcaatctactactactgtcccttaactttacaaaggaagagaccatcaacataaggtcccatcaaaaagcatcagaaaaacaataccctcaactggaaaaaggtacattcgaatatgcctgtgtactccataaacttacggnnnnnnnnnnnnnnnnnnnnnnnnnnnnnnnnnnnnnnnncgaaatctcaaaacacctaaatactatgtaatcatgcatgtgcatgcccctgaacacgaagatatcgttacgatcatgatacactgaaacatctcaaactgactgcgctgcactcattgctgcagctgaaactgccgtctaagcactcgacattacagataatgctcttgcacagaaacatgatcttcttgctctcacccttgaagaattgcaactcattgttgatcgtcgataacatgaagtcgacggatgctgacatacaacgaatcaccttccaaggaaatcttgaagaaagtatcctcatacatcatgactagtgtg

SEQ ID NO: 18323 - DNA, 879 bp, Diabrotica virgifera
  misc_feature (7)..(23): n is a, c, g, or t
  misc_feature (25)..(839): n is a, c, g, or t
  misc_feature (855)..(855): n is a, c, g, or t
caatttnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttttgatccattnttttttgatatagaaataattacc

SEQ ID NO: 18324 - DNA, 771 bp, Diabrotica virgifera
  misc_feature (18)..(41): n is a, c, g, or t
  misc_feature (54)..(87): n is a, c, g, or t
  misc_feature (89)..(118): n is a, c, g, or t
  misc_feature (120)..(694): n is a, c, g, or t
  misc_feature (707)..(707): n is a, c, g, or t
  misc_feature (709)..(761): n is a, c, g, or t
tctccacagggccccccnnnnnnnnnnnnnnnnnnnnnnnnctctttccacacnnnnnnnnnnnnnnnnnnnnnnnnnnnnnnnnnncnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggtattttgnannnnnnnnnnnnnnnnnnnnnnnnnnnnnnnnnnnnnnnnnnnnnnnnnnnnntggatgaaaa

SEQ ID NO: 18325 - DNA, 438 bp, Diabrotica virgifera
  misc_feature (373)..(394): n is a, c, g, or t
gaaaatatagagatatttagagatagatggtgggataggaagtacaagaaaaatgcaagcaatgagtcagatggatgatgctagtatatagattgacagaacaatcaaatatatattggatcatctactaaacttaacgagaaactatagctaaaacgcccagatcgtagaaacaatagatatgctaatgtgaatctaaaaaaaggaagagaggaatcgatcggaaggttacaaaaataaggtgtacttccatcaagatgaaaaggaagaacagaacgagtagcctgaaagctgatcaaggtgtaatatgttgttacaatcattagtgatagatagccacataatacagatacgtaatcatactaatgtatannnnnnnnnnnnnnnnnnnnnnctaaaattctcaggtgaggccacaaaaatgaacaaaaatgcctg

SEQ ID NO: 18326 - DNA, 714 bp, Diabrotica virgifera
  misc_feature (3)..(26): n is a, c, g, or t
  misc_feature (28)..(44): n is a, c, g, or t
  misc_feature (60)..(117): n is a, c, g, or t
  misc_feature (121)..(134): n is a, c, g, or t
  misc_feature (136)..(173): n is a, c, g, or t
  misc_feature (193)..(228): n is a, c, g, or t
  misc_feature (275)..(297): n is a, c, g, or t
  misc_feature (299)..(336): n is a, c, g, or t
  misc_feature (349)..(375): n is a, c, g, or t
  misc_feature (421)..(447): n is a, c, g, or t
  misc_feature (455)..(468): n is a, c, g, or t
  misc_feature (470)..(502): n is a, c, g, or t
  misc_feature (558)..(575): n is a, c, g, or t
  misc_feature (577)..(592): n is a, c, g, or t
  misc_feature (627)..(651): n is a, c, g, or t
ccnnnnnnnnnnnnnnnnnnnnnnnncnnnnnnnnnnnnnnnnncgccattagtattgcnnnnnnnnnnnnnnnnnnnnnnnnnnnnnnnnnnnnnnnnnnnnnnnnnnnnnnnnnncacnnnnnnnnnnnnnncnnnnnnnnnnnnnnnnnnnnnnnnnnnnnnnnnnnnnnccaccactttcattggaacnnnnnnnnnnnnnnnnnnnnnnnnnnnnnnnnnnnncattcccttttaaatatatctcattctttaagaaataaactacatcnnnnnnnnnnnnnnnnnnnnnnncnnnnnnnnnnnnnnnnnnnnnnnnnnnnnnnnnnnnnncggatgacctcannnnnnnnnnnnnnnnnnnnnnnnnnncttaaataaaaaccacgactaaaaattttcatatttcaccatatgnnnnnnnnnnnnnnnnnnnnnnnnnnnccctatcnnnnnnnnnnnnnncnnnnnnnnnnnnnnnnnnnnnnnnnnnnnnnnncaatgacgctcacattactattaaaaaatcgtatatttactaacaatatataggcnnnnnnnnnnnnnnnnnncnnnnnnnnnnnnnnnncttattaaacacatgcctttttgtattacatatcnnnnnnnnnnnnnnnnnnnnnnnnnctgaacgtccgcgcgattttgaccgcgctacggtagcataatcatcatagtatttattgaaag

SEQ ID NO: 18327 - DNA, 240 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (137)..(138): n is a, c, g, or t
  misc_feature (162)..(193): n is a, c, g, or t
  misc_feature (199)..(199): n is a, c, g, or t
  misc_feature (203)..(235): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagttnnaaccggtgtgagccaggttggttnnnnnnnnnnnnnnnnnnnnnnnnnnnnnnnngaaggnaccnnnnnnnnnnnnnnnnnnnnnnnnnnnnnnnnntatta

SEQ ID NO: 18328 - DNA, 867 bp, Diabrotica virgifera
  misc_feature (285)..(302): n is a, c, g, or t
  misc_feature (834)..(834): n is a, c, g, or t
tgtgaaatgtatagtagataaaaagtaaaatacagaaggcttgtgatttaatggtttcatgtaaattttattcctagaaaatgacttttcctatcactgatcaccttttctatcacttgaaaaaggagggcgttacaaaaaattttgaataagcaaaccccaattattttttagttgtttacctatctagatttagtgtttacctaacacctaggcggtgttaccttttttgaaacaccatgtataaaattgtatcgataaagcgagaaaagggaaaatatgtgnnnnnnnnnnnnnnnnnntacgtttcaccaattttaaaaatcttaaaaagttcagggtgaagtattgtgcaaaaatacacgttagatatttttttttcgtaagaacgagtgtctcagtttttttagactcatttgaaattttatactcgttctaaaatttcccaccgaaaattaaaaaacaatcagacagaaccttttattttaagtttttcgctagctctcgatgccactgagataaaaaataaaagcctaaaaagcttaattaggccaccgtgattacctatttcagggggctaaaaatttcagagtttttctatatgtgataaaaattggcctatatggaattctaatcgagttagaagcatttttcatcatcttacctggctaggccctttgtatattattgttaaatgtaaataatcataacaataataattcttgcgttctgtcatttatttcgataatttggctttcagaaaatttgaagctgtaaataggactgatctgattgagaaaaataagttccatttttgaattcagcatgcatganatatagaagatcaccctatacagtacccgacac

SEQ ID NO: 18329 - DNA, 691 bp, Diabrotica virgifera
  misc_feature (116)..(139): n is a, c, g, or t
ccacttttaagatatgtagttattgtgtttatggatgtgtgaactcatctgtcgattattggtagtatttttaatgggtgtgttatggggacagtattctacaaccaacggccagnnnnnnnnnnnnnnnnnnnnnnnntcaaatattttccaatattggtagagaattattcctaaggacttggtaaactatcggaattgtaaagactgtatttgtttcaatatttagatagaggaatttagtgagagaaatatgaatttattggtaggagtattagtttagtagatggatgtgtgaagttaaattgaacacaaagaaagaaaaatgtatacagtgaaaataaagaaataaatggtgtaggaagattaattgtgacaagggactaaaaaaagtatatttaaagcactggtaataattttgcgtggctcgaggtaaattgtgctggtgtggaaatgtttgtcgcatcaatcggactcaggaattttcgacgcacaggacgcacgcgctccgtcggttgtcggtttttgagcgaatatcaagggattgcgtcgcatatggtttgcagagtggacgcttcttttggcacagtgtgtgtttttaagttactccgcacagcgaacaataaacaaattttcgatggtcgagcagtagaatttgcgtcgcaaatcgtaactactcgatcttcgaaaa

SEQ ID NO: 18330 - DNA, 854 bp, Diabrotica virgifera
  misc_feature (293)..(313): n is a, c, g, or t
  misc_feature (334)..(576): n is a, c, g, or t
  misc_feature (578)..(758): n is a, c, g, or t
  misc_feature (760)..(806): n is a, c, g, or t
gaaaaatgacaagaaacctgttttatttgggatgttgcaaagaatctaagaaatatatattttggagggaaacagaatatttttgaaaatggtgcgcgccgcgactggcgaaggaatctggatggacacgcataattgacaattgaatggcgacgatgtaaatataagttgcatccgatcaggctgcagaatcttgaaaatgttagtgtaaactacaaaaattgaagaacttgtttgcctggatatgacattcgtgattgagtatatctaacttgttaaggaatatattctcnnnnnnnnnnnnnnnnnnnnncataattacatattttgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnagctaaatttttttaaagacgagaaaaccctatagaggtttataaatt

SEQ ID NO: 18331 - DNA, 888 bp, Diabrotica virgifera
  misc_feature (859)..(859): n is a, c, g, or t
gttaagcgaaaatctatttttaactagcagaaataaaatgaaaaacaaaaatagatttcctacttttgtaaattttttccttccatttgtatgtaggtaagaacctccaaacgttcagtacttaatagaagaaatgaaaattattaacaaaaaggaaatacctcaaggtggtttaattttagaagaaaagccctttgcctatatactctgtgagaagtttcgaactgttaggtgtgatttctgttttcaaaagggtcagttgcttaaatgttcattctgcagatatacttattattgcgggagagcgtgtcagcgagaaggatggacagtacataaattagaatgtaaatatctaaaacaaataagtccgagaatattacctgactctggaagattgttagcaagacttataaaggtattagaaaagggtggacataatactaaatcttattatactgatataaggtttagaacgtttaaagatttgatgtcacattatcctaatttgaagaacgacagtactagaatggaacatttttcatcactctatgcagttctgtacgaattttttagaggagaatcattgccaaattctgcggaattaatgggaatgtatggaaggatttatattagttatatagacgtcatggcaaccaaaaaggagagactacaggagctcgagcaagcctactacttcctttgtcgttgtgtgaagtgtattaatccagaaccgataatagagatgacaggcgccgcctgtccaaactcagactgtaacaattgttttgatagttttactataaaaccagatgacgaatgttcagcatgtggaacgatcatcagtggagagtttatacangtattccaaagatgtgatggatatgacat

SEQ ID NO: 18332 - DNA, 649 bp, Diabrotica virgifera
acaatatttgtcattactagtattagtggctgtttttacggcaacaaattgttccacttacttaccagaaagacattgggcaaaaggtgctgccaacttcgagaaagctgcggcgaatacaaaaaaacttggagaactgattggaaagtatattatcgacaatgaaattgagctagaagatttacaacttgttggatttgatataggcgcccacgctgcagggcaggcaggaaaatatattgctaatttaactggtcattatgtaagtagaataactggtcttgacccagctgctcctaaatttgaattggattctgtgccaccagaaaacaaattacaaaaaactgatgctattttcgtagatgttatacatacaaacgttcaaaagttgggatataaggttccgattgggcacgtagattggtacgttaacgttggaaatgaacaaccgagatgtcctaccttaatgatgtcagaaacagatgtgtgcagacacttacgtgcctgctacctatatgttgaatcgatctgttaccaggtgacttcctacgaatgtacgggaaccatcgagaatgatacatctacagtaactctcatgccgtactggaagacacataggatatggtgatgaagtgaaattatctgatac

SEQ ID NO: 18333 - DNA, 799 bp, Diabrotica virgifera
  misc_feature (690)..(710): n is a, c, g, or t
cgttcttcgagatttgagtacatattgagtgtttttggttttgtttgagtctttctttatttagtctagtcttgagttgagttttgatgagttctgatttggacatttggatttgattgagtttatacctttacctttactgtggtttatacttactcctcctatatacctattatagatgattaaaagttgagaaaaagcataaaaacggggtatacatattccacaataaaatacataaaaggagtccgaagccgaagtttaaagtaaagcaaagacatctattatttactgaacgtgtgtactatttctgcttcgtttacgtttaagcattaaacagtgttataaatatcatacttaaaatcaaattaatatggaaataaaacaagaagctagtgaggaaacttgtaaaataagagtagaggacacatgtgttggtagttcctttgatgtctgcaaaattgaaattattgaagaacccaagagagaacctgtatatgatgcatttgattatttagactcaaatgaattttccatagacactaaagtagaacaagatgaatataaattttcactggttgaagaaaagctaacaacaaatgaagaaagttgtccccaggagaacaaaataaacattatggaaacgtcatattcatctcataaaggaaaatatacaggtcaagatgctgnnnnnnnnnnnnnnnnnnnnngcatgaacgttgggactgaaaacagaccttacaaatgtgaatttggtttcgagcaatttactacaaaagggatttttggaaactcattt

SEQ ID NO: 18334 - DNA, 341 bp, Diabrotica virgifera
  misc_feature (69)..(97): n is a, c, g, or t
  misc_feature (106)..(153): n is a, c, g, or t
  misc_feature (155)..(204): n is a, c, g, or t
  misc_feature (219)..(255): n is a, c, g, or t
  misc_feature (270)..(294): n is a, c, g, or t
aatatagggagggtgcggcggctggcggtaccggctccgagaacctccccctttcgctttacgcgcccnnnnnnnnnnnnnnnnnnnnnnnnnnnnngccttcatnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnccttgcgtatcaccnnnnnnnnnnnnnnnnnnnnnnnnnnnnnnnnnnnnncatgtacaagagctnnnnnnnnnnnnnnnnnnnnnnnnnctcaatattttgagtaagtattttggaaggaagtggtgactcgattt

SEQ ID NO: 18335 - DNA, 1013 bp, Diabrotica virgifera
  misc_feature (92)..(110): n is a, c, g, or t
  misc_feature (112)..(125): n is a, c, g, or t
  misc_feature (509)..(528): n is a, c, g, or t
  misc_feature (561)..(584): n is a, c, g, or t
  misc_feature (895)..(926): n is a, c, g, or t
cacaaatatttttgtcaaataaaatgtgtcaaatcaaaacttaccaggaattacctttcgaaactgttcaaatataactggtaactatatgnnnnnnnnnnnnnnnnnnngnnnnnnnnnnnnnngaatattaaatacctacatactatgtgtataatatgtattttatttcaattttggcatataatctacataaaagcacctaaattattaaattttgtagtttgaactcttgaaaaaaacgcatccatagaaaaagtacagtgtacaacacgtgagaaaacgacatatttctccctcgcttgatttgcggccctcgcctcgtacctcggcttgtgccaacaaacttctgtgctcgtgagaaatatgtcttttttctctcttgttgtacaatatactatttttaaatggtataaggtgtaataatgaaatagctgtttattttaatatctcgaatctggtttaataaccaaatagtttcttatagaaataaatcgaatataccatannnnnnnnnnnnnnnnnnnngtctacgaatgtgtttgtctagatcttttaacnnnnnnnnnnnnnnnnnnnnnnnnatgtgaactacattcattttaacttacaaagtacatatgtgcattcctttatgctaatttccatttatgtatgattatagtattttttataagactttaaaatagaacaacattagtttagacattaaaatttttgttttataacactatgatgagtaggaaaccttttctttcgatgggcttttgagatttttctttgtatttttattgcttgtaaaaatggatatgcctttttattaaacattatcatttttttaaagatccataataatttgctcactttgaagggaagaatttgcttttcaagttcnnnnnnnnnnnnnnnnnnnnnnnnnnnnnnnntttccttcccaaaaccccccaaaaagttcttttaaaaaggaaaacttttttaaattttggggttaatccccacaagggggaaaaatt

SEQ ID NO: 18336 - DNA, 703 bp, Diabrotica virgifera
  misc_feature (232)..(252): n is a, c, g, or t
  misc_feature (507)..(520): n is a, c, g, or t
  misc_feature (522)..(534): n is a, c, g, or t
  misc_feature (560)..(615): n is a, c, g, or t
  misc_feature (617)..(676): n is a, c, g, or t
cgcttgaatacaaaacatcactagattaaaccaaagctaaaaatggcagcaaagttggccttcttctttacgttcttcctcgtagctgtatatattactgaagctgttaatgttcgcaacaaaactgaagctgcagttaaggaagccactgaaactgtccatctccatactgctgatattaaaaaccaaactgaaaatgcagcaaaagaagttcatgtccacacttctgacnnnnnnnnnnnnnnnnnnnnngtagcaaaagaagttgcacaagctgctgaaatccctaagactcaaacaactgcagcgcaagatattgatagtaccttagacaatttgaaagctggctttgaagaattcgtcgacaaagttaagaataatgacattgttaagaaagctacacaagggatcaaagatcttggagacaccattcagcagaaaggaaaagaagcgtatgacaagataacatctgaaacgaaaacaagataaaccgtttcaaacaaatannnnnnnnnnnnnncnnnnnnnnnnnnngtttaaattaaatgtttatttatatnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnntaattggggaaaaaaaatatggggggg

SEQ ID NO: 18337 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18338 - DNA, 72 bp, Diabrotica virgifera
  misc_feature (5)..(70): n is a, c, g, or t
ggggnnnnnnnnnnnnnnnnnnnnnnnnnnnnnnnnnnnnnnnnnnnnnnnnnnnnnnnnnnnnnnnnnnac

SEQ ID NO: 18339 - DNA, 443 bp, Diabrotica virgifera
  misc_feature (435)..(435): n is a, c, g, or t
gaaattatgtgtattattgttcaacaaggttatcaagtcattcaatatttgatctaagagcattaagagtgaaattgtgaaatggaaagaagtgaaattccaggattattaataggaatagatgacagtagtgggtatgcatgcagacactatctacttaccccagtattacacccaggtatttattgataattgctaaataaatagtaggttatttaatagacataaatatctttttaggtaatgatcaagaaaataagatatttttaccatagtactcatgtgagaacaagaaatgtagaaaagctatttggaacaggagcgtcatttgaaattttgtttgggggggggcaagcactatatatattatactgtatatatgatgttatgatgaatattgatgtattttttgtaaatttcagtcatttttttggngccggggg

SEQ ID NO: 18340 - DNA, 533 bp, Diabrotica virgifera
cacacatgtttttgtcaaatgaaatgcgccctacctctacttaccaggaatcactctttcgcacctgatcaaatatagatgagaactatatgttcctttagatacagaatatgatgtcaatatatctaatattaaatacctacatactatgggaataatatggattttatttcaattctgccccatcatctacatattaggacctatcctagtaacttctgaaaaatgaaatctcggcttcaacccatccatagaaatagaatagtgctctttgctagggaacttttgatatattctccctcacatggatttacagcatcaactaagacaacagctagagagagaaaaggtcagcgatgatgtaagtgaagacgaacaatattttatgcaatgactgatgaaggtgtgtggatgccaccgatagattttccggaatctatagtatattatgatgacaccgatgaagaccactaaaactccgagtctggatatggttatcctgttaattcgatattatctcgagtaagataatt

SEQ ID NO: 18341 - DNA, 995 bp, Diabrotica virgifera
  misc_feature (703)..(722): n is a, c, g, or t
cctttttgaaaacagataataaaaagcaatatttcctacaaatgttttttacttcgtaatttcgtgatttcctataaatgtttgtactttatatttaatttgacatatggacctacattttatatatgtattattattttaaatcttaatctctttaaatctagtaaaacgaataaactgactttatttgaaacaaaatacgctgagtagcctttatgacattattttgtaaggttttcccttctctaaactcttcacctgcagataccaccttgtaccaaaacgttgcacaaaactgcagtaaataattacaaagaaaataacagcaaggtggattaaaagcagaaaaaattgttttgtaaagtattaatagtctacactgtatcaaaaaccagcaagcaaaggaatcagcacatatttaggtcaaacttcatggcataactcaacttataatatactaaactatatactgaatactaccatatactataatacactttaccacgtattgtgtacaatattttttctacgaccaatttttttcttagattggttatagcacatctaacgcaaatatttgctggttcttcgattacctctacagataacttactatatccatagttaagacatagatttgttagaagataggtagcttaattaataaatgtagtaaatgtaaaatagtggtatatttggatgnnnnnnnnnnnnnnnnnnnngtgtaccgagggtgctttttttagacaggaaaaataaaggtagacgattgtaaatcattgtcaaaacttaagagtactattatttggcgtttttctgattatggaaggttaaatatcttaaaaaatttacaaaaatcagcacccaccgtcaaaatcacggtggattaaattttttattcacggcaaacaaagtttaattaaaaatatctttcctttttcttttctttgaaaaatttgggcagggttattatttcccagggtttgccccatggg

SEQ ID NO: 18342 - DNA, 824 bp, Diabrotica virgifera
  misc_feature (700)..(700): n is a, c, g, or t
  misc_feature (797)..(797): n is a, c, g, or t
  misc_feature (804)..(804): n is a, c, g, or t
atcccttgtagccggtatattgaatggaagagtgtgttttaactgtatatagagcatcgacttcacatcgtttttatatagcactcgtattatatacaatgttgccataagttttattatcggacattttgtaataatttattaatgctcactagaaaaacctttatgttgtagttatgtatatatagttcacgggagaaagcgatcgtatgaatgcaaagagagtcagtgccaattataacctatatatgtaataaattctgaatgctgtgtaccaattataatatgtgtttgcacttgtgtattatttgaaatgtatacttaatattcttatgaaatcgcactgtattacctaaaattcgtgatcatttgtccataattcattcgtcattattgtatcggtaaaggatactaaatctgacgtcgaactaatagtgaagcttcgaaactcttcaaagaaacttctaataacacgtaaaagtctataacatatttaatttcaacttattcttaaatgttgtgtagaagatccttaatatgggcttctgcagtgataaaaagtatttgtatcttcctcgctgtgtcttttttagccgaaatgagaaatgtatcgaaatcagttagaatctagttccagctgttaatagcactattcgtcgccgccatgtttatcttcaacttaacatgtaacgtacattgngtctattgaatggaaagaagtgtttgcttttacttacaagtatttaagtatttacttaatactaattgaatgaagtcatttctttaatgctttgttncattacnattaagtaaatacttaaata

SEQ ID NO: 18343 - DNA, 819 bp, Diabrotica virgifera
  misc_feature (733)..(733): n is a, c, g, or t
gaaacgactgaggtcgggtacagaaggacatgattcattcagtaaatgatccattacaacagttaagagaactcattactaaaaagaattgaggacattacaactaataagaattgctgaatggaacgcaaattgacttctaaaacgtagacaagaaatcgaaatattcttagccactaataaagtagacattctattagtgtctgagacgcacttattcgccagtgcacaatttaaaatcacctcgtataaggtctacaacgcagaaagaaatcccagaggcggagcagcaattataattaggaataatcttaaacatcatgaactaccgaaaatcgaaaaagatttccggcaagcagtctcaatttgcatagaagacaattttggcccactatgcatttcagcagtttattgtccgccaaattatcaacctaacaagaacggatttgaaacactttttaaatcattaggtcccaggttcttagcaggtggggactacaattcaaaacacaagtgctggggctcaagattatccccccgggaagaggtagattcctatacgatgtggtgaaagaaatgcaactacaatatctctcgacctacaaaccaacttactggccaaccgatcgaaatagactacctgatctgcttgacttctttatatataaaggaataccaaaagaatacctgcacacagaacctaatcgtcagatcattcaccaattattgcagncataatgataaaaccatcagaaaaatgtccacctccaagactaacgaatgaaacacagactggaatattttcaaagaaaatctaca

SEQ ID NO: 18344 - DNA, 481 bp, Diabrotica virgifera
  misc_feature (49)..(71): n is a, c, g, or t
  misc_feature (352)..(375): n is a, c, g, or t
ataattgggaaaaaaaagaatggaaaaaagatgaccttgaaagaagagnnnnnnnnnnnnnnnnnnnnnnngaaagataagattaaagaataggaaggaattatattagatgaatagagattgatgtatgatggtatgaaaattgaagatggaagaaatatatatgattataaaatatagaaggaatatagatgttattatggtatttagatatgagaggataatgaatatgtttgaaagatattgaatgataagatgatgatattgaaagtaaaaaatagtgataagattgaaaatgagaaaaaagagttgtgagaaaaggaaggtatgataaaaaatgaattgagattgnnnnnnnnnnnnnnnnnnnnnnnngatgtgagaagtgtaattgaatataaaatttagaaggaatatagatttaattagatgtttagattgataggagagatgtagagatgtgtaaaaattttgattggta

SEQ ID NO: 18345 - DNA, 54 bp, Diabrotica virgifera
  misc_feature (2)..(29): n is a, c, g, or t
  misc_feature (37)..(53): n is a, c, g, or t
gnnnnnnnnnnnnnnnnnnnnnnnnnnnntatagagnnnnnnnnnnnnnnnnng

SEQ ID NO: 18346 - DNA, 149 bp, Diabrotica virgifera
  misc_feature (7)..(44): n is a, c, g, or t
  misc_feature (85)..(102): n is a, c, g, or t
taacagnnnnnnnnnnnnnnnnnnnnnnnnnnnnnnnnnnnnnntgcgacctcgatgttggattaaagtttataattggtgtcannnnnnnnnnnnnnnnnntgatcgacttttaaaagtttacctgaatctgtgtttaaaccgatgtt

SEQ ID NO: 18347 - DNA, 788 bp, Diabrotica virgifera
  misc_feature (7)..(773): n is a, c, g, or t
  misc_feature (780)..(780): n is a, c, g, or t
ttagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaangtaaaagc

SEQ ID NO: 18348 - DNA, 482 bp, Diabrotica virgifera
  misc_feature (28)..(28): n is a, c, g, or t
  misc_feature (180)..(206): n is a, c, g, or t
cccactcccggcacggggaggtaatttncctttctgcggccatccttggatgcagaaggagagtatgcatatatatttacgatggagatagtagaacggtgtatctcttagaaaaataaatttataataaacaattaattaagtgaaacttgagagtccatacattaaaacaaaatatcnnnnnnnnnnnnnnnnnnnnnnnnnnngaatgttaatacagtaaatatatcattgaaaagattaagaatatcatgaaaacatttaagttacgttaagaaatgtggtttgatataaatatatgaatatgtttaggtagaagttgacaagagaaactaagaattagcaatgtgaaattataaataatattagtagaagaggaaaaatactatggagagaaggaatataatccttttagatacattggcatatgactttgcagaacaactgtctaagctaagatggtgttattaagaataatatcg

SEQ ID NO: 18349 - DNA, 799 bp, Diabrotica virgifera
  misc_feature (755)..(755): n is a, c, g, or t
aatatatcggtgttcagaccgaaggacccgaaactaattttaaagatttaaaagtggccgtgttagacaaattggacagtacggagatcagaacgatgagagacgccaaatatatttatctaactttaaaaagtttgaatgacaaattccaaaccgacatccaagacagtactgcgccactttatttaccagccttctttacgtgcacagaaaaatgtcagtcttgtaaaaccaactgtagtctatcaatgggacataaagaagaaggcgaaccccaccaaagtactcaagattgtacgtttcagcatcagtatcaaaactatgtgtatctttgtaaggcttgctacaaaaacggacacagatcagtggttaaacccagctatcaaacgatgactgataattcctggtccagctatttgaattacgtatgggctggttacgtgatagagtgtcctaaatgtggagaaattttcagaagcagacagcattggtatggtaacaaaaatccagaagatgcagctgtaagggcagaggtagttcatatgtggccagggaacaaacccttttttcaggagagatctttgttcggatcactcaattcagctcaaaaagtcttggacggagtaagcatgttcactgatgtgatatctcatgtaggatctcagcctaaaaagttactgagcgattgggcagctgataaaatagcacctagttactggaggccaaaccacgaaattaaagtatgtttcctgtgntagataccgttcctgccacacgccaaaaaacatcattgtcgctc

SEQ ID NO: 18350 - DNA, 1051 bp, Diabrotica virgifera
  misc_feature (812)..(812): n is a, c, g, or t
  misc_feature (987)..(1016): n is a, c, g, or t
cggacgcgtggggaactactagcattcaacacttctcttaaaatgcctccaaacgatgttttgattactgatcgaaatgaaatccgaaaaatttggggaaaatcagaaaatgatgtttacaaggatatccagattataaaggaatggttaaaaatccaaaaacatctgccagagattccaacggacaatatgattgaattttttctcgtaaattgcaaatttagtatcgagaaaacaaaacaaaccctggatatgtattatactgtccctagtcttgtacctgatatatataagaatatacatccttgtacttcagacgtggacctagcctatgagacagcaaatttcgtttgcgtacctgtccttactccgtccttacataggttaactgtgatacaatataaagattccgaaaatggaagcgtagccaaaatgtcagctcatggtctaaaaaatatttacgagatacgaattcatgaggacctgtcaatgggtgaaatatatcttgtcgattgtgaacgtgttaaattcagtgttgcagctggaataactcctgtgacgttgaaacaaatagcttttgttttagagagggtgcacagtttcaggacacactcaatacattttattaatgctccagcatattatcatcacacaataactctatttaaaaccttcttaaagaaaaaattatcagatagggtatatagtcacagatctcttgacgaagtgctaaaacatctcccactggacatattaccaagtggacttcggaggcaaacaaaaaatcttgcgcagaactgcaagaattatgnaaaaaagaaaatgtttgagtataaagaccgatttgacaaattggagacaatgcaagtaaatgaaaaactccgtcctgaaaaactggaaaatgacgaaattttaagctattatgtaaatttcaaaaaataaacccagattaagcaactgatgaaaaattggagcagtgaaataagnnnnnnnnnnnnnnnnnnnnnnnnnnnnnnttgtataattaataagggtaaaaactattggtttt

SEQ ID NO: 18351 - DNA, 852 bp, Diabrotica virgifera
  misc_feature (5)..(137): n is a, c, g, or t
  misc_feature (139)..(787): n is a, c, g, or t
  misc_feature (791)..(792): n is a, c, g, or t
  misc_feature (807)..(807): n is a, c, g, or t
  misc_feature (831)..(831): n is a, c, g, or t
  misc_feature (834)..(834): n is a, c, g, or t
atttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaanntttttgatccaattntttttgatataagaaataataccnttnaggatacagcgtaatttt

SEQ ID NO: 18352 - DNA, 226 bp, Diabrotica virgifera
  misc_feature (6)..(40): n is a, c, g, or t
  misc_feature (42)..(55): n is a, c, g, or t
  misc_feature (57)..(57): n is a, c, g, or t
  misc_feature (66)..(66): n is a, c, g, or t
  misc_feature (83)..(109): n is a, c, g, or t
  misc_feature (131)..(213): n is a, c, g, or t
gagggnnnnnnnnnnnnnnnnnnnnnnnnnnnnnnnnnnngnnnnnnnnnnnnnnanaaagcttanattttttaaagacgagnnnnnnnnnnnnnnnnnnnnnnnnnnnaatagtttttttagattaattnnnnnnnnnnnnnnnnnnnnnnnnnnnnnnnnnnnnnnnnnnnnnnnnnnnnnnnnnnnnnnnnnnnnnnnnnnnnnnnnnnngatccattttttt

SEQ ID NO: 18353 - DNA, 787 bp, Diabrotica virgifera
  misc_feature (163)..(187): n is a, c, g, or t
  misc_feature (292)..(314): n is a, c, g, or t
  misc_feature (776)..(776): n is a, c, g, or t
attgtgagtattgaccccttttctcacatacatcatggactcacacctgcaacattttcatcactttcgtacgaacaaaatgttacttcctgaaatcagaatgttggagaatcagaatagttcggccacattgaactactatatgtatagctacattgcctgnnnnnnnnnnnnnnnnnnnnnnnnngtttcactggatatttatatgcctactaagtgtcggtaaatataattctcaaatgttaaatttattagaatcgcctaaaaagtaagttaaagttctgtttatttnnnnnnnnnnnnnnnnnnnnnnntagatactattatcatgaagaatactttgaacaagtttaactaaatgtaatgaatgtaaaatctttgtcattgtcccaaattactaaataaaactctcgttttatttaatttcggagttacttgcgaccgcctttccaggagaaattttctagcctcattttgttatgttctgtatttcgattttgtacttggaaacatttgatctatctgttatattgaatcacccaccccatatatctatctaagctttggtgtttcctttttagatcatcatcatcaactgatgcttcagcctgaaagtaaaatagcgaagtcttctttcgtcattcagtcccatctattaacaaccgtcatcaattcgtcgcaacagttttcctccggaaaacacaacaaaaaatctattgaggcaggattcggtgatcaaggttgctattctaataccatcccgtattctttatatnggcgatcgtcc

SEQ ID NO: 18354 - DNA, 972 bp, Diabrotica virgifera
  misc_feature (5)..(821): n is a, c, g, or t
  misc_feature (842)..(879): n is a, c, g, or t
  misc_feature (914)..(936): n is a, c, g, or t
  misc_feature (944)..(965): n is a, c, g, or t
atttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataataccttagggatacagnnnnnnnnnnnnnnnnnnnnnnnnnnnnnnnnnnnnnntgcgacctcgatgttgaattaagtttataattggnnnnnnnnnnnnnnnnnnnnnnntgttcgannnnnnnnnnnnnnnnnnnnnnagtttaa

SEQ ID NO: 18355 - DNA, 836 bp, Diabrotica virgifera
  misc_feature (730)..(730): n is a, c, g, or t
  misc_feature (782)..(808): n is a, c, g, or t
gatagttcgaacgacagttcgttggatgtgaagcagaagcaaataaatcaaagaaatctctctattgttaagttgttattaggaaaggaagattattgggaacaagaaccaagaacgtgtttatcattcatagtaacctacctagctctctgcctatggcgcctctgcacctctgtgtttatgttaaatatctttgatgtaaagtgtcagcacagggcagtttaagatttcctcttaaaatttagttatacagtgactacattttggatgtaaatataaaactgcaattgttacataaaatcaaatttaataatatggaaataaaacaagaagttagtggaaaaacttgtaaaatagaaatagatcatgtcacatgtgttggtcccttggataccttaaaagttgaagttaaggaagaaccgaagacagaaactgaataccaggcatttgagtatgtagacttaaatgaattcccagttaaaactgaagtagagcaaggtgaagataaatttataccatttgatgaaaagcaaacaagaaatgaagaaagttgccccgagacccctaaggaggagaacaaaatgaacattgtggaaacgttactttcatcccataaaggaaaatatacaggtcaacatgctgaaggaaaaatctcaaatacaaatatgaaagttggaactgggcaactactttaccaatgtgaaatttgtctcaagcagttttctcgaanagattctttacctcaccatatgaaaattcacaccggagaaaaaacctttatnnnnnnnnnnnnnnnnnnnnnnnnnnnctcaaatgccacacttgaaacaacactt

SEQ ID NO: 18356 - DNA, 555 bp, Diabrotica virgifera
acctttcgtactagaacgtgttaataaattagagatagaaaccaacctgtgctcacacgcgaatgagactcacatcatggagaatcatgacagcccaacagacttaacagtatatatgtgacaccagttataaactttaatccatcactcgaagccacaatctttattgtcgaattgaactctgcacataaaatctccctgttgctactaactagcggagtagacactcaaccccaagcatttatacattccacataaatgtcgctaacgtctacataataactataaagaacgatgtttacaatataaaaaaacaaacacttctcctaataacgcaaaactctatatgtgaactgcacctccatcccaaaacacgaatcattacattcacatccctgtacattagcataacttatgacggccttccatagagaagaaatcatagatgtattaccttgtttctcctggtataaggagttaacttactcgggtaactgaagagcatgagattaggatacatataccgtagaggtataagcgccttgaacgcggaat

SEQ ID NO: 18357 - DNA, 880 bp, Diabrotica virgifera
  misc_feature (233)..(253): n is a, c, g, or t
  misc_feature (600)..(637): n is a, c, g, or t
  misc_feature (695)..(718): n is a, c, g, or t
  misc_feature (777)..(777): n is a, c, g, or t
tttttatacaaagcatcaataagagcaatgttttgaggttaggagctcaagaagtatcaccaacaacagaagcctaaaaagtgtacattggtttgaaaggttctgttgtaataactgaagtcctttttctggaattgttctattttctcaactatcggatcatttttgggataacttccaagggtgatagggaacgtttctagaaattataaaaaaacacttgggccaggaannnnnnnnnnnnnnnnnnnnncagtatccttttggattaatttaataggttttttccaactcaatacaaaaccgttcttgaatcgtcgcgcgcatgcgcaataacgaatagttatgcgcagtaacacatttttcgttactgcgcatactcgtaaccgttcaagaacggttttgtatcgagttggaacaaacctaatatttacttacctatttcgtaataggagaattcttttagaaacggtcttagctaacttttgtaaaatacaaacaaaatatcgcttgtgaaagggctcaggtgtctttctgtttctgaagttctttctcatttgcaatagtaaaatttactatttttaatgggaattaatcacnnnnnnnnnnnnnnnnnnnnnnnnnnnnnnnnnnnnnnacctgaacaacttaaaaaccacattttagctgtttgtatgtccaatcgagttagcgannnnnnnnnnnnnnnnnnnnnnnncttatgaatagtaagtaaataataaattgatgtgcattattttttagtttggtgacccnagtcgtttttttttttcgattatttcggggagcgttacctagcaaaattggaggatacactgaaattgatcttgaatacataccttttgacgtagtatcgtct

SEQ ID NO: 18358 - DNA, 74 bp, Diabrotica virgifera
  misc_feature (2)..(18): n is a, c, g, or t
  misc_feature (23)..(63): n is a, c, g, or t
gnnnnnnnnnnnnnnnnncgagnnnnnnnnnnnnnnnnnnnnnnnnnnnnnnnnnnnnnnnnnataaattatta

SEQ ID NO: 18359 - DNA, 71 bp, Diabrotica virgifera
  misc_feature (10)..(45): n is a, c, g, or t
  misc_feature (52)..(52): n is a, c, g, or t
  misc_feature (62)..(62): n is a, c, g, or t
atgaaagggnnnnnnnnnnnnnnnnnnnnnnnnnnnnnnnnnnnnagaattntatttttaangtaaaaagc

SEQ ID NO: 18360 - DNA, 65 bp, Diabrotica virgifera
  misc_feature (4)..(63): n is a, c, g, or t
gggnnnnnnnnnnnnnnnnnnnnnnnnnnnnnnnnnnnnnnnnnnnnnnnnnnnnnnnnnnnncc

SEQ ID NO: 18361 - DNA, 587 bp, Diabrotica virgifera
  misc_feature (277)..(293): n is a, c, g, or t
  misc_feature (295)..(512): n is a, c, g, or t
cggacgcgtgggcaaatagttacattttgattataagtattagttcattctgtattacgaatacactaatacttataatcaaatagttacattttgaaaaacgttatttaatctgagatttagaaaaccattatttgcttttcgctggaagaagatgaaacttctgattatcatgtctttcacaattatcaattattgttgatcgatacgcagtttacgagtgtaatatttatgtgagaattatatgttttgtagagaagtgttattcgtttttagnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatatgaataatttgatgttagtagaggatgataagaggaataattgagaagtgtgtattgaggaagaacata

SEQ ID NO: 18362 - DNA, 504 bp, Diabrotica virgifera
  misc_feature (2)..(496): n is a, c, g, or t
  misc_feature (498)..(498): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnggtgat

SEQ ID NO: 18363 - DNA, 347 bp, Diabrotica virgifera
  misc_feature (2)..(242): n is a, c, g, or t
  misc_feature (247)..(323): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtnnnnnnnnnnnnnnnnnnnnnnnnnnnnnnnnnnnnnnnnnnnnnnnnnnnnnnnnnnnnnnnnnnnnnnnnnnnnngaataattaccttagggataacag

SEQ ID NO: 18364 - DNA, 175 bp, Diabrotica virgifera
  misc_feature (3)..(75): n is a, c, g, or t
  misc_feature (80)..(151): n is a, c, g, or t
  misc_feature (155)..(174): n is a, c, g, or t
tannnnnnnnnnnnnnnnnnnnnnnnnnnnnnnnnnnnnnnnnnnnnnnnnnnnnnnnnnnnnnnnnnnnnnnnngggtnnnnnnnnnnnnnnnnnnnnnnnnnnnnnnnnnnnnnnnnnnnnnnnnnnnnnnnnnnnnnnnnnnnnnnnnatcnnnnnnnnnnnnnnnnnnnnt

SEQ ID NO: 18365 - DNA, 1017 bp, Diabrotica virgifera
  misc_feature (309)..(327): n is a, c, g, or t
  misc_feature (735)..(753): n is a, c, g, or t
  misc_feature (856)..(883): n is a, c, g, or t
cgaactatttttggtcccagaatgtgtgatttagtttgtgacctgtatttttgttacaccctgtatatgagatacaaatgaatcgcgatgattttttctaactagcgatttcggtatatgaatctgaatcctgacagatgtaaacatagactaaataaactacactcagagaaaaaaatgatgtgaaataaaattattcggaggtagataagtgaaaaaatacgaacgaacagtaggaaattaaaggccttggggaaatgtggataaggtctgaaatgacaggctgcgttctgttgataggtttgctcnnnnnnnnnnnnnnnnnnnaattcattattacatcagcaatttatccctttcttgagtttatggaacttatcagtttttctaaattaagcgtttcaaatcaaattttttaggaagtgtttttaaagggacgattattctttagtttttaaaatgcgttttatccaatgttgcctacttcttaaatgtatataacaataaaagcaataccattttggatgttacataggttgttaataaacagatgaaaaggtgtgtttgtctaagaacaggtatatatttgcaatgatatagagattactgtagttaaagaaactatgcaaaagattagaggtgatagtggatacagttgatagctaataaatcaataattctatacatttatcttcgattaaataattatgttattgtggttttcatggaaactannnnnnnnnnnnnnnnnnngacgaaggtagaataccttaaaacttctccatggctctgtcagaagatatgaagtgttcatttattaataagtttcctagttggaagggatttctaactttgnnnnnnnnnnnnnnnnnnnnnnnnnnnncttcttatttatctggagggttttttgaatccaccgctggtaccattattttttaacaaataaatggtaaaaacaaaaattttatgggaaaattttcttacggggggggctttcacaccaggaaatttgttttt

SEQ ID NO: 18366 - DNA, 221 bp, Diabrotica virgifera
  misc_feature (2)..(26): n is a, c, g, or t
gnnnnnnnnnnnnnnnnnnnnnnnnnggctaacggagcataatcctgaggttttttatggaaactggaaagaaggggcggatgaaagaaaaactgtccttcatttaattgattaagaatatttctctttaaaggtaaaaacggtttgaattttttgtacaaaacgaaaaagacgcctaaaaagtgtgtaaaaaaatttttaacaaacccccgtccaaactc

SEQ ID NO: 18367 - DNA, 118 bp, Diabrotica virgifera
caacaaataacaagttcgattatttatcaaacaaaataataactttgcccaggaaagggcgcaattctttattaaatgtataaattttacgaaaaagtaatattatatcgcaccttat

SEQ ID NO: 18368 - DNA, 684 bp, Diabrotica virgifera
  misc_feature (410)..(424): n is a, c, g, or t
  misc_feature (426)..(440): n is a, c, g, or t
  misc_feature (489)..(507): n is a, c, g, or t
acaagcatacgctaacatctaatgatgagcgataaccctgataattataatggccgtatcccatttcccaaagataattcacaggataaaattttaacaacaatcttcgttctagtggggttggtagtagccacacaagtgttttatatattttttatcacccacacagctaaagcttttagaaaggaagtcattagaagaggacgactaatatcagttttaccaataatttcgacaattggtgcaacgatgcccgttcatgtaaacgtccaacaaactgtaaatgttccaaatgctccacaacaaaatacttacccaccgaatgcgtatacagctcctgatggctccagaatgttcgatgataaagtagcaccaccagcatacgtaccgtaacaaaaataaattgaggnnnnnnnnnnnnnnngnnnnnnnnnnnnnnncgtttatcctaaactatttatcaatatgatttcttacaatttttagagnnnnnnnnnnnnnnnnnnncttttttattacttcatgcaaacatctttttcggcaaatattaccaccaatgctaattataagcttattcaattgaaacatatctttggtcagattagccttgagaacaattgtaatcactcaactgacgttctgagatgttagttatgtttgtattacatgtcacactatcatttg

SEQ ID NO: 18369 - DNA, 828 bp, Diabrotica virgifera
  misc_feature (103)..(122): n is a, c, g, or t
  misc_feature (317)..(334): n is a, c, g, or t
gaataattgttgatttgaagaaggtaaaccagccgcaaataaccatttagtttaataaaccaaaaataaaaacataactcatagaaggtagtgtgacacaacnnnnnnnnnnnnnnnnnnnnggtggaaggttgctatgcggtttagaagagattcgatttaatttaaatttgtaatatatttaaaaaagcaggaagtcactgggtatgcgtaataaatattcaaatttaaataaaccagatactatgttttattagttagtgacagtgaatgcaagattatgattacaattaacttacattattaggaatgtatgnnnnnnnnnnnnnnnnnnctacaggtctccacatagtttgaaatgaatgctctacatattattgtttcgttttatacactatttattacctacagaactgtagaggctgtatataatgtaggagttggtagagcggactgtactggacctatagcagatgtaacattgatgggatacggagacccatttcaactaggctgtggtcttcatttaagacaattcgcaagagcatttatttttgatgattctgtatcgagggtactattcgttactgtagatgcaggtatggttaaccacccaggaaaacaagcgtgcatcgaaaaattagatgttatatatccagggggcatttacacttgtaaacacactctaattagtgccactcatacacacagtgctgcaggtgatcaatttaaagatatattattagatatatcagcatttggatgtgtataggagtcttttactgcaatagttgctgcgatagttcgagcagttcaaagtgctcatga

SEQ ID NO: 18370 - DNA, 71 bp, Diabrotica virgifera
  misc_feature (7)..(70): n is a, c, g, or t
ggggggnnnnnnnnnnnnnnnnnnnnnnnnnnnnnnnnnnnnnnnnnnnnnnnnnnnnnnnnnnnnnnnnt

SEQ ID NO: 18371 - DNA, 709 bp, Diabrotica virgifera
cacaagtataatacatggtgaaagagagcgttttattgatcctcttatctttagaatgaaaactccatcatcgaatatgtacctgaatcccttactatagaatcctattaccatgctatattaagaacattggttgttcacgctgctgtcgcaccagttgaaaaaatttcgtttggatacattgcagatcgactatgacacaacataccttgatatatcaacccgctccattgaaagattggattgtacaatatcgatgaccttatgcagtttctattatatgatcagactttaatatatatcaacattacattacatattgtatatgttgtatattgaactatggccgagttcatatttccctcgactcgaataacccatatcatattactgtcgaagtattatacctggttcgatacatgatagattatacctatctatatgtgaccgaaacccgagtgaaaacaattatagagatatgatctactttactcacacagattatttatatatgaatacaaagcatgtaaatcttttttttatgaaatttcattcattcatattagacacttactgtatgctgattttatatttctacttatttccctgtcctatttttctcccgatctgaacatactactaaatactgacaccactagagaacatgatgataacataagataatctagatgatttgagcattatcaaa

SEQ ID NO: 18372 - DNA, 886 bp, Diabrotica virgifera
  misc_feature (787)..(787): n is a, c, g, or t
  misc_feature (842)..(842): n is a, c, g, or t
  misc_feature (869)..(869): n is a, c, g, or t
agaaagtcaagcttacatggatctattagcatttgaaagaaagctggactctactttatgagaaaaagattggacatccaagaagctcttaagcgtccgatgaagcaaaaaaggaagttgagaatatttatttccaataccttctatcctgccaaggaacctcagcctgaaggacccgatggaccatgtcaggaaggcactgttgcatcttgggaattaagagtagaaggtcgtcttttagaagatccaaagaacgatccaaataaagttaaacgcaagttttcttctttctttaaatctctggttatcgaattggataaggagctgtatggaccggacaatcatttagttgaatggcacagaaccctaaccacccaagaaacagatggttttcaggtaaaacgccctggtgacaagaatgtgagatgtactattttgttgcttcttgattatcaacctctgcagtttaagcttgatcctagactagctagacttttgggagttcacactcaaactagaccggtcattatttcagctttgtggcagtacataaaaactcatcgcttgcaagatgcccatgaacgcgagtttatcgtttgtgacaagtatttggaacaaattttcaactgtacccgtatgaaatttgccgagattcctcagcgtctgaatccactattgcatcctccagatccaatcgtcatcaatcacgtgatctccgtagaaggaggggccgagagcaaacaaactgcttgttatgatattgatgtagaggttgatgatacattanaaacccagatgaacaattttctattgagtacagctagccagcaagagattcaggnacttgatgctaaagattcacgaaccgntgataccattaatcagc

SEQ ID NO: 18373 - DNA, 133 bp, Diabrotica virgifera
  misc_feature (5)..(89): n is a, c, g, or t
  misc_feature (92)..(128): n is a, c, g, or t
ggggnnnnnnnnnnnnnnnnnnnnnnnnnnnnnnnnnnnnnnnnnnnnnnnnnnnnnnnnnnnnnnnnnnnnnnnnnnnnnnnnnnnnnacnnnnnnnnnnnnnnnnnnnnnnnnnnnnnnnnnnnnngtatc

SEQ ID NO: 18374 - DNA, 314 bp, Diabrotica virgifera
ccctccgcgtccgctgagaaccaagaaatccacgcattctcccttaattaactgattatgagagtgttttagacgtaagatatgacgaagggcatacgtgcttatgacattctgagcaatgtctatagactatgtgaggatgataggtaatgggtctcataccggagatccatacttgtatggactttagagacaccattaaaaaaggcctgatagtgtgaaatcattgtgtggaatacatttcttaaggaacggatacgcggtatgatttttagaattgcaattattgtatgaacacatgtgtgtctattctt

SEQ ID NO: 18375 - DNA, 155 bp, Diabrotica virgifera
  misc_feature (20)..(33): n is a, c, g, or t
  misc_feature (36)..(58): n is a, c, g, or t
  misc_feature (66)..(88): n is a, c, g, or t
  misc_feature (118)..(149): n is a, c, g, or t
tgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 18376 - DNA, 612 bp, Diabrotica virgifera
  misc_feature (38)..(50): n is a, c, g, or t
  misc_feature (53)..(69): n is a, c, g, or t
  misc_feature (394)..(420): n is a, c, g, or t
gctctcttcgcgcccgggagagttcacgataatggggnnnnnnnnnnnnnaannnnnnnnnnnnnnnnngttatagaatggcaagagccacagctggagaaattgttatttatacaacatactcctttggtttttggacttcgcgtgttagggattgtaattttggaaacatatatttttgattttcgacttcgtcagatgtgagcaattaagacattgattgtctgattagaattgtagcttagattctctggtccgagacgccattagttcatctatttatgtcacacgtcaagttgtgaggtcacattgaattagtgagaatatatttagaattgaatagtgcttatattataaatatgaaatatttgtaggtcgggacttgagattatcnnnnnnnnnnnnnnnnnnnnnnnnnnnaccgcattaagatgaaagatgttcatattcgaagataggcacagtgtagattttcatattctacgacccatagtggatattaatgctacatgacaacatatatttaaaccatagaaatgtcgcggtgatgatcgtcagtaggatgccgaacttgtagatttgtgtatgtactcataggttgattcagggaat

SEQ ID NO: 18377 - DNA, 673 bp, Diabrotica virgifera
  misc_feature (294)..(315): n is a, c, g, or t
cccccttatactttattttagactttatttttggaatgtgagcaactacgttaagaacttcattacgaattttattacgaacagacctgatgctttaaccggaactgtccttgttaatgacgaaattgatacagctcttgctactattcttgcttttattataattattcctataataattcctattataagttgatggacttgtaccctgactagttcccgttcccgatgtagctccccctctaatattccctctaatattttgtatgctacccccgtcgcttcccccatcannnnnnnnnnnnnnnnnnnnnnggatagttgaaaccggatgagcagccgacccgcctctgtacccgcctctggcctctgatattgcccctggagatccatctatatatatatctcttttaacagtactttcatctgttatatctgcaattatatttgttactacttttattactacacgacctataatactacccttagatctaatccccctacttgtacccctagtcgtatgtactgccatccttcctctattacctctactattatcattaccagctataactgtatcaataacagaactattatcagatccatctttatatgcatcatttgttgatccagatgcagttctctatccacatctctatcgacatttatt

SEQ ID NO: 18378 - DNA, 781 bp, Diabrotica virgifera
  misc_feature (495)..(520): n is a, c, g, or t
  misc_feature (579)..(623): n is a, c, g, or t
ctcttgaaaaccagctcaaggaagctaggttcctggctgaagaagccgataagaaatacgatgaggtcgctcgtaaattggccatggttgaggctgatttggagagggcagaagagcgcgccgaatccggtgaatcgaagatcgtcgagcttgaagaggaactgcgtgtcgtcggcaacaacttgaaatcccttgaagtgtctgaagaaaaggccaacaagcgtgaagaggagtacaagaaccaaattaagaacttgaataaccgtctcaaggaggctgaagtaagagctgaattcgctgaacgtgctgttcagaaactccagaaggaagttgacaggcttgaagacgagctcgtacaagagaaggagaagtacaaatacatctgcgacgacctcgaccaaaccttcaccgagctggttggttgaacgaccactcgccgccatgctctctaattttgcgtctatattgtctactattaaattttaacacctttcnnnnnnnnnnnnnnnnnnnnnnnnnnaacctccgcttgttccgaccaactacagtattatacctaaccgcgtgagcgttgctacnnnnnnnnnnnnnnnnnnnnnnnnnnnnnnnnnnnnnnnnnnnnnaccaatcaatttaccaccgcttcttgataaagatgaattaagaggtttattgaaacccctgactttattggctgtatatattttgttatatacagaatatataaaatcaagttgactattcgatgtacctttacataaggctggaaatatactcactt

SEQ ID NO: 18379 - DNA, 831 bp, Diabrotica virgifera
gctaaacgactacgacctgccgctgaaaggattctcaacagtcgaattatacgttcaaggtttgattattgtaataattaaacgtattatatataggaagtgtgagtcgtttagtgcattttggacgtgaaaatgaatccagagaaaagaaaggcgttaatgctatcgcatttcggaaaaaccaataaggacttggaagaagatgttaagttgattaaagagtggttgaagactcaacctcatctacccgaaattccaagcgatcacatgattgcttcttttatatggattaataaatttagtttggaaaaaacgaagcaaagaattgatttgtactacacaaatagatcaactatgccgtatgtattccaatttgcaaatccaaaaagtcaatttatgaaaacatctgctgaatcaagccattttttcgtattacctaagctggtagacgatagttatcgcgtaacggttaagaaaataaaagattgtattcccaatgactttgatgtaaatggatggcttgcagaagtcctaaatagcattgagataacacttagagaagacgataatttagttttgggcaccattttactgtgtgaccagcaatatttcaaaatggaccatttattgagatttactccaaccgtcataagagacagtatattaattatagagaaactattaaacagcagaataaagcagtttcacttttttaactgcccgtcatatgtagacctgttattcaaactatgtaaacaatttcttaaaccaaaattatatgaaaggattcggatacacaaatctacggacacattgttggactatattccg

SEQ ID NO: 18380 - DNA, 132 bp, Diabrotica virgifera
  misc_feature (64)..(77): n is a, c, g, or t
  misc_feature (80)..(102): n is a, c, g, or t
  misc_feature (115)..(115): n is a, c, g, or t
taacagcgtaattttattgggagagtcaaatcgataataaagattgcgacctcgatgttggatnnnnnnnnnnnnnnggnnnnnnnnnnnnnnnnnnnnnnntggtcgacttttnaaatttacatgatctga

SEQ ID NO: 18381 - DNA, 185 bp, Diabrotica virgifera
  misc_feature (6)..(113): n is a, c, g, or t
  misc_feature (124)..(174): n is a, c, g, or t
gttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgattaccnnnnnnnnnnnnnnnnnnnnnnnnnnnnnnnnnnnnnnnnnnnnnnnnnnncaattttttga

SEQ ID NO: 18382 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18383 - DNA, 171 bp, Diabrotica virgifera
  misc_feature (12)..(45): n is a, c, g, or t
  misc_feature (47)..(82): n is a, c, g, or t
  misc_feature (87)..(169): n is a, c, g, or t
agaccctataannnnnnnnnnnnnnnnnnnnnnnnnnnnnnnnnngnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnat

SEQ ID NO: 18384 - DNA, 530 bp, Diabrotica virgifera
aacgcatccttatcatttgatccacctgaccccgtgtgcattgtcacttatagtgaaaaaggtactatccatatgacttatgcttaaatgatatagtctatccatgattgatatgctgaaaaatgtataattacttgcattgattactacatagcaacgatgacgacgtaccagctctggaggaaatgttatctgggtcctcctagtttgaaatccattcactacagacgaggacctatacctttaaacatgattccagatcaatgatactgtatatcatcctgtggctcctcattccatattgcctgatttacaactatttgaatatcgagtactacggcctcctggagatagacaagtctagaaatgattactaatcactgtacagataacattagaatcatgtatacttctctatgtaactgtccgataggagccatgcataagctattccagaataatatgtcatcgagagcatacaagtcgatattgtacagccactacaatcattactatttgctattacacat

SEQ ID NO: 18385 - DNA, 806 bp, Diabrotica virgifera
  misc_feature (9)..(802): n is a, c, g, or t
aatttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaga

SEQ ID NO: 18386 - DNA, 819 bp, Diabrotica virgifera
cggacgcgtggggcttaaatatgatagaataaagaaatgtgccttctataacaagatttgtatttgagaagttgtgactgataattttaagttaaaaactatctgtgtatatgtaaatcttttagctatattaaaagccacagttagaatgcagtgcaggtagcataaagcaatgtatttcttacagaagaacggccgaccacgttgccggtttgccccgagcggcacatcaggaccagtcgaccagtgatttctcagtccgcacataagcggcatcgctgcgcgtcgtaagaccaacactgcattctaactgtggcttctactttaggtgtaaggaagtatttcaaatttattgaatcgcaaagcattgtcggttagtaggcccatggcttgcttagttggtccctttaatcagttgcttttcttcccagttcttaacgttgagtcttctcatatcggattcaacttcgttgctccatcttcaattctgtctccctcttcgccttttgccttgcaatgcgccagatagtattattctgagaattctagataaaaccattctctgaacatgtcctaaccatctaagcctttgcgccttaattacctactgctaatatgttaggtttttgatagagctcagttagctcgttagctcatggattcaaagaatgtcaaacgtggaagtaactaaaaggataggaaatgaagagcaaacaatatcaatagacgaaaacttgagtacttaggacatatgatgagagaacaaaatacccactattgcagcttatttatgtagacaaaatttcgagaaaagtcaat

SEQ ID NO: 18387 - DNA, 816 bp, Diabrotica virgifera
  misc_feature (139)..(158): n is a, c, g, or t
  misc_feature (164)..(184): n is a, c, g, or t
  misc_feature (233)..(302): n is a, c, g, or t
gaacggtgaaacttgaattgaacagaaataccatctgtatatatttattttgataaaaaaaggatttcattattggcagtataaataaagataataaattactctcggtaattaggaaattgactattatgatatatannnnnnnnnnnnnnnnnnnncgcatnnnnnnnnnnnnnnnnnnnnncataatttatttgcataaaaatacttgaaagtatcaatcttgacatgannnnnnnnnnnnnnnnnnnnnnnnnnnnnnnnnnnnnnnnnnnnnnnnnnnnnnnnnnnnnnnnnnnnnncgtatttagagaaaatgttcttcatgtagacagaagtatttcacaggactgacaggaccccatgagatactcgcattgcattgttatattgaccatcattcacttgcagaaggacaccttcgtgtttttaccatttgtttttaggtcactattttgtacgattgttccagtattatttttcatactttccattccattatatagtatgctctttgataatagttcttaagaatattcatttgtgattgtggtcttgctttaactggtcctcgtaaaaccacatatatagttactgtagtactaaatgtcacttttgtccttcttttcaattgagcttcagtccaaattaaagtattgtcttctgtaatttctgcctccaacattggcgattctgtgcagctctccccgagtttgtgacatcaatcaagatgtttgctgccacttcattttaccgtcctcaccgtgatctttcttttgggcttctgtcctgattttactatctaggactcttgtt

SEQ ID NO: 18388 - DNA, 837 bp, Diabrotica virgifera
cggacgcgtgggtttaacgtgtcttggtttgtttatttctactgcatcttgattgtaaatttagtataataaagtatatatacgactcaaaacattttctatattattgttatccagagttatattcccagttatatctagagattcgttggttagatatttagtttttgttattagcgtaacatcatcggcaaatctcagatggtttaggttttcgccgtctatcgtcacttgcttatttgttcattccaaagttagaaacatatcatataacaaaaaaatcatattaaagcccttttccccttgtttgtcctaaagaaccagcctcccggggttgctagatttttacctgttcttttgatattgaagtttattgttattgtgaggaacctctaaaaagtagtacaacggctgccaagatacctttttatttggtgcccgtatgtgttgagtctcccattggttaaaataaataatcacgtgtatcaggccatgcaatatctcatctcagtaaccgaaaatgtcaactagttagggttcttcttcttcttatgcaatccactaatggatgttcgcgatcacgtttgaccatttttctctatcccttgcagtatgtattaggtctcctatgttttttagtcctgtccattgttcgacattacggagccatgacattttcttcctgcccactccccttcttccttcgatctttccttcaattaaggtttgcagaaactgatatctttcatttctaattatgtgtcccaggtatgccgtttttctctgtttaattgtgcacatcagttgtcgttctgtaccaattcttctcaggatttc

SEQ ID NO: 18389 - DNA, 569 bp, Diabrotica virgifera
  misc_feature (2)..(27): n is a, c, g, or t
  misc_feature (37)..(63): n is a, c, g, or t
  misc_feature (68)..(186): n is a, c, g, or t
  misc_feature (194)..(232): n is a, c, g, or t
  misc_feature (263)..(391): n is a, c, g, or t
  misc_feature (394)..(424): n is a, c, g, or t
  misc_feature (457)..(469): n is a, c, g, or t
  misc_feature (471)..(494): n is a, c, g, or t
  misc_feature (530)..(549): n is a, c, g, or t
gnnnnnnnnnnnnnnnnnnnnnnnnnnataaagatgnnnnnnnnnnnnnnnnnnnnnnnnnnnaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaagnnnnnnnnnnnnnnnnnnnnnnnnnnnnnnnnnnnnnnnaaatgttcatattgtaaaatatgtgattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnnnnnnnnnnnnnatgtgtattaacaacatgtctttatgtattatnnnnnnnnnnnnntnnnnnnnnnnnnnnnnnnnnnnnnacgtggtattttgaccgtgtgaagaaagcataatcnnnnnnnnnnnnnnnnnnnnatgcaatgaagggtggcatg

SEQ ID NO: 18390 - DNA, 893 bp, Diabrotica virgifera
  misc_feature (44)..(81): n is a, c, g, or t
  misc_feature (770)..(770): n is a, c, g, or t
  misc_feature (844)..(845): n is a, c, g, or t
  misc_feature (879)..(891): n is a, c, g, or t
acgaaatgtcaattttgttataaccttaaatgtaaactaaatannnnnnnnnnnnnnnnnnnnnnnnnnnnnnnnnnnnnncaatggcagatactctaccctctgccattgaacaggaattgttaggtattaaaaatcttctctggggcaacgaaattaaactagacatttttaaaagatggtcacaaggcttttactttagcaagaatgaacaaagtgctttagaacaaacagagggagggccttgtgcaataatagctcctgttcaggcatttatactcaaaaaccttttattagactacaaagatctttcatttcgagaaaaggttaatttagagctccaaaatcacagtttggtatcagctctctgtgaaatattgagacaatgtaatatccggaagtattatgtagtatatttaaacagtgaatttagtgcagcagtcaaccaagcagaactaaaatgtgaagcagagtcaagtaaagctgtagaaaatttagaaatagatcctgctaggtttcatgatggcctcaaagtacatagttatcagtgcctagatgaagttaaaaactattattgtgagaacatcacaaaattaagagcacagtatggcattttattgtttttatattctgtaatagcttcaaagggtttagaaatagtaaaatctgagtcagatactcaggatcctttgatagatgagacgtatggctatggtagccaaagccttataaatttaatgataactggtagggcaactacttacgtttgngatcaccatgaagatgttggaggtttgaaactattaggaattgaaagacaaagtcaaataggttttataactgnntatgaataccaccagtattgtacaagttgggtcnnnnnnnnnnnnncc

SEQ ID NO: 18391 - DNA, 628 bp, Diabrotica virgifera
  misc_feature (300)..(317): n is a, c, g, or t
  misc_feature (580)..(598): n is a, c, g, or t
tttacgataaaatttgaaactcaagtaaattattgattaataaaaaggacgacaggcaaaaacaataatagaataatatattatcaatgtgaacaagagtcttcttttcttctttacgtgccatctccgctaccaaggttagcaatcatcattgctattctaacttttgacactacagcccgaaaaaattcaattgagctgcatccaaaccattctctgagatttttcacacaagagttctctgagctgaacaagagtgtaatgtcgcaaattgcgataaagagttaagagctggtctcnnnnnnnnnnnnnnnnnnagctgacagcctcttttcgatgtagccagtctacaaactgtcataaaaacgacatattttttctttgtttataagaatattatgataaaagtccgacgcattttgacagcatgtgggaaacctacaacacaaaaaatcctacctcacactattaacagctcaaataaattaattctttcattaaaataagaagaaaattgtaaatagtgggagggtactaaacttatacaattttgtggaagatatttcctctttattttatnnnnnnnnnnnnnnnnnnngattggattagagatttaatgctagttatg

SEQ ID NO: 18392 - DNA, 722 bp, Diabrotica virgifera
  misc_feature (9)..(62): n is a, c, g, or t
  misc_feature (69)..(148): n is a, c, g, or t
  misc_feature (159)..(269): n is a, c, g, or t
  misc_feature (305)..(379): n is a, c, g, or t
  misc_feature (396)..(424): n is a, c, g, or t
  misc_feature (442)..(483): n is a, c, g, or t
  misc_feature (485)..(513): n is a, c, g, or t
  misc_feature (517)..(535): n is a, c, g, or t
  misc_feature (546)..(567): n is a, c, g, or t
  misc_feature (569)..(600): n is a, c, g, or t
  misc_feature (664)..(700): n is a, c, g, or t
aatttgacnnnnnnnnnnnnnnnnnnnnnnnnnnnnnnnnnnnnnnnnnnnnnnnnnnnnnngagaacnnnnnnnnnnnnnnnnnnnnnnnnnnnnnnnnnnnnnnnnnnnnnnnnnnnnnnnnnnnnnnnnnnnnnnnnnnnnnnnncgtgtatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattcgttctcacctatatctaattttttaacagnnnnnnnnnnnnnnnnnnnnnnnnnnnnnnnnnnnnnnnnnnnnnnnnnnnnnnnnnnnnnnnnnnnnnnnnnnncatgagcttaataatgnnnnnnnnnnnnnnnnnnnnnnnnnnnnngaaattatcgattaacannnnnnnnnnnnnnnnnnnnnnnnnnnnnnnnnnnnnnnnnncnnnnnnnnnnnnnnnnnnnnnnnnnnnnncagnnnnnnnnnnnnnnnnnnncaaatttatcnnnnnnnnnnnnnnnnnnnnnncnnnnnnnnnnnnnnnnnnnnnnnnnnnnnnnncactatcggaatgcgtgaacatttttctcacctgtttattaaaagcatgtcgttttgtattatnnnnnnnnnnnnnnnnnnnnnnnnnnnnnnnnnnnnnttcgcggtatcttgaccgtgct

SEQ ID NO: 18393 - DNA, 852 bp, Diabrotica virgifera
  misc_feature (430)..(447): n is a, c, g, or t
caatataacgcattaagaggggcggttatgtgtcataattaacggtttggcgaattagttcttcgtttggatggatatgtgatagttgtttatttgttgtgttgaagttcattagaggatattccaaaatataataacaaaatgttgtcggcaggtatatgtcgatggctgtttcttctggtatctcttgcaacatgggtgtcattaacgagttcccaggagatgcgcgttgtttgttattataccaactggtcaatatatagaccgggagacgctaagtttagtccgcaaaatataaacccctatctatgcacacatcttatatacgcatttggaggatttaccaaagaaaatacgctcaaaccctttgataaatatcaagatatagaaaaaggtggttatgcaaaattcactggattaaaaacttacnnnnnnnnnnnnnnnnnnatgctagcaattggtggctggaacgagggatccactagattttctcccatggtggcaaatgccacaagacggaaagaattcgctagaaatgccattaagtttttaagactgaaccatttcgatggactggatctagattgggaatatccgtctttcagggatggtggaaaacctagggataagaccaactatccacttcttgtacaggatctcagagaagaattcgatagagaagcagaaaaaacaggaaggccaaaattgttattaacgatggctgtgcctgcgggtctagaatatattaacaaaggattcaatgtgccagaattaaatagatacttagactggatgaatattttaagttacgattatcactccgcgtttgagcctgctgtaaatcatcatgcg

SEQ ID NO: 18394 - DNA, 61 bp, Diabrotica virgifera
ctttttttttcgattttgtaggtgtatttttgtatattacattttaataaattacaactac

SEQ ID NO: 18395 - DNA, 563 bp, Diabrotica virgifera
  misc_feature (10)..(10): n is a, c, g, or t
  misc_feature (15)..(15): n is a, c, g, or t
  misc_feature (22)..(22): n is a, c, g, or t
tcttacgcgnccggncggaacnagcgcaaacactaaccaacattttcccgaaagatactaaaaaactaagagcccagccgagaacatcccagagatcctggtacattgccgaaatttttattgcatacacgacccctgtcacactttgaggtataactgccgctaaaataattttcgttgggtctgaggcacataaactgaaatcaataagggagaccactgcatcagaccatatcattattgaccatcaagccgagatcctgctttttgatgatgaaatattattaccacacgctgctgagcatttttctcccttatattattagcacacgatcagactatattcactctcagaatagccgttacatcagcgttcgtcaagcttcttgtgttccgctcccctgcacaggttgatgtatctcccggaccccatatgtagcgctataaagccaccagtaacctacttaagaaataactatgctgaaaaagtgattcttacctcgttaggcacatactctgttattataccagcgcatacagcaactagctctgaagctgaccca

SEQ ID NO: 18396 - DNA, 219 bp, Diabrotica virgifera
  misc_feature (30)..(51): n is a, c, g, or t
  misc_feature (96)..(127): n is a, c, g, or t
  misc_feature (138)..(160): n is a, c, g, or t
gaattttgagggatgaggttaaagatatgnnnnnnnnnnnnnnnnnnnnnnaaatagagtttatgattaaaagttgtaatatttaaagagatgagnnnnnnnnnnnnnnnnnnnnnnnnnnnnnnnngttgtataagnnnnnnnnnnnnnnnnnnnnnnngtattatttagaagttagtatttgttgttaagttttagaatttgatgaatggtaatata

SEQ ID NO: 18397 - DNA, 76 bp, Diabrotica virgifera
  misc_feature (3)..(24): n is a, c, g, or t
  misc_feature (29)..(69): n is a, c, g, or t
ttnnnnnnnnnnnnnnnnnnnnnngtaannnnnnnnnnnnnnnnnnnnnnnnnnnnnnnnnnnnnnnnngtttata

SEQ ID NO: 18398 - DNA, 258 bp, Diabrotica virgifera
  misc_feature (11)..(169): n is a, c, g, or t
  misc_feature (171)..(257): n is a, c, g, or t
gatgaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 18399 - DNA, 307 bp, Diabrotica virgifera
  misc_feature (2)..(89): n is a, c, g, or t
  misc_feature (91)..(166): n is a, c, g, or t
  misc_feature (168)..(237): n is a, c, g, or t
  misc_feature (242)..(306): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnc

SEQ ID NO: 18400 - DNA, 844 bp, Diabrotica virgifera
  misc_feature (832)..(832): n is a, c, g, or t
ccttacgcgtccggccaattaaccttttgtgtggtgtcctacaaaaagaaaattatgcatatgcatggcaagtgccatatcacagtataggaggaattctcctatactgtggccatatttacttacagtacagtagtgatcagtgctgccgtagtgatagtgattcatgagagatctgaatatctactaagatggaaatatattcatacataaaaatgttgtaatgtagcaaatacatatttaccagttgattatactatactgtttatatacttattataaaagcagaaagaagacaatatggcacagtctggcccaaaggatgataggaatttattatccaacacagtaaaaactgaaagtcttaatgatgatgtttctactcctgacaacaatttcagtgggaaagccatagactttcaattttctatccagccaaaagttgaacaatgtgaaataaaagatgaagttgaggaattagaatttgtgggagaagttatcgagttttctgaaaatgaactgtctgatttagaagaaagtcaagaacctgaatcaaaggaatcatatttgtgtgaacaatgtaatgtggaatcttgttacaaaaaacatgacttgcacgcagattttatccgtattacaaccaaaccattaaatcaatcaaatccatatgaatgtgctatatgtagcataaagattcttaatcctacgatagccttatttcatttgtccctgcatgacaaagatagtttcaggtgctataaatgcgattgcattctgctagaattttctgattttttggagcatatcgagaaacttcattctaaagacaggnattattatcgat

SEQ ID NO: 18401 - DNA, 68 bp, Diabrotica virgifera
  misc_feature (19)..(20): n is a, c, g, or t
taacagcgtaatttattgnnagagtcaatcgataataagattgcgaccctcgatgtggattaaagtta

SEQ ID NO: 18402 - DNA, 744 bp, Diabrotica virgifera
  misc_feature (2)..(498): n is a, c, g, or t
  misc_feature (510)..(655): n is a, c, g, or t
  misc_feature (664)..(701): n is a, c, g, or t
  misc_feature (703)..(738): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgcggtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccctannnnnnnnnnnnnnnnnnnnnnnnnnnnnnnnnnnnnngnnnnnnnnnnnnnnnnnnnnnnnnnnnnnnnnnnnngggggg

SEQ ID NO: 18403 - DNA, 904 bp, Diabrotica virgifera
  misc_feature (35)..(53): n is a, c, g, or t
  misc_feature (55)..(67): n is a, c, g, or t
  misc_feature (95)..(115): n is a, c, g, or t
  misc_feature (196)..(213): n is a, c, g, or t
  misc_feature (749)..(765): n is a, c, g, or t
  misc_feature (777)..(777): n is a, c, g, or t
aactcctttaaatgtcaaagtagtgaacaaaatcnnnnnnnnnnnnnnnnnnngnnnnnnnnnnnnnctgtgatgttaaaccatagtcaaatagnnnnnnnnnnnnnnnnnnnnngatggaaagtgaagacgaatttctacatatttattttactcatgtatctcagttgtgttatgaaaaggccaaagaacatannnnnnnnnnnnnnnnnnctaaaggatgtacaacaccgtggggtgtctttttaaattatttacaacaattaactttaacagagaagagctatatggaaataggatttttacaaaataaacataaagccttttttagaaaagataattccttaaggtctgtttatgaaaccatgaaaaatgatcttaaaaagttagaagacaatactaaacaatctgcaggtgatataagagttcaaaaaggaagtaaaaatattgtacagtttttgaatgccagaataaatttgattgatttatatgaaaaaatatacaacatgggcgtaaataaacaaattcgatataacgaaattttgacgcatatagaatcagttatagagaaaaatagtgaaggatttacggatataggtttgacccctgttaaagcagtctttagtttggagtgtgagattttagagcagttattcaaggctttgacacaattacaaacattggagtttttaccgccattagcattaattcatggggcacatactcgattagcagcttgggaaagcaannnnnnnnnnnnnnnnnttggaaacttgngatattcaaaaatagtccttttccagcgttatttcaatggctccaaaagttgaaaagagccgtttttagcaaatttagtttatattttcatgatatactggcctcacagacgacgccacatgacatg

SEQ ID NO: 18404 - DNA, 63 bp, Diabrotica virgifera
  misc_feature (3)..(60): n is a, c, g, or t
gtnnnnnnnnnnnnnnnnnnnnnnnnnnnnnnnnnnnnnnnnnnnnnnnnnnnnnnnnnntag

SEQ ID NO: 18405 - DNA, 426 bp, Diabrotica virgifera
  misc_feature (402)..(420): n is a, c, g, or t
atcagcaatgcgatgtattctaaaacctcctgacaaacattattgtatattggttaaggactaatatagtaaatcagtgagaaaagaaatgatgttgataattctttatcttttccttcgtagcatgtgaatcaggtgttattatctaagaaatatatatctatgatttcgcctattacatcatcattaaataggatcatggttaccgtttaaaaagaaatttgaatagttatttaagttatcaagagatattcgttttaaaaaatctctcatttcttcataaaagaaaatataggcatttataaacaaaatattgactatttctaaatttttcaataattaatagccaaaatttataacggctgaccgtagcatgcaaaactaatctaaaataaccgtttnnnnnnnnnnnnnnnnnnngactca

SEQ ID NO: 18406 - DNA, 386 bp, Diabrotica virgifera
  misc_feature (64)..(82): n is a, c, g, or t
  misc_feature (90)..(112): n is a, c, g, or t
  misc_feature (142)..(173): n is a, c, g, or t
  misc_feature (180)..(306): n is a, c, g, or t
cgatgttggattaaagtttatagctgctacaccaattataaactttaatccaacatcgaggtcnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttaaaggaaccaagtttaacgaccgggggatgggaaggtaaaatttttttaaaggggcccccaaatttaatttccgg

SEQ ID NO: 18407 - DNA, 823 bp, Diabrotica virgifera
  misc_feature (2)..(582): n is a, c, g, or t
  misc_feature (589)..(626): n is a, c, g, or t
  misc_feature (646)..(659): n is a, c, g, or t
  misc_feature (662)..(684): n is a, c, g, or t
  misc_feature (692)..(714): n is a, c, g, or t
  misc_feature (750)..(774): n is a, c, g, or t
  misc_feature (780)..(811): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatcnnnnnnnnnnnnnnnnnnnnnnnnncaaagnnnnnnnnnnnnnnnnnnnnnnnnnnnnnnnntaaatatttacc

SEQ ID NO: 18408 - DNA, 812 bp, Diabrotica virgifera
  misc_feature (695)..(695): n is a, c, g, or t
  misc_feature (709)..(726): n is a, c, g, or t
ctaaagaccccgcaaaatcatcccatgatagtgaagatgctagaaagaattttacctatttgatggctggaggacttggcgttggtgcagcctatggtgccaaatcagtggtctcacaatttattagttctatgagtgcatctgctgatgtattggctttagctaagattgaaattaagctttctgatatccctgaaggcaagtctgttacctttaaatggagaggtaaacccctattcatccgccacagatccgcatccgaaatccaagcagaacaatccgttgcagttagttcccttcgtgacccccaacacgataacgaccgtgtccaaaacccatcgttcttgattgtaattggtgtatgcacccacttaggttgtgtcccaattgccaatgcaggagactttggaggttattactgtccatgccacggatcccattacgacgcctggtcgcatccgtaaaggacctgctcctttgaacttggaagtaccaccttacaacttccccagtgaagatctattagttgttggttaaacgattttttaattaatagttgaattttacttgagtgacgtattatgaaactggaagaagaagaatttttggcaagtttttgttaatttctgtttaaaacatttgtcaaaattttgagtgatagcgcgaacagttttacaatactcattctttgttgngttcagcttaagtnnnnnnnnnnnnnnnnnngtcgataaaagattccacaatgtaattgcaggtatgtacatatatcttttaaatcaaatatttggttaatgtacccttacagtgac

SEQ ID NO: 18409 - DNA, 277 bp, Diabrotica virgifera
  misc_feature (2)..(234): n is a, c, g, or t
  misc_feature (237)..(273): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnngggg

SEQ ID NO: 18410 - DNA, 342 bp, Diabrotica virgifera
  misc_feature (126)..(156): n is a, c, g, or t
  misc_feature (172)..(198): n is a, c, g, or t
  misc_feature (322)..(339): n is a, c, g, or t
tattttccaagcacacagaatcaataaagaaacatttctattggaacagaaatatttcaaacatttcatttagcagcgcaaggatattctgatctataactataactactcttttaagaacttccnnnnnnnnnnnnnnnnnnnnnnnnnnnnnnngacatcatcatcatannnnnnnnnnnnnnnnnnnnnnnnnnngggcttataaattgaattgcctgccgattccatttttccgtattaattatgatcagtgtgttctcctagctacaaacgtgctagtacttatatttatatattaacaccttaattgttaataacnnnnnnnnnnnnnnnnnncat

SEQ ID NO: 18411 - DNA, 338 bp, Diabrotica virgifera
  misc_feature (2)..(15): n is a, c, g, or t
  misc_feature (24)..(56): n is a, c, g, or t
  misc_feature (67)..(85): n is a, c, g, or t
  misc_feature (99)..(99): n is a, c, g, or t
  misc_feature (183)..(183): n is a, c, g, or t
  misc_feature (185)..(185): n is a, c, g, or t
  misc_feature (281)..(326): n is a, c, g, or t
cnnnnnnnnnnnnnncaatttaannnnnnnnnnnnnnnnnnnnnnnnnnnnnnnnnctttgatcccnnnnnnnnnnnnnnnnnnnataattacccttanggataacagcgtaatttttattggagaagtcaaatcgataataaagattgccgacctccgatgttggattaaagtttataattngntgtaccagtaatatttatttaagtccttgttcgactttttaaaattttacaattgattctgagttttaaaaccggtgtgggagaaccaaggtttgnnnnnnnnnnnnnnnnnnnnnnnnnnnnnnnnnnnnnnnnnnnnnngaaaagggaccc

SEQ ID NO: 18412 - DNA, 313 bp, Diabrotica virgifera
  misc_feature (137)..(157): n is a, c, g, or t
aaattttattagttaaataaaagaatgtgttgaggaaaaggaagatttagatgatagtatttaaggtaaaaagaatactatgggtatagtatagttatatttagaagaagatagatagatatattaatgatgtgttnnnnnnnnnnnnnnnnnnnnngtataattattagagaaaagtattaagtttagatagatgaaatagaataaattatgtatttattattaatcataaatgttggtatgtgttaaaagatgtcagataagtagaggattattattgaataattatgattatgaagggtgtaaatgtatt

SEQ ID NO: 18413 - DNA, 99 bp, Diabrotica virgifera
  misc_feature (5)..(35): n is a, c, g, or t
  misc_feature (37)..(98): n is a, c, g, or t
atcannnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnc

SEQ ID NO: 18414 - DNA, 928 bp, Diabrotica virgifera
  misc_feature (827)..(827): n is a, c, g, or t
  misc_feature (898)..(899): n is a, c, g, or t
attggattttagccgatcaagaagcggcaatactttacaagaaaattgagatggtaccggaacccttagtatcactcagtgatccactaccaaaagcaatcgtggcagccttcatagccagaagagattatttaactcagaattcaagtataagccctaagaagattttattacaatgcgactacgccagccatcttttgacggatagtttgactttcactgtttgtaagaaaagggaccaaacagttatgctggctcatttactggtctgcgattggcttttggaaaccagaacttcactttgggaagattgtgtagataatggtttgaaaaatccagtttccagttgtgtcctatcatcatttcaagtagacctggcttctttgaggtctcttgcagaacatatacccagtgccttatcgagagtcttcctttatgaagctacagccagattgatggcaggtgctgctccaggaagaactcagcaacttttagatagaagtctaagacaaagacatgctaaatcttcgattatctgtggcaaaggtgataaaaaccaacatgagttaggcggtcagcgacagcacgccacagcgctttacatggcatgcaaacacctaccagggccccttctgtcgtctccgggagagagagcaggaatgttagttgaggcagccaaaactttagaaaaaataggggataagaaaagactgcaagattgttacgaactaatgaaaacccttggaaccagcgctgtgaataattaaggctcctatagacttactagtctgctaaaagtatcgagagcaacagtataactatagttnttatgatatgatatttttctagaaaaaaaaaacgttggatgagtgtccctcgtgaaaacgtgtcatcttgnngcatgtcctcgctcgtttttgagtagttt

SEQ ID NO: 18415 - DNA, 116 bp, Diabrotica virgifera
  misc_feature (2)..(27): n is a, c, g, or t
annnnnnnnnnnnnnnnnnnnnnnnnngatatgcatacataaaaagttaaatgttttaaatatacgaaaggagaaaatatttttatcgacatccagtggagtgagggcgattgtat

SEQ ID NO: 18416 - DNA, 654 bp, Diabrotica virgifera
aattcatacaagtgagatatgtgtttattattactctcccactacctattgtattaatctcctttgagattgcacacccgctttcatttgctttgatatactacgtcactcttcaccacagaacatgctgtgacagactcttattttcgtgaatcccgttcttcccgatatgtcagatgttcttgacacgagtgtaattctaatttctaggtgaataatgactcttcacccaaagtataatttcaagctaccaattctttcgatgtgagagacagatcgcatttttgatcatacgatatcctaacccgatgtggatctttccgacatctcaatctatgctgtcccacctttattcgtgctgtattgtaagtcatacgatgattacaatcccaaaataatgttagatatcctgcttcacatgactttctattgtcatgctgaatgtcctgtcgatatgtgtgattaggttctctccaattcgtgggatgaaactgcttgcatagagtactagaataactacaacacactcgttatgattacaaatcagatttgacaactcttatccactgcatacatgtttacatcgaacagaatgcaatttagatcaatgcattactatgcactatatcacaccttcttgctatcattttgtat

SEQ ID NO: 18417 - DNA, 786 bp, Diabrotica virgifera
  misc_feature (2)..(118): n is a, c, g, or t
  misc_feature (139)..(198): n is a, c, g, or t
  misc_feature (206)..(242): n is a, c, g, or t
  misc_feature (250)..(424): n is a, c, g, or t
  misc_feature (429)..(494): n is a, c, g, or t
  misc_feature (496)..(512): n is a, c, g, or t
  misc_feature (514)..(550): n is a, c, g, or t
  misc_feature (583)..(671): n is a, c, g, or t
  misc_feature (678)..(719): n is a, c, g, or t
  misc_feature (721)..(734): n is a, c, g, or t
  misc_feature (757)..(778): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcagccattattaattacnnnnnnnnnnnnnnnnnnnnnnnnnnnnnnnnnnnnnnnnnnnnnnnnnnnnnnnnnnnnccataccnnnnnnnnnnnnnnnnnnnnnnnnnnnnnnnnnnnnncttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgnnnnnnnnnnnnnnnnnnnnnnnnnnnnnnnnnnnnnnnnnnnnnnnnnnnnnnnnnnnnnnnnnncnnnnnnnnnnnnnnnnncnnnnnnnnnnnnnnnnnnnnnnnnnnnnnnnnnnnnngaaaactatatacgtctaacaaaggaactcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatgnnnnnnnnnnnnnnnnnnnnnnnnnnnnnnnnnnnnnnnnnncnnnnnnnnnnnnnnattggatgaaataacaactgtcnnnnnnnnnnnnnnnnnnnnnnatattttt

SEQ ID NO: 18418 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18419 - DNA, 874 bp, Diabrotica virgifera
  misc_feature (24)..(36): n is a, c, g, or t
  misc_feature (39)..(102): n is a, c, g, or t
  misc_feature (632)..(653): n is a, c, g, or t
  misc_feature (709)..(709): n is a, c, g, or t
  misc_feature (757)..(775): n is a, c, g, or t
  misc_feature (779)..(780): n is a, c, g, or t
  misc_feature (785)..(807): n is a, c, g, or t
  misc_feature (837)..(837): n is a, c, g, or t
cccacgcgtccgatattttacagnnnnnnnnnnnnntgnnnnnnnnnnnnnnnnnnnnnnnnnnnnnnnnnnnnnnnnnnnnnnnnnnnnnnnnnnnnnnnnaatcgggttttcaaccggtaaaatggcctacaagagtttcttaatcttgcattatgtgtttaaaattgttgcatttacacagttggacctgtatttcttagatatgtatttgtttggggaaaagtacttggtttataataacgctaaaataacctcacatcacgatataaaagactatataatatgtaatcaaaaacccatctgtgacatttttttaggattttatactcacgcattttttatatttcttcttttattttacgtttattttcattaactttcttctatctgtctgttcgggaggtattttgtaatagaattttgaaccaactattcggtgaagagagacttgaaattttaaacacagttcagatcattgtattggaaaacgtttcgtgtatgattttatatacaacatcagactatatgagacaatgagacaacatttatgaaatgaataatatgaactattgtataaatatttactacttactctttactctcttcaatgctatagcaggctccccccnnnnnnnnnnnnnnnnnnnnnngtattttcaaagttatttaaattcaatatcacaattttttagaacaatttgtatgngattataagtctgcatgcatagctttataaatctctctagatgtatannnnnnnnnnnnnnnnnnnttannaacgnnnnnnnnnnnnnnnnnnnnnnntattttgcccatttttttaattcgattccntcataatgacataatcccatgataacataataatctt

SEQ ID NO: 18420 - DNA, 446 bp, Diabrotica virgifera
  misc_feature (65)..(170): n is a, c, g, or t
cggacgcgtgggtttgatcgaagcttattctttgggctttactccctgagtttataagacacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattgttaggagcgtgaagaaaataatatctgagctactaaggtagatattgagctagtcaatagctgagacgatgatagatcctgaacatagagagctagaagaccaccggtataaaatggagagacaagagagctgcatacatagttcacagccgtctgagaagtgtagaatgatttcaaacattttcagtgtctacacgtcaaaagagcgggtagaatcgaaagcatgggttccacctgatgtatctccgctgtcggagctgtcggacgaag

SEQ ID NO: 18421 - DNA, 372 bp, Diabrotica virgifera
gagttggtttctttggatagaagagttattttttttttaggagtttttcttaaaatgatgatctgtggagtaaagatgattaatggataatgaaaaagtaataattatatgaatgttagaagaggtggataagtgtagcaatttgtatgggagagttattgagatttatagaagttgtttgaaatgaaatgaatgtcgttgtttggtatattaaatgttttaataaggattttagaatctttttattaatagatagagaagtatgtaagaactattgttatggttgttctatataattttagggatgtgttagtatatgaagtattattagaggcttattcttcaataagcatgattatggatgatgataat

SEQ ID NO: 18422 - DNA, 611 bp, Diabrotica virgifera
  misc_feature (412)..(445): n is a, c, g, or t
  misc_feature (447)..(469): n is a, c, g, or t
  misc_feature (534)..(553): n is a, c, g, or t
attggcactggttttcacaaccaactggccagtcaatttcataattgttttgtagactataacttatcactaactcaggggagtaatgtgtagtgtgtgtgttgactaagtgtcttgttactttgcaaagtcgacgtcattgtctttgcaaagagacgctaattgtatccgaacgtctgcggtccctccggtgaataccgatctcacaaggacagaaactattttcatttattaatttataataaacgaaaaatttctgaccctggtgagattcgaactcgcaaccttttcgaatttttcgatccataggaaggctcaggaatttatttaattactagataattttatttgtgagttacaagatgaaattgtattaatgtttaatttttatttaggaatcatgaataacgtnnnnnnnnnnnnnnnnnnnnnnnnnnnnnnnnnncnnnnnnnnnnnnnnnnnnnnnnncacaaaacctttataaacatataaatacaaagtatcttacatcaagaaaccgatgagagtagtgnnnnnnnnnnnnnnnnnnnnggcatattaagatctaggatttcaagaggaacatcggaatcgttttttttccctgttt

SEQ ID NO: 18423 - DNA, 726 bp, Diabrotica virgifera
  misc_feature (33)..(51): n is a, c, g, or t
  misc_feature (87)..(126): n is a, c, g, or t
  misc_feature (128)..(163): n is a, c, g, or t
  misc_feature (185)..(227): n is a, c, g, or t
  misc_feature (316)..(333): n is a, c, g, or t
  misc_feature (411)..(444): n is a, c, g, or t
  misc_feature (462)..(480): n is a, c, g, or t
  misc_feature (494)..(516): n is a, c, g, or t
  misc_feature (615)..(646): n is a, c, g, or t
  misc_feature (662)..(689): n is a, c, g, or t
attgttatttattttcaaataatcaaatattcnnnnnnnnnnnnnnnnnnnccattttattcaacgctagatacttactattgtgcnnnnnnnnnnnnnnnnnnnnnnnnnnnnnnnnnnnnnnnncnnnnnnnnnnnnnnnnnnnnnnnnnnnnnnnnnnnntacttatcctttccgactttcnnnnnnnnnnnnnnnnnnnnnnnnnnnnnnnnnnnnnnnnnnntttaaatactttttctgcagtgaaatgttcttcccttttcaatacatctcatcttttcagaaataaattacttccatttattaacaacnnnnnnnnnnnnnnnnnnctttacattattaacattacatatttccagacctgaccttaaaaataaccttgtataataccttagtttttaaagacnnnnnnnnnnnnnnnnnnnnnnnnnnnnnnnnnncgttagttatttatttcnnnnnnnnnnnnnnnnnnncttttataaattcnnnnnnnnnnnnnnnnnnnnnnncatataaatttagtaacgctgatgatattattattaaagaaccgtctatcttacgtgaccatcctatagtcgctaataatcgaattcaaccacatttcnnnnnnnnnnnnnnnnnnnnnnnnnnnnnnnncatcaaatataaagannnnnnnnnnnnnnnnnnnnnnnnnnnnaccgcgttattttcaccgtgccatctgacatcatcat

SEQ ID NO: 18424 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18425 - DNA, 1272 bp, Diabrotica virgifera
  misc_feature (141)..(169): n is a, c, g, or t
  misc_feature (195)..(213): n is a, c, g, or t
  misc_feature (254)..(290): n is a, c, g, or t
  misc_feature (332)..(346): n is a, c, g, or t
  misc_feature (348)..(368): n is a, c, g, or t
  misc_feature (397)..(414): n is a, c, g, or t
  misc_feature (468)..(489): n is a, c, g, or t
  misc_feature (507)..(528): n is a, c, g, or t
  misc_feature (797)..(842): n is a, c, g, or t
  misc_feature (881)..(934): n is a, c, g, or t
  misc_feature (945)..(1009): n is a, c, g, or t
  misc_feature (1027)..(1045): n is a, c, g, or t
  misc_feature (1051)..(1070): n is a, c, g, or t
  misc_feature (1124)..(1149): n is a, c, g, or t
  misc_feature (1179)..(1202): n is a, c, g, or t
  misc_feature (1213)..(1242): n is a, c, g, or t
tccttaagggtgcgaaaatgatggttatgatttagtagatatcctttaaagaactttattaggagtttttagaggaatattaagaatattaggaataattaaatgatttcatttattctataataatttactaatagttgnnnnnnnnnnnnnnnnnnnnnnnnnnnnnaaatgatgacgagatattggaggagnnnnnnnnnnnnnnnnnnngtatagtttataagttaaagaaggtttaagtaaagaaatgnnnnnnnnnnnnnnnnnnnnnnnnnnnnnnnnnnnnnaattgagaagaaggttttagcaagtagattaataatgaaagnnnnnnnnnnnnnnngnnnnnnnnnnnnnnnnnnnnntgttgataaatgaaattttgttagagtgnnnnnnnnnnnnnnnnnngatggatgatatttttaatatgttaatataaggtatgatttatgtaaatgaagnnnnnnnnnnnnnnnnnnnnnngtgtttagtaaagtatannnnnnnnnnnnnnnnnnnnnntgatgatggtggtatgaagaattgtgagattggatatttaggagaaatatagaagtggaataagggagtaggaggacagttgtgttaactgttaatgaaaaagatggtatttgtgtattaaatataaggaatcgactgattagtgattaagttggttgagtgggggatgatgtttgtggtatggtggtataataattggagtgttttatggaaagatggagggagggggtggtggaagaaaaaaagtgtttttattttgatttgattgnnnnnnnnnnnnnnnnnnnnnnnnnnnnnnnnnnnnnnnnnnnnnntgaagtgaattttataggagttttattagattgattaannnnnnnnnnnnnnnnnnnnnnnnnnnnnnnnnnnnnnnnnnnnnnnnnnnnnnggggggggggnnnnnnnnnnnnnnnnnnnnnnnnnnnnnnnnnnnnnnnnnnnnnnnnnnnnnnnnnnnnnnnnnttgaatattttttggggnnnnnnnnnnnnnnnnnnnccttannnnnnnnnnnnnnnnnnnntttttaatggtgagggttttaatattttgtaatttaagggatgtttggtctttnnnnnnnnnnnnnnnnnnnnnnnnnntgtaaataaatgggggtgggttaggattgnnnnnnnnnnnnnnnnnnnnnnnnactgtgtgtgnnnnnnnnnnnnnnnnnnnnnnnnnnnnnngtggggtggtggggggggtcgaataaaagg

SEQ ID NO: 18426 - DNA, 594 bp, Diabrotica virgifera
  misc_feature (504)..(518): n is a, c, g, or t
atcttttgagattgtaacagagtatcaacattactcatcatctttaatgccacagatatcctgaccactaacaacatgaactcattctcctacactcatcttaatctacgtcttgttaccatccctgcatctcttctagctcatgatcacgctattgcgattgcccttcctatacattcttatccttttctgctccattatctccattccaccgcacagttcgtacccaccatgaaactcataactccaactcaaatacattctcatacgaaaatgaaacactctctccccataatctacttcctccaagattaccattatctccatgagatccagtaccacttctatatagtcattcatatactccttctggttacacgccttcctccggacgattcgcttctgccctgccagttgccgacttatttaacttggatgacatccccctttcatctactggtgtaataattgaaacaacacgagcgatcgcccttttcaaccccnnnnnnnnnnnnnnnggctaaagattcctctttcgtgtaacgtgtaataatgcacgcagagtgcgatgtataccagcccttggaccgatac

SEQ ID NO: 18427 - DNA, 89 bp, Diabrotica virgifera
  misc_feature (17)..(84): n is a, c, g, or t
aaagaccctataaaagnnnnnnnnnnnnnnnnnnnnnnnnnnnnnnnnnnnnnnnnnnnnnnnnnnnnnnnnnnnnnnnnnnnnggggg

SEQ ID NO: 18428 - DNA, 852 bp, Diabrotica virgifera
  misc_feature (9)..(26): n is a, c, g, or t
  misc_feature (232)..(251): n is a, c, g, or t
  misc_feature (789)..(789): n is a, c, g, or t
gtttcagcnnnnnnnnnnnnnnnnnnggctacagggggaagaatactttggcagaagaaaaactgaagcggggaaaattgtttttgataaaaaaaggaatgaaaaaaaagaaaccacgttgtacctgtagagctaactctaaaacagtatttaaatgtgccactgtcactctataaacaggtataaaagaatctataaaacaggtatttgatcagttttggtctttatcacnnnnnnnnnnnnnnnnnnnnttgtgcaaagtttagttgggaaaaaatctgtggctcaaagaacgggggataacgatacaactaggagaaatctatcgttattttatcacctgattatgcataacagtctacaaaaagtaagaatttgcaagaaaatgtttctgaacactttatctgttggagaatggtcagtttcaaattgggtgcgtaaatttaaggaaagccagggtcaagttgaaaattataatgaagaagagttaaaggaggaacagcaagaattgatcgatacaagaaagagtgcagcaaataaggctaaaaaagatttattaaaatccttttttgaaactttgcctaagcttgagtctcattactgcaaagatacagaaagatgtatttagaaccaaagtggcaatcaaaggcacgtttgtatcggttgtaccaagaatactgtgagtctcaaaataaagctaactttttatcgttgatatgtttattttatgaaatatttgatgagtgcaatctgagctttatttcacaaaaaaaaagatcaatgcgacantttgtgcacattcacgcgggaaattaaagcgaagataagtataacgctcacatttgacagaag

SEQ ID NO: 18429 - DNA, 68 bp, Diabrotica virgifera
  misc_feature (2)..(43): n is a, c, g, or t
gnnnnnnnnnnnnnnnnnnnnnnnnnnnnnnnnnnnnnnnnnnaatattaatagtttttttagtatta

SEQ ID NO: 18430 - DNA, 668 bp, Diabrotica virgifera
atgttttcaatactatcatcgatacatcttttgcgtaaaggactgaatgatgcgtgcaacgattaaaaaacaatttgccgtactatgtcttttcgacaccctagtcaataaactgcctgtatttatgcgctatggtttctattatctctgcatcacatagcggcgcacctgatgaggccgtgtcaaccgaatctgagcagaaataccatatacatattatcgataaatcgacctaggaatatgtcactcaatgcatctctacagcaacgccaatatcaagtaccactttcctaactatctttgtgtgatgagcaagcgtgaggacatctaccaagaactgggagcaatgatactacacatacacctagattccgtgcatcatatgttatagagaaaaagctaaccttcttcaaagagatatagatataccaccgacccgacactgctccacgatatgctatttttctgaccttgcctgatctatgtattattatatctatgtgaaataccgattagaatttctatattcacatgaatttttgctcatttgattcatcatacattatgacaccttcaaaactaccaccaaatatgtctttgttacttcatactacaatacatgaaacatcatatattatgtctaatgcaataacatcaacccttcttcc

SEQ ID NO: 18431 - DNA, 584 bp, Diabrotica virgifera
  misc_feature (6)..(28): n is a, c, g, or t
  misc_feature (219)..(358): n is a, c, g, or t
  misc_feature (366)..(417): n is a, c, g, or t
  misc_feature (419)..(447): n is a, c, g, or t
  misc_feature (450)..(484): n is a, c, g, or t
  misc_feature (486)..(533): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcggannnnnnnnnnnnnnnnnnnnnnnnnnnnnnnnnnnnnnnnnnnnnnnnnnnncnnnnnnnnnnnnnnnnnnnnnnnnnnnnnccnnnnnnnnnnnnnnnnnnnnnnnnnnnnnnnnnnntnnnnnnnnnnnnnnnnnnnnnnnnnnnnnnnnnnnnnnnnnnnnnnnngacccaccactacagttttttagtattatatttatgtatataataaattta

SEQ ID NO: 18432 - DNA, 615 bp, Diabrotica virgifera
  misc_feature (2)..(59): n is a, c, g, or t
  misc_feature (61)..(76): n is a, c, g, or t
  misc_feature (78)..(150): n is a, c, g, or t
  misc_feature (152)..(215): n is a, c, g, or t
  misc_feature (217)..(296): n is a, c, g, or t
  misc_feature (299)..(396): n is a, c, g, or t
  misc_feature (569)..(589): n is a, c, g, or t
  misc_feature (601)..(614): n is a, c, g, or t
gnnnnnnnnnnnnnnnnnnnnnnnnnnnnnnnnnnnnnnnnnnnnnnnnnnnnnnnnnntnnnnnnnnnnnnnnnnannnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnntcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattgtagagttcaaatcgataataaagattgcgacctcgatgttggattaaagcttataattggtgtaccacctatattattaagtctgttcgactgttaaaattatacatgatctgaggttaaaccggtgtgagccaggttggtttctatctttacnnnnnnnnnnnnnnnnnnnnngagaggaccatnnnnnnnnnnnnnng

SEQ ID NO: 18433 - DNA, 867 bp, Diabrotica virgifera
  misc_feature (711)..(711): n is a, c, g, or t
ggtaagaaacctatttcctttgatgataatagttgttcgtcacctctaaaaatccttggacttgtatggaatgcacagttggattgtttttcttttgaagtgacagctctggacaaatcttgtactaagagaagtatgttgtctgaattggcccgagtgtttgatcctgtagggtttctagctcccatgactttgttcacgaagcaccttatccaacgtttatggttgtccggaatcgactgggatgactctcctccagactcaatttgtaaagtttggaaccagtataaggaacaactgttatcccttgcacagcttgaaatacctaggtgcatgttcgtgtccaggtatatttgttgtgaggtacatgggttttgtgacagtagtgaaaagggttatgccgctgttatttatttgcgttttgttctaccagatggtcaggtttgtgtcttttttgtttgcgcgaagtcaaaagtggctcccataagaactgtaagcattccacgtttggagctgtccgctgcagttctactatctaaactcatgcagtttgtagtcagagtattagatcctaaacttaaaaccgcaaaatttgtagcttggtccgattctcaggtagctctaagttggataaaatcctctcctcatcgttggaaaacttttgtttctaaccgggtttcatatatacaggaacgcctttctcctaatagntggttttatgttccttctgctcagaatcccgctgatttggctttcaaaggtgttttacctgctctaatgttggaggaatcttattggtttgcaggttctgaattttttgaataacaccggatccattcccaaacgcttcctgttgtttttctgagg

SEQ ID NO: 18434 - DNA, 353 bp, Diabrotica virgifera
  misc_feature (129)..(145): n is a, c, g, or t
  misc_feature (147)..(167): n is a, c, g, or t
gtagaatatgaaagaagttataaattttaaggaaatatggtaaaaggaaaatattaaaaaagaatgagtggaggaaaggagtatatgattttaaatattatttgaattttgggaaaaataattagaatnnnnnnnnnnnnnnnnngnnnnnnnnnnnnnnnnnnnnngaattaatagtgaggaaggtgtatgaaagagattgtaataaaaattaaggtgaggaaggaaatataggattaagagtaatgaaattgaatgtgtgtatgaagataatgttattaaggatgaagataaattattagaaattagtgatttatgatatagagtgtataatatccctttagtaaagataa

SEQ ID NO: 18435 - DNA, 69 bp, Diabrotica virgifera
  misc_feature (33)..(50): n is a, c, g, or t
agaagaaataattcatatgaataagatttcaannnnnnnnnnnnnnnnnncctgtactgaagagagaat

SEQ ID NO: 18436 - DNA, 749 bp, Diabrotica virgifera
  misc_feature (8)..(28): n is a, c, g, or t
  misc_feature (679)..(679): n is a, c, g, or t
  misc_feature (721)..(740): n is a, c, g, or t
gtttatgnnnnnnnnnnnnnnnnnnnnnaactaattatttctaccctaaacatgtattttagttaattgcaccgatgaatactctatttgaaacatctgaacaaacggagcctcggtcgcttccaaagaaaatatctcccgctggaaaattttttgtagcaatcacaggaggtgttgcaattggtttgacagtaatatgtgccccatttatcagtcctgcatttcgaaaatattgtttaccatatattccagctacagatcatcaagttaaaaatatattggccgctctcaaaggaagaactggtacccttttagatctaggatcaggagatggaaggattgttttggaaactgcaaaaaacaagtttatatctcatggtgttgaactgaacccatggttagtattattttcaaaaataagtgccctaagagaaggaatcacaaacgccaagttttatagaagagatctgtggaagtacagcatacatcagtatgataatattgttatttttggagtagaacaaatgatgaatgacctagagaaaaagtttattaaggaatgtaaatcaagctgcaaaataatagcgtgcagattccatcttcccaatttgacacctatcaaaaccattggacatggaatagacaccgtatgggtctacggtttaaaatagattaaggnggtaaggtgctcttccaagtttaagcataatagtgaaattgnnnnnnnnnnnnnnnnnnnngtttatttt

SEQ ID NO: 18437 - DNA, 872 bp, Diabrotica virgifera
  misc_feature (17)..(37): n is a, c, g, or t
  misc_feature (743)..(743): n is a, c, g, or t
  misc_feature (800)..(800): n is a, c, g, or t
  misc_feature (806)..(806): n is a, c, g, or t
caaatatttctagctcnnnnnnnnnnnnnnnnnnnnnttgtttataaagtatgtcagagaagaagccaaatcctttggatataaatggatccaactttaatccaaatatgtatctagaaaaggtattcaaggaatattccttgaaacaaatattggatcatgaagttgaagtagtgaaagatacacaaacattacactcagacatgcagaccttagtatacgaaaattataacaaatttatatctgctacagacacaataaaaaaaatgaagaatgatttcaaaaaaatggagacacaaatggatctgttggcttccaatatggctacaataacatctttttcagacaagataaatggtacattgcaagacactagacaaacaattagtaagttatctggaatacacacccttctacagaagttgcaatttctttttaaactaccaactacactcaaggctcgaatggaagaaaagaattatgttcaagctacacaagattatctacatgctcaacgtgtgttacatcaatatggtgatatgccttcatttcaagggatcaaaggggattgtgaattgattttaattgaactgaagagagaattaagaaaacaatttggtaattctgatgcatcagctaaggaactggcagaggctgttgatttactgttgaagttagatgaacctgctaaagagttatgtatggagtttttgtcttgtgctgaaaaacgtttagcagaacangtagttatgttaaaagatcaaagtgagcaacgtgatattattgagtttgttgatctnagttgntcaggtttcttaagtgatctgtgtttaaattggtgcttcattccatgatatgtttataaatcgatt

SEQ ID NO: 18438 - DNA, 718 bp, Diabrotica virgifera
  misc_feature (5)..(29): n is a, c, g, or t
  misc_feature (48)..(96): n is a, c, g, or t
  misc_feature (107)..(139): n is a, c, g, or t
  misc_feature (147)..(180): n is a, c, g, or t
  misc_feature (186)..(218): n is a, c, g, or t
  misc_feature (229)..(323): n is a, c, g, or t
  misc_feature (329)..(376): n is a, c, g, or t
  misc_feature (378)..(399): n is a, c, g, or t
  misc_feature (407)..(502): n is a, c, g, or t
  misc_feature (507)..(528): n is a, c, g, or t
  misc_feature (563)..(585): n is a, c, g, or t
tcttnnnnnnnnnnnnnnnnnnnnnnnnntttaatgagaattgtgaannnnnnnnnnnnnnnnnnnnnnnnnnnnnnnnnnnnnnnnnnnnnnnnngatcctggagnnnnnnnnnnnnnnnnnnnnnnnnnnnnnnnnnaatatatnnnnnnnnnnnnnnnnnnnnnnnnnnnnnnnnnnatatgnnnnnnnnnnnnnnnnnnnnnnnnnnnnnnnnngcgatgttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgnnnnnnnnnnnnnnnnnnnnnnnnnnnnnnnnnnnnnnnnnnnnnnnnannnnnnnnnnnnnnnnnnnnnntcatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagnnnnnnnnnnnnnnnnnnnnnngaataatatataggaatattaaaggaattcagcgnnnnnnnnnnnnnnnnnnnnnnnctgacatgtctttttgtgtcatatataaagactcgtctgcccactgctgacctcggatgaacgcgaaagtttgaccgagctagagcatgataatcattagtatttatattgaaagctgatatgaaggtgtgaa

SEQ ID NO: 18439 - DNA, 723 bp, Diabrotica virgifera
  misc_feature (3)..(32): n is a, c, g, or t
  misc_feature (43)..(65): n is a, c, g, or t
  misc_feature (256)..(328): n is a, c, g, or t
  misc_feature (334)..(399): n is a, c, g, or t
  misc_feature (417)..(435): n is a, c, g, or t
  misc_feature (442)..(476): n is a, c, g, or t
  misc_feature (479)..(497): n is a, c, g, or t
  misc_feature (511)..(532): n is a, c, g, or t
  misc_feature (670)..(718): n is a, c, g, or t
atnnnnnnnnnnnnnnnnnnnnnnnnnnnnnnccctttcgtannnnnnnnnnnnnnnnnnnnnnngataaaaaccacccgggctcaccccggtttaaactcaaatcatggaaaattttaaaagtcgaacagacttaaaaatatagctgctaccccaattataaactttaatccaacatcgggggcgcaatctttattatcgatttgaactctccaaaaaaattacgctgttatccctaaggaaatttattcttatnnnnnnnnnnnnnnnnnnnnnnnnnnnnnnnnnnnnnnnnnnnnnnnnnnnnnnnnnnnnnnnnnnnnnnnnncccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttnnnnnnnnnnnnnnnnnnnnnnnnnnnnnnnnnnngannnnnnnnnnnnnnnnnnncccttcattccagnnnnnnnnnnnnnnnnnnnnnnttatgctaccttagcacggccaaaataccgcggccattcaaattaatcagggggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnntttac

SEQ ID NO: 18440 - DNA, 1258 bp, Diabrotica virgifera
  misc_feature (178)..(199): n is a, c, g, or t
  misc_feature (401)..(406): n is a, c, g, or t
  misc_feature (419)..(419): n is a, c, g, or t
  misc_feature (423)..(423): n is a, c, g, or t
  misc_feature (427)..(427): n is a, c, g, or t
  misc_feature (431)..(431): n is a, c, g, or t
  misc_feature (434)..(434): n is a, c, g, or t
  misc_feature (448)..(448): n is a, c, g, or t
  misc_feature (455)..(456): n is a, c, g, or t
  misc_feature (461)..(461): n is a, c, g, or t
  misc_feature (479)..(481): n is a, c, g, or t
  misc_feature (492)..(494): n is a, c, g, or t
  misc_feature (526)..(528): n is a, c, g, or t
  misc_feature (589)..(612): n is a, c, g, or t
  misc_feature (622)..(665): n is a, c, g, or t
  misc_feature (667)..(714): n is a, c, g, or t
  misc_feature (741)..(784): n is a, c, g, or t
  misc_feature (787)..(836): n is a, c, g, or t
  misc_feature (847)..(876): n is a, c, g, or t
  misc_feature (886)..(946): n is a, c, g, or t
  misc_feature (957)..(1020): n is a, c, g, or t
  misc_feature (1024)..(1066): n is a, c, g, or t
  misc_feature (1094)..(1124): n is a, c, g, or t
  misc_feature (1130)..(1147): n is a, c, g, or t
  misc_feature (1201)..(1245): n is a, c, g, or t
cctcgccggacggcccggaattccaccccccccccttcccctccgctttcttattaaaaaacagaatgaaggtgctcatctcttgtcgctgcccttattgcgggttaagtgactatcaatgtgactacaaaaaatgtaccagtgttaaggaaacccataacagagattacaacgatannnnnnnnnnnnnnnnnnnnnntgttttccaagacaccctcaaaaaaatcgtgtcaacacaatgctagataataaaacacaaaaaaaacctactacataatgttaaaaattcggcatgggcccagagctgaattccaattatgttgggcagttgatgaatattagttcgattaatcctatattactaaacacgtaggcgaaccaaatgtgaaaaatgaaatcannnnnngggaattccctanaccnaccntccnaangtgggggaaaaaancggtggnnatcgngcccccggtcccaagggnnnaaccccggggnnntccccggggaaaaatttttcccccgggggggnnntccgctaacctctttttttttccggggttcccccggccaaaaaaaaaaagcccttttcggnnnnnnnnnnnnnnnnnnnnnnnnccaaaaaggnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnngtgaaaataaaccccccccttcccctnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnncgccccggggnnnnnnnnnnnnnnnnnnnnnnnnnnnnnnttcccccccnnnnnnnnnnnnnnnnnnnnnnnnnnnnnnnnnnnnnnnnnnnnnnnnnnnnnnnnnnnnncacacccaccnnnnnnnnnnnnnnnnnnnnnnnnnnnnnnnnnnnnnnnnnnnnnnnnnnnnnnnnnnnnnnnntgcnnnnnnnnnnnnnnnnnnnnnnnnnnnnnnnnnnnnnnnnnnngggtgacacaacacacaacaaaacccgnnnnnnnnnnnnnnnnnnnnnnnnnnnnnnncaacannnnnnnnnnnnnnnnnnttgtttttttgtggggggggggtgggagaaaacaacaccacccaccccccccannnnnnnnnnnnnnnnnnnnnnnnnnnnnnnnnnnnnnnnnnnnncaccccacccccg

SEQ ID NO: 18441 - DNA, 1110 bp, Diabrotica virgifera
  misc_feature (970)..(987): n is a, c, g, or t
agcgttacatacatttctgtaatttcagtatggtacttcatccagttgctagacattatacactgcgcgtcatagaaaacgagcaccctaagaagtgggtcatttttgatgtagcgtgtctcctaaacatgtcagatttgggttactttttgaatgtgttatggctttgttctttgtcaatatccttgtgatggtgtttttgctagacgggtaaattttcattgtataccgggtgtacgaatcaaactgttttttctgagttcgcaacaccctgtggaatgttctagcatttgtaaaatgctgaaattgagacctaactatagccttttgttttcttgacattctgttttttaattcattcgcttatgtgggacagtgcaggagttgtgtactttaacaactggtcatgttcttcgtcagtataggttgtttgtaaataggtgcgaccaactttggggggtagttctgcatgataaaatgatgaccatttgcggacatacgattgttaagcaggctgtcattatttttaatgcagaactaccccttgaagtttgtcgcacttgtttggaaacaccctgtactgaggcccaccatggctagttgttggagtgcctaacttttgtattgttcagcgtaagcgaatgaatgaaaggagcagagtgttaataagacctgaggctgtagttggggttttaattcggtattttgtggggggtgggatattccccaggtggtcgcgaactttgaaaaaaaaacaccgtttgagccgtgcccccggcatacaatgggaatttgcccgttaatggcaaaaatgtacccctgttgtggccaggaatggggttaaaaaatgtcaaaaagtaattaaattcggaaatccttttagataaaggggcccccccggttttcccgttttttgggggggtctttgccccgcccggggtgcctaccccccttttccctatttcaggtnnnnnnnnnnnnnnnnnnaagaaaggcaaaaggggcctttaaatggtcggcgcccttctcaaaacacctccttttttcccactttccaaaaaagcagacaaaattccctctttttcccttctctttttttcctttttcttg

SEQ ID NO: 18442 - DNA, 94 bp, Diabrotica virgifera
  misc_feature (12)..(36): n is a, c, g, or t
  misc_feature (38)..(57): n is a, c, g, or t
  misc_feature (59)..(83): n is a, c, g, or t
cccgacttcccnnnnnnnnnnnnnnnnnnnnnnnnncnnnnnnnnnnnnnnnnnnnncnnnnnnnnnnnnnnnnnnnnnnnnnctaatttgaat

SEQ ID NO: 18443 - DNA, 904 bp, Diabrotica virgifera
  misc_feature (786)..(786): n is a, c, g, or t
  misc_feature (839)..(853): n is a, c, g, or t
  misc_feature (856)..(886): n is a, c, g, or t
gcaagagatctcatggactttggaatgatacctgaatttgtaggaagatttcctgtcttagttcctttccactccttagaccagactctattggtaaggatattgactgagccaaagaatgctctgcttctacagtacaaacgattgctagggatggacaattgcgatttgatatttacaccagaagctttgaacgccatcgcccatttggctatggaaagaaaaacgggagctaggggattgagggcaataatggaatctcttcttttggagccgatgttcgaaatacctggttctaacatctcagaagtccacatcacagaagactacgtgaagggaaagggcaaaccgtcctacattaaaaatcaagtacaaaccgaagaaggcgagttcaatacgtctatcagagtaaaacaatgagattgactttgctgtaattaactgattgggtaattgtcgcactagaaatggtctacgaaagttcggtatttatagtatcttgttttatttgtatattcaatggttttgaccgtatctttagttgaattatgaaaaaattatagattaacagccgaggaaaataatttttgacgacatcggcaactatagtttcctcctgtatctttcgtagattagctagtaatgtttgtttttaagattagaagaattgttattcaataaacaatagaatatatttttaaaagcaaagtgggtctaaaatgtttaaatgcctaaatgtgcaaatttttaatttgcatagtttagtcaatttagattctatttaanaccgattcaaaatcggttgaaaaattttttatcgaaaattaacttttgattannnnnnnnnnnnnnngtnnnnnnnnnnnnnnnnnnnnnnnnnnnnnnntcgaagacttcttaactg

SEQ ID NO: 18444 - DNA, 218 bp, Diabrotica virgifera; identical to SEQ ID NO: 7300
  misc_feature (6)..(28): n is a, c, g, or t

SEQ ID NO: 18445 - DNA, 895 bp, Diabrotica virgifera
  misc_feature (4)..(46): n is a, c, g, or t
  misc_feature (52)..(74): n is a, c, g, or t
  misc_feature (265)..(338): n is a, c, g, or t
  misc_feature (343)..(408): n is a, c, g, or t
  misc_feature (426)..(444): n is a, c, g, or t
  misc_feature (453)..(467): n is a, c, g, or t
  misc_feature (469)..(485): n is a, c, g, or t
  misc_feature (488)..(506): n is a, c, g, or t
  misc_feature (521)..(541): n is a, c, g, or t
  misc_feature (679)..(728): n is a, c, g, or t
  misc_feature (735)..(767): n is a, c, g, or t
  misc_feature (778)..(841): n is a, c, g, or t
  misc_feature (844)..(887): n is a, c, g, or t
tttnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttactannnnnnnnnnnnnnnnnnnnnnnnnnnnnnnnnaaatttattannnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnctcatccc

SEQ ID NO: 18446 - DNA, 514 bp, Diabrotica virgifera
  misc_feature (361)..(380): n is a, c, g, or t
tagcgtaccttttcgtgacgaatcggatatttttcgagcgatcatcggataatctagagaaatgcgattggcaacactggtcttcaaatttggtgatttgtttggcggtgtaaagattttttttgccggcactgtacatggcagcaaatttcttctgcgcgcccgacggtgaattttttaaggcgcgcccggccgaaggttaagtaccccaatgcccaactttgggtgaaacactaaagtgccaagttagttttagtaaaagttttagtggcaaataacagttttcacttattttgcggtttgcgaagcaacgaattgactttttgactttaaaaaatgggcattttgaacgtttttcaannnnnnnnnnnnnnnnnnnncgtagttgtttgtcgactatttagctttttattggagtgcaaaaggttgaacaaatcgcgttttttgcactaatgttaacaattaagggacggctccgaactctacgcaggaggaagataggatttaggactat

SEQ ID NO: 18447 - DNA, 918 bp, Diabrotica virgifera
  misc_feature (20)..(39): n is a, c, g, or t
  misc_feature (849)..(849): n is a, c, g, or t
  misc_feature (885)..(912): n is a, c, g, or t
agctaatacactcgagtccnnnnnnnnnnnnnnnnnnnnctatgaatctggggcgttaatgggaaaatatcttacatttacatataaagccttaaaatgaataccgccgacaagtgtggaagccgaaagggcattttctgctactagctattgtgcgaagatgtaggtgttgttggccttacacttcgtcctggtgcctttgtttcgcgcaccagttatagatcgctggtttttccccttgggaaactgaattttctttccttagggaaatggtttcactttttctctacttatacgaaggaccacccaaagctttgggacaaatgaaatatacgagaagaacgtttttactaagtctatttaccaaaaacaattacaataacgaaattttggacgccgatagcttgcttgcaatagctcaataaacacactatgagcacgaaaacaaaaagaattggcactagttactgaacacgtattaaagaatccggtttgcgctgaaccgagagcgttgagctccaacttttcgactgctccgtctcgcagttgcaactgtactgtctctcgaacacaagaacacccctcaacccctattcatcgcaaccgttttttgaccttcaaaatttccttttttggttaaagtttacgtcagccgtctttctcatgaaatggcctggttggaaattttggatgccaaagactgaaagataaaaatttctaactgtgtactgtcattgttataattcttaagaacgcattaggattatatttagaaagttagtttccaagcaagtaccggcatccataaagataattaaattttaggaaaattaggaaagtaaatcttanaactaatatacagtgtgagcccaggttggtttctannnnnnnnnnnnnnnnnnnnnnnnnnnngaaaag

SEQ ID NO: 18448 - DNA, 617 bp, Diabrotica virgifera
  misc_feature (300)..(320): n is a, c, g, or t
ggagtgtcataattgaaactgatgataactttgtaataattttgtaattttttggaatttagtaatttaacaatggttaatataacgacaaccatcacgcacgtacgagaatatttttgtaaaattattagagacattgaggatgtatctgttgtagtagcagcaatctaagctgtgaaggtgttgattaaacattccaaatctagacactgttcaagagttggaagctaatctaaaagatgatatccaggagacgaaatactcaaactacgcaggagcatgaattaactctggatgtgnnnnnnnnnnnnnnnnnnnnncattaaattctcgtgatgcaagtgcgttcgatgagtgctaacgaattatgttgtatataggtctcctttttattaataagttggatgaagtcaggggcaacatcgtcaaattagctgcagatttcattgaatatgaatcgagactattaactaggtcaagatcacgagccagttcttcaaaatttatgatgcgcccttagacattaggaaaagtttgaatgattcgtcactattacagagtctggtaagagcccacccccccccgagagagaacatggatgtgatggaattccctgc

SEQ ID NO: 18449 - DNA, 439 bp, Diabrotica virgifera
  misc_feature (128)..(221): n is a, c, g, or t
  misc_feature (227)..(249): n is a, c, g, or t
cacagatggacagacactgttcgctggatattccgacaacacgatcagagtatggcaagtcagtgtgtctgctcattaagatgttaagttgtagataagcgacagtttttttacaataaaaagactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 18450 - DNA, 922 bp, Diabrotica virgifera
  misc_feature (824)..(824): n is a, c, g, or t
gttttgattatattaaattttgcaatggatttagattctgaaagtactgctacttctttagaggacaatactgaaaatttctgtgacaatccaacaagggataccctcgccgagggtttaatgggactgataaaacctacagtggatcaattagacgaaagagttagagcgacaagaatatctcaattggaactgaaacagtgtattgaaagtctcagtgaagaactcaagtcaatttctgagtcacaacagcacacccaggacttggatatctacgttaaaaagcttattaatgccaaacagagagttacagtgttgacaaatgtactgcaaaatacacaggagagattaaacaaggttcatgctaatttagataaagaagtgttaaaaaggaaagcagttttagaaactactgaggagactcaagctagtgccagttaacatgaatctttcaacacctatttattcattagaacaatttcctgaagtgtacgagccgagagaagatacatttttattcttagatgcactagagtcggactctctgtttttaaaaagtttgcagcctactgttatagccgaaataggaacacgcagtggcgttatcatcagtgcgatgttccagatgtttggaacatcctgtgcatactttggtactgatgtaaacaatcaatgttgcttagctgctcagcttacaagtaaattaaacaaaagtactgtcgaaaccatgacaatggacctattgactaattttaaaaataacatttgtgatattgttttgttcaatcctcccgtatgttgtgacagaacaggaggaaatgtgntgttaatgaattaaatcgtttcttgggctggggggagtgatggccgtgaaattactgataaactattaaataatttaccaaatatacttttcggaaaa

SEQ ID NO: 18451 - DNA, 849 bp, Diabrotica virgifera
  misc_feature (75)..(111): n is a, c, g, or t
  misc_feature (380)..(397): n is a, c, g, or t
  misc_feature (799)..(799): n is a, c, g, or t
  misc_feature (827)..(827): n is a, c, g, or t
gtcagttttggttttacgtttcgccccgacatgaagtacacttggttgatgctggcttcgagtttagtgctggtnnnnnnnnnnnnnnnnnnnnnnnnnnnnnnnnnnnnngcatatctcgaagacgatgaaaactaccaaccctccgaggacgattatggggataatgccattgatcgcttatttcagaaacgagcatgtatcagaagaggaggaaattgcgaccaccggcccaacgattgttgctacaacagttcatgtagatgcaacttatggggctccaactgcagatgccaacgaatgggcctgttccagaaatgggggtaatttaatataaacaaacatatatagagaatgatgacaggaacattagatcctgnnnnnnnnnnnnnnnnnnccattgaggtaaattttagttgtaacaagtcctgttatcattctttcgaggatactgaacacaggatcaaaagtttcaagtttaaattttacattttgtgtttctacaacagaactgattttctataaattaatgttattatttgaaacttttgatccagaccactgcgagaaattggatactgaatttatttccatcatttaaaatcattatgtcccatactagcaacgatatgttacttttaacagactctgtacaccaactattactaatataaacaatgccaatacttagaaaattgtttgaagctgtcatgaaatcattccatacagaaagtgggtgaatttttatggatataggaaaagtaacaaaccatttaaagaaatacattatttttaattntcttataaaaaagtttattttattctgnttaatggatttataaaataagt

SEQ ID NO: 18452 - DNA, 721 bp, Diabrotica virgifera
  misc_feature (24)..(43): n is a, c, g, or t
  misc_feature (225)..(247): n is a, c, g, or t
  misc_feature (263)..(281): n is a, c, g, or t
  misc_feature (541)..(558): n is a, c, g, or t
gtattgggcaccgattatttcacnnnnnnnnnnnnnnnnnnnntattatgtaccttgagcatctacaattaataacaaccatatatatattcatcatgtactatattaatatatatcctaaaccattctacctatcggagaataggtgtttataatcttattcttagccatgaagtgttatatcatattaacttatatctacatttttaacttaaattatatgtnnnnnnnnnnnnnnnnnnnnnnnatagtacatacttccnnnnnnnnnnnnnnnnnnncataacatctaattataacaaagaactaatgcagaatatttaactaccaaataactcatgaaaagaagttacgataaatcctactcctatcgtagaatgatgccatgatttatatgtacatcctagtataataacatataactcataactacttcaaatataaaaatacttaatatacttttagatatgatgcaaatcttattgaataacttctagaatatccactacatatatctttctcactatttactattctgctnnnnnnnnnnnnnnnnnnaattattaccatctcctgttgcattatatacattctctcgacagcccactagatgacccagaatgagacactcagaattgcaccatgctaaaaatatataagcatcaagccccctattgaatgctgataagaaagagcgaatgaaagaaaaacggtgtgtatg

SEQ ID NO: 18453 - DNA, 59 bp, Diabrotica virgifera
  misc_feature (2)..(2): n is a, c, g, or t
  misc_feature (7)..(8): n is a, c, g, or t
  misc_feature (12)..(55): n is a, c, g, or t
anttttnnagtnnnnnnnnnnnnnnnnnnnnnnnnnnnnnnnnnnnnnnnnnnnnataa

SEQ ID NO: 18454 - DNA, 871 bp, Diabrotica virgifera
  misc_feature (95)..(116): n is a, c, g, or t
  misc_feature (739)..(739): n is a, c, g, or t
  misc_feature (843)..(869): n is a, c, g, or t
aatgaaaccctagttagccttctgaacaaattgtctgtacagttctacgatctaagtccaatagaatttgaacagagacgcgtagtaaatccagnnnnnnnnnnnnnnnnnnnnnncgacagaaagtggtacttaacacaaattcaaaataaatataaggactcaaacatcggcagagaaatggccgagttgttatctaaattagagtacaacgaaatcgtcagttttatgtcaagtagtggctttaataaacataatttaaaagactgtttaagattaggtttaatggaagtggataaattaaagacaaatgatagttgcgatttgctgagagcaagtattgactgtctcttaaaagacatttctagtgtagtttgtaaaattccagaacctcatcaggtttattctccaatagaaagaattccatcagcttctgaatcactatacaccaaacaaatgacggaactttttgacaatcaagaattttccagtttactttatagtttggcaatgtccatacctttattttcgaaacatattcttgcaaattcttcctatgaactctccaacaataatttagaagatctagcaaaatttagcgttctctgtttagaatacatgcgatttttagaatctgagaacgtagattttagagttcatttgacagatatatgtttaacatgttgtgataccatattaagaaacatcagtacctgtaactttttagaattagattccnatgctacttggttgtgttctagtataaatagtgtgtacagtcttgtaaatactttattaagaagcgatagaccactttttacagttttcaagtacaatctaaannnnnnnnnnnnnnnnnnnnnnnnnnnca

SEQ ID NO: 18455 - DNA, 876 bp, Diabrotica virgifera
  misc_feature (215)..(235): n is a, c, g, or t
ctagaaatgagatattgctacggtatgtttttaaaccaagaggttgttgtaatttattcaacctcagacatgtttactccactgttttcaaattttgacactaatgacatttataaaatgttgacgctattggtatttcataggttcattaagttatatcagcgattttttgtattttctgcgtgattactttaatttttagatttttagtctgnnnnnnnnnnnnnnnnnnnnnttgtttttagaactctttatcgacgtagtagtatgatataaagtttatggattaccgtcgaaggccgacatgatcaaccaaaaaagaagatgtaggtatttggtgatatttctagtgactttcttggatgtgaatgtctttagtttactactcttggtttaaaaacaaagcttagatgcttttgaatattcgaggcacattggcaggtagcacttatcgcaatatgtattaattcttttcgcatttttacgagcataaactagattttgtcgctgacacatattcttgtaacatgggttgcacctttttctggcaaccctcttttgtccatcgtattctttcaagaagtgttttatcctggatgtggaagggctttgattgtattgtatttaaatattgatataccagagcctcgacgatattttcttttaattctattatatccaatttcttgttattaattttcttatacagatgcagagcatttaccatagctgttaaaggacaaactgttataaacgagtcgcttatacaacttgacggttcttctcacgtatggtgtataagatgtcatctgatcagaagtgtcgacaaaagctttttcttttgtgtaatctacaaccatccctgggttatgaact

SEQ ID NO: 18456 - DNA, 1027 bp, Diabrotica virgifera
  misc_feature (3)..(467): n is a, c, g, or t
  misc_feature (469)..(556): n is a, c, g, or t
  misc_feature (558)..(796): n is a, c, g, or t
  misc_feature (800)..(977): n is a, c, g, or t
ctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacccttaagggaaaaacaagcggaaatttttatttggaagaagttcac

SEQ ID NO: 18457 - DNA, 577 bp, Diabrotica virgifera
  misc_feature (424)..(441): n is a, c, g, or t
cccacgcgtccggtaccacaagtgataaaagttatcaaatttattattggtttgtttgtttatctttgtacctagttccgttaattattaaataaaataggtttagttccgctattattgctagatagagtatgttggatttagaatttgactatttttttgaagaagacaaaatgggaatgacggttacatcggtcagtgtcaccataagaaaagatgataataacctgattggtatcagcattggtggcggatcgcctttatgtccttgtttatatattgttcaaatttttgactacacagctgcagcaaaagatggcaccttgcaatcaggagatgaactggtttccgtgaatggtcaatctgtaaaaggaaaaacaaatgttgaagtagcgaaaatgattcaagctgcaaaggatgaagnnnnnnnnnnnnnnnnnnagttacacgctgatcctgttcaaggtagaagattgtatatcatcatccctaaaatgaaagatctgctggacgaatatatgagttcttcaacgacagatgccttggctatatgcagagaaattctgtgtactgatcc

SEQ ID NO: 18458 - DNA, 1011 bp, Diabrotica virgifera
  misc_feature (828)..(847): n is a, c, g, or t
ttgaagagcatttcttgttgcagtggcattttataaagcctttttctcaaacttttgaatattttgtactaatttctcttagacagtttgacgtctggaatatcttcgaagttgagaaaattctctttgcatttcaaaaaaatttcctccaatttcaatcagaaaactgtaacaatacatatccccagctttgataaagccaaagaagatgcccgaaatgatttgggtatcatacaagataaaacaattgacggtttatatagagttggtacgaaatacggaacaataaacacacttttttcaaagagaatgcaaagataattttcttaatttcgatgttccagacgtcaacctgtctctgagagaaattagtacaaggggttctgattttggaggacaatgctttatagaatgctgctgcagtgggaaatgctcttcaaaattatgtaagtttaagggatctggcgtgttgtgtaggtctgggtgccatagttcttgaacatgtgagagtaaacactgattttttttgttttaattgcgacggtataaaaataatgaacattatgaaaaatgatgttttgttggacctgatctggcaaattacgacattttaagagctgatcgatttcataaaattggattttgacctttgcctggccgacttggtctctcctgggtttgactgttcgggggccgaaactgtagtttatttcgggctttgacatatatagaccgttgcaatcatagtagacgtatcggtgcaaagtagtagacggatcgatgcaattctagtctctcgcgtgttccaggtctagctatcatccaggnnnnnnnnnnnnnnnnnnnnaacaaatgaatcaaatttaaatggtggattagattttttcttgaaattattaaatgacgagggactgggggggggggaaaaacaaaagggaaggggcgggtttggggggcaaatctttcagggggggctctttttgggtttgaaaaaatttcaaaattgtgtgg

SEQ ID NO: 18459 - DNA, 735 bp, Diabrotica virgifera
  misc_feature (633)..(657): n is a, c, g, or t
aatatattcagatacaaatcgatatacacctatttgaggtagtgatatttgcacgtgtcatttacgtatcattattcttgcattgttttttctgtctatcgattccgagatgaagaagtggataatatcattgcctttcttactggcaattgaactttgtgacaacatcttcttgtacctgaacaacatacaccgccaccacctccgaaatcatatgtcctcgggtacgctgttgaaatgttccacgggccacatacatagaacccactccgaagtatccgatgcatctgaacttgttcaaggatcctattcctacgaacatcctctctccaaactccgacaagcaaactatgatgccgatatttatggattcgacgaaacatccaaccaagacagaccttcccttcaatcatatactacaggataaggctgatgctaaagttgccatcacagaggatatgcctgctatgaaaacgcacacattgaatcatgtgaccaatacagtcacgactgctgatcaaacagaatgaagaccatgtgaatgatattgatctggatgtctgatccaattgatgtggatcagcacctaccaatactcgtgcaactgatggcggtcacatatggcgtaggacnnnnnnnnnnnnnnnnnnnnnnnnnattaaggcgtgagaattgttcatctgtagctcttacactagttgactctgtagacagatccaacttcaacaaactttt

SEQ ID NO: 18460 - DNA, 876 bp, Diabrotica virgifera
  misc_feature (676)..(693): n is a, c, g, or t
  misc_feature (708)..(708): n is a, c, g, or t
  misc_feature (753)..(753): n is a, c, g, or t
aaatattacctttagattaaggaatttttaagaaaatatgttataggtacaattgtacctatgccgtctaaggttaatgatacagtgcattaaagagtttttggagtgttctacttgatggtaacgtgatggaacaagtggcttgaatgttttaattgtgatcaactgagaaaacgtgatatttagatatatatgtatagctctttgccagtaactaaacgatccctagtccttctaccgttttttgtgttgttccaaacaattttagcactgaaaaagcttaacgaaagagtagaagaagagaatagataaaatcattaaacaacgaaatggacttggtatagtgtacaccatagcatgcaacgtacttatcttttggtttggtactgttgtctgggatatttcgcaatgtattggactgttatttcctatccaataaggtctcaacaaaaatataggtaactatgtatcatgacgacttctaatatacacgagtgtattttatcaagtttcagtgagaaattgtactctatcaattcgagtagtggcagtggaattgaaaagaaagaataaatgatctgtagatcgctgtagtgtattctatctattttaaagtagtaataactcaacagtaacattcgaattcttttttgtactgcaaattgaatttcttgcnnnnnnnnnnnnnnnnnnctacatgagcaaggncgtaactggcgtagtttgagaaaattaaatttacacaatttcggnctttctctaatcagtcatatcataaaactattctaatgtcatttgtcatgattagctgagagtactaccccagtcaaaattgcccacggcatgtttcaatagacttaacacatttaattttta

SEQ ID NO: 18461 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(183): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnncacctagtacgaaagg

SEQ ID NO: 18462 - DNA, 888 bp, Diabrotica virgifera
  misc_feature (256)..(274): n is a, c, g, or t
  misc_feature (758)..(758): n is a, c, g, or t
  misc_feature (799)..(800): n is a, c, g, or t
  misc_feature (817)..(818): n is a, c, g, or t
aaagtttccaaaattagaaagaatcgaaataatctagccctagtatttgcttgtatagcttatttaacgttagaaattctagttttattgttcaactaacttcaacaaatgataccggttgtagttccaaacattttaaagctttgtaaacaagattagtagaaattagtgtaatggtgaacaatacccacttataacttggcatatttccattccatttataattatacttacctaaaggtaccttttgttatgnnnnnnnnnnnnnnnnnnnccttatgcgttcagttctcctattagacggagagctagagccgaggaattgtcgtcgtgagtggtatggagttttttctgcttcctgtgtccactgaggtgccagcctgagaggggtcgtagttttcaagatgcaatgaacgcatttcacaggaaggactccatgttgcttgtgacgatgatttttcggctctagctctataatatggtcaaattatatctaatggtataaagatttagaaataaaaatgaaaataacactataaatataataactgtataagaaaataaaaaggctaaggcagcagtttaaaattctaaaatggatatgttgcataaactggaataggctggtatctgttcggcttggaataaataaaagccagcaaaatgtttctgtttccgatatcttctatgatgaggcttattgatatactgcagatattctactccaataaaaggagatcaagagattcttctttagncagctattacgagcttaaacacagtttaaatttataagaannaatatagtgtattattnngaaaatacattgtattaaatcgtcctatacagaaagagggtaacgcggtcgaactcacttcatttcactg

SEQ ID NO: 18463 - DNA, 1152 bp, Diabrotica virgifera
  misc_feature (598)..(619): n is a, c, g, or t
  misc_feature (902)..(920): n is a, c, g, or t
  misc_feature (1004)..(1026): n is a, c, g, or t
  misc_feature (1054)..(1129): n is a, c, g, or t
  misc_feature (1131)..(1148): n is a, c, g, or t
cgtaaataatttttttttcgattatagcgccatctatcgacaacaatgtctgtaatcacagacgtgccttttttctgtcacatacaatttaatgcattagaaagaaatcgaaaaactgtgactcactgaaaaatgctcatgaaaaggactttacctacatatataacagaattgtttacttcattctacgttgtcttttttatattacgaaatggcattgtgtgggacatttctttcactatttagctgagattgcaattcgcaatataggaaaattgtatgtaactgttatcaattaagtaaatgataaaaatataaaagcaaatctatctcaattcatatttgaggccatgagagccagagtggcttgactgattttgacattactttgcataatcaaggaaaatgatagaagctatcaatgtccgcttgttttagtaattgtatgttgactaataatgattcttgatcaacataaaactactaaagcaatcggacattgttaacttctgatcgttttctttgattatgtgaagtaatgtcgaaatcagttaggccactctggctttcatgacctcatttgaaataaattttcttnnnnnnnnnnnnnnnnnnnnnncctttataaaaggtatatatttaactaaagtcccttaaagggctacatcataatcccagaacgttttcgatcaaaaaagatcatcatcagtgctgaaacaggataataacatgctgagtcaccaaaataaaaatatgtgggtaaaaaccctttaaaagttaaaaaaagatcaaggcaggctttgtttatatttgattcagagttggacccccatctccatataagctatttcagcatccttatgcctcatccgggaaagttcaaaagtctcaaactctgaagnnnnnnnnnnnnnnnnnnntgccaatttataaggaaaaccatcccaatggaaatgaacccccccccctgaaaagcaatttccgcgaaattttccccgtatttnnnnnnnnnnnnnnnnnnnnnnnccccccaaaagcaaaagttttacatccnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnncttt

SEQ ID NO: 18464 - DNA, 258 bp, Diabrotica virgifera
  misc_feature (9)..(88): n is a, c, g, or t
  misc_feature (90)..(116): n is a, c, g, or t
  misc_feature (118)..(161): n is a, c, g, or t
  misc_feature (164)..(196): n is a, c, g, or t
cgagagacnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnncnnnnnnnnnnnnnnnnnnnnnnnnnnnnnnnnnnnnnnnnnnnntcnnnnnnnnnnnnnnnnnnnnnnnnnnnnnnnnnttacccttaaggggaaaaacaaggcgggaatttttttattggggggaaaggtcccaaattcc

SEQ ID NO: 18465 - DNA, 315 bp, Diabrotica virgifera
  misc_feature (18)..(131): n is a, c, g, or t
  misc_feature (144)..(178): n is a, c, g, or t
  misc_feature (189)..(239): n is a, c, g, or t
  misc_feature (241)..(275): n is a, c, g, or t
gctgagatgaaggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatttttaaggnnnnnnnnnnnnnnnnnnnnnnnnnnnnnnnnnnncggtggaaaannnnnnnnnnnnnnnnnnnnnnnnnnnnnnnnnnnnnnnnnnnnnnnnnnngnnnnnnnnnnnnnnnnnnnnnnnnnnnnnnnnnnncttaagggttaaaaaggtggaattttatttggaggaggtc

SEQ ID NO: 18466 - DNA, 803 bp, Diabrotica virgifera
  misc_feature (9)..(26): n is a, c, g, or t
  misc_feature (34)..(54): n is a, c, g, or t
  misc_feature (84)..(151): n is a, c, g, or t
  misc_feature (153)..(165): n is a, c, g, or t
  misc_feature (216)..(235): n is a, c, g, or t
  misc_feature (246)..(277): n is a, c, g, or t
  misc_feature (280)..(308): n is a, c, g, or t
  misc_feature (316)..(356): n is a, c, g, or t
  misc_feature (364)..(377): n is a, c, g, or t
  misc_feature (379)..(409): n is a, c, g, or t
  misc_feature (447)..(465): n is a, c, g, or t
  misc_feature (493)..(544): n is a, c, g, or t
  misc_feature (554)..(593): n is a, c, g, or t
  misc_feature (657)..(684): n is a, c, g, or t
  misc_feature (697)..(742): n is a, c, g, or t
  misc_feature (746)..(760): n is a, c, g, or t
  misc_feature (762)..(774): n is a, c, g, or t
  misc_feature (778)..(798): n is a, c, g, or t
ctgggattnnnnnnnnnnnnnnnnnncgtaagcnnnnnnnnnnnnnnnnnnnnngtttagaatttattgtaattgctttatatnnnnnnnnnnnnnnnnnnnnnnnnnnnnnnnnnnnnnnnnnnnnnnnnnnnnnnnnnnnnnnnnnnnnannnnnnnnnnnnngttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggttgaggttatcaaccagaacgtttagaggctgnnnnnnnnnnnnnnnnnnnnnnnnnnnnaatatcattaccnnnnnnnnnnnnnnnnnnnnnnnnnnnnnnnnnnnnnnnnnnnnnngtcnnnnnnnnnnnnnnnannnnnnnnnnnnntagnnnnnnnnnnnnnnnnnnnnntaaat

SEQ ID NO: 18467 - DNA, 798 bp, Diabrotica virgifera
  misc_feature (639)..(639): n is a, c, g, or t
  misc_feature (647)..(647): n is a, c, g, or t
  misc_feature (736)..(736): n is a, c, g, or t
cattgacattagctataatagtgtaaaaattctaaaaagtagataaaataatctaatgaaaatttaatttaactattttctattaacattaatgactaataaatattcgaatttaaccccgccccagtatattccaatgattaggattccaagaaatgaatttgtgaagtagattaacagaaataatgtaaataattgtgatggctgtacctgggggtaataataaaggtccatgttactggtgtttcaaagcagtcaaatggataccagtcttatttattgtaaccattgtggtttggtcctactatgcctatgtcattcaactttgtttattgacagtagatgacttacctaggagaatattttatctcatatttttccacatgttcttcttcatgtttttttggtcctactggcaaaccatttttacagatattggaagagtgcctagtaaatttgcgattccggatcaaatttttgatgcttatctgagtagctctgataactatgaaaatcaaaaccgcatattagaaaatctagctcggcgtttaccaatcacaaatgtaactgtaaccggaggagtaagagtctgtgagaaatgcagaatagtgaaacctgaccgtgcacatcactgttctngtgtgtgnggtttgtgtcttgaagatggaccatcactgcccatggattaataactgtgtgtccttcacaaattataaatattttctattgtttttgngatatgcccttttgtactgtatatatgtatcccttacatcactcacatacttcatttctttt

SEQ ID NO: 18468 - DNA, 915 bp, Diabrotica virgifera
  misc_feature (847)..(848): n is a, c, g, or t
  misc_feature (864)..(864): n is a, c, g, or t
gatcaagacaaaaagtaattttagatttcaagacaagacaagaaatcttgaaatatcttgactaataataaaaactagattttattttgaataacaaatttagcatatttttaaatcggaattgataagccatgaattaaggcagataacacttcttatggagtcaacgcgtagccgatttcttggctttgttattattaaagttgctcttgaaaatagcctttccgcatgtacagatgttgctgacgttccgagaaaatccttggctattttcgataatgatgagtagatattttcatgtcttctccaccaatcaagtatattttcttatgacctaggctcatttaactatttttcaatttcatacttccaagattttaagttatcattatcagctttcttaactaggtaagtaagtaatatctagattaaattcgttatcttcccttttcagactaagtactggctctggtattggattctgtaaatcattctgggatttattaaagtagttagctttaaatatttcttaaaatttttgtactgtctctgattatagaagcttttcccaagatgaggaggaaaaagcctctactttatgccgaggattcaaaataagaactacacagtatatccaattagttttaatatagtgtttcagtattttatctctcgcagcttgaatgcagtaaattaattgctcatcggtagcgtctctatcaattttattattaagttcaacagtttagaattttgcattgagtttccctgtggccgttttccattcaccacccggtatgtactgacaaaatttactgaccagaaccattctgtatctaacattttnngcatacatattagatnttttcttgtgtcgcatatcattaatttaaacattacacttaaaccccatgt

SEQ ID NO: 18469 - DNA, 912 bp, Diabrotica virgifera
  misc_feature (780)..(780): n is a, c, g, or t
  misc_feature (866)..(867): n is a, c, g, or t
aatcaaaatgtgcaaatcaggctactttagtaaaatttgggaattacgaggagacaatatgatatggttcttttcataggcatttttcagtgcgtcacaaatgatagaaaaaagggtaagtccgtgatgatacgcatttgtaacatttattctaacatgacatagttaaatctgacagttgtcaccttttatttgcaatttggcataaaaacaaattaattgtgtttattgcatttataaaatggtattttctttaatttgtataggcttataaattgtacagattatattcgtagataattttttgtttcgattatagatccatctatcgacagctagaataaatgttataaatgtctgtaatcacggacgtgccttttttctgtcacatacaatttaatgcgttagaaagaaatcgaaaaactgtgacgcactgaaagatgcctacagtccgtctaatttacttgccgttgcacgtattatctacggcagagatctaagttgacatagttgccaaagtataaaaaaatcctgaatccattttaaatcaaatacatcacatataattattgtaaacgtggattatacaacaaaacaaattaatattcaatgtaaataagtaaaaacttaagaaatagagaacaagaattaagttataatcttttgagatttgcagtcacaagtgtttttgcactgcattgttaataattagaaaacggctccgaactcttgacatgaagccggcaggtttctttgtatatgtctacaataacaactaanaaagttgtcagatacctcgattattccaagtcgtgataaaattaggtgaaatttatatttttatagtagaggatctttttatagtnnaagtaataataaaatcggtaaatatacttaataaaacagatactt

SEQ ID NO: 18470 - DNA, 808 bp, Diabrotica virgifera
  misc_feature (7)..(37): n is a, c, g, or t
  misc_feature (310)..(362): n is a, c, g, or t
cgaaccnnnnnnnnnnnnnnnnnnnnnnnnnnnnnnngggaacaacaaagattgcagtctacagtagccggggattcaactgtgaatatgcgaaagacagttattagattaagacgtacagtacctaatgtacgaacagtacctaatgtacccagactccaagtccaaataaaaaataatcgcgtattggctacacgattcaaattggtgctgaatgaggaaattcaatcacagttggaatctttaaaagactactatacaggagaaataaatacaaatgttaaagttgttcctgaagccacaattactnnnnnnnnnnnnnnnnnnnnnnnnnnnnnnnnnnnnnnnnnnnnnnnnnnnnnttgctacatctaaatgtcttctcctatacgtcatataatctcaatactgttctaaagctattgtggcatcaaagcggcgtatccatttcgcgagattgccgcgcgcggcttgacaaaaaactaacaaaatgtgactcgactcgaacatcgatcgaccgcgatagtgatcgatatagcgtgcgtctagacgggtgtggatccaatgacagcagatgcgcgtgcatttgagaggacaattaattgcttagtatcaattttaatatacatgaggataactaattaacgaaaagaatccgcgcccagaggaattcgttaaagtttcttccgtaggagcttaagatggtaaactagatgcaaaaaactttaaggggaaggcaagatacccttttaataattgagggccttattgtgaacttcagatttggacaaaaaactaaaatgaagtt

SEQ ID NO: 18471 - DNA, 64 bp, Diabrotica virgifera
  misc_feature (2)..(55): n is a, c, g, or t
  misc_feature (62)..(63): n is a, c, g, or t
gnnnnnnnnnnnnnnnnnnnnnnnnnnnnnnnnnnnnnnnnnnnnnnnnnnnnnnatattannt

SEQ ID NO: 18472 - DNA, 253 bp, Diabrotica virgifera
  misc_feature (29)..(29): n is a, c, g, or t
  misc_feature (61)..(61): n is a, c, g, or t
  misc_feature (79)..(99): n is a, c, g, or t
  misc_feature (110)..(130): n is a, c, g, or t
  misc_feature (135)..(135): n is a, c, g, or t
  misc_feature (152)..(152): n is a, c, g, or t
  misc_feature (164)..(164): n is a, c, g, or t
  misc_feature (170)..(188): n is a, c, g, or t
  misc_feature (197)..(239): n is a, c, g, or t
taacagcgtaattttattgggagagtcanatcgataataaagattgcgacctcgatgttgnattaaagttataattggnnnnnnnnnnnnnnnnnnnnngtctgtcgacnnnnnnnnnnnnnnnnnnnnnagttnaaccgtgtgagccaggntggtttctatcnttattnnnnnnnnnnnnnnnnnnngaaaggacnnnnnnnnnnnnnnnnnnnnnnnnnnnnnnnnnnnnnnnnnnncaaacctaatattt

SEQ ID NO: 18473 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18474 - DNA, 164 bp, Diabrotica virgifera
  misc_feature (7)..(67): n is a, c, g, or t
  misc_feature (69)..(96): n is a, c, g, or t
  misc_feature (138)..(156): n is a, c, g, or t
ggggtgnnnnnnnnnnnnnnnnnnnnnnnnnnnnnnnnnnnnnnnnnnnnnnnnnnnnnnnnnnnnncnnnnnnnnnnnnnnnnnnnnnnnnnnnnttaaggaaaaaagggggatttttttttgggagggtttcaaannnnnnnnnnnnnnnnnnnggcccccc

SEQ ID NO: 18475 - DNA, 906 bp, Diabrotica virgifera
aacaagatggcaaccaaatttttagttctcgccgcattcattgcagtagctaaagccggttcttatggatcaggtttcggctacgccgcgccagctgttgtcgctcacggatctcacgatgccatctctacctactccactgtgcaacatcatgctccagccgtacactcctatgctgctcacgctcccctcgttcatgctccagttacccattcctacgcagctcctttggttcaagctccagtcgctcacgcttacgctgctcccgttgctcacgttcacgctgaaccctctgcaccagcccattacgacttcgcatatggagtaagtgacccccacaccggagatgctaagagccaacacgaatctcgtcgtggagatgttgttcacggaagctactccctcgtagaatccgatggaaccaaacgtactgtagactacactgctgatccacaccatggatttaatgctgttgtacacaaagaacctaccgtacatgctgttgctccagttgttgccaaaatcgtagccccagtagctcatgctgcttatgctgctccagcggttcatgccgcttactctgctccagcagttcatgctgcttactctgctccagcagttcatgctgcttactctgctccagttgtccatgctgcccacgctgccccagttgcccatgctgcttatgctggtccagttgcccacgccgcttatgcagcaccagctctacatggatacgctagctctgttgctcatggttacactgctcctttggctcatggtcatcatgcttatgctgctcatgctccagtcctttcacataacttgtggtaattttctagaaggacaattgtagattttgtatataaattatttatactgcttgcatttacataaagattgtct

SEQ ID NO: 18476 - DNA, 190 bp, Diabrotica virgifera
  misc_feature (10)..(27): n is a, c, g, or t
  misc_feature (51)..(108): n is a, c, g, or t
  misc_feature (116)..(151): n is a, c, g, or t
  misc_feature (153)..(180): n is a, c, g, or t
gttaaaaagnnnnnnnnnnnnnnnnnncgagagaccctatagagtttcatnnnnnnnnnnnnnnnnnnnnnnnnnnnnnnnnnnnnnnnnnnnnnnnnnnnnnnnnnncgcggtgnnnnnnnnnnnnnnnnnnnnnnnnnnnnnnnnnnnncnnnnnnnnnnnnnnnnnnnnnnnnnnnncccaattttt

SEQ ID NO: 18477 - DNA, 85 bp, Diabrotica virgifera
  misc_feature (4)..(5): n is a, c, g, or t
  misc_feature (10)..(64): n is a, c, g, or t
  misc_feature (66)..(84): n is a, c, g, or t
gtannaagcnnnnnnnnnnnnnnnnnnnnnnnnnnnnnnnnnnnnnnnnnnnnnnnnnnnnnnngnnnnnnnnnnnnnnnnnnna

SEQ ID NO: 18478 - DNA, 885 bp, Diabrotica virgifera
  misc_feature (100)..(126): n is a, c, g, or t
  misc_feature (858)..(878): n is a, c, g, or t
accatctcaccaaatatatctaataatgtctccactacttctagccaacgaaatgctcgctctaataggaatggcatgtcaagaaaatcggattattccnnnnnnnnnnnnnnnnnnnnnnnnnnnggcaacaaggggaaaattgcgtgcgagccttattgtttgacttcgaccatactttaattaaaacgcctaaaacacaacttttgtgaggacaaaattagcaatattgtaggttatattataactagcttattttattcttcgcacaaagctaaacaacggttttatgaaaattatgctaggggaccattttatccgattttcccctatcacgtagccggtgcttactatactattgcgaagttctagaacagttcttgcttatgttaggcaaaaaagacatgttcctttctcttatctaaagttttacattgaaatattaactatacccttactaatattgaattaatgatatttattgacgaatatgcagctactaacaaatcaaataaactcagtgaattggccacgttagtggtgtattataccgccatttcttatggagaccaaacagcaaattgtatatgctcgtaaactaaaagtcaaacaattaggaattcgcgtcatagatttaatgacatcataaccccccggtacaaacttgaagacagacaaattcaacaattttttcctcatatattagttttttcgctaccgtcaagtttaacaggatagcgctattgccaaataaaaaacatatatgtatttaccaaatcagccaccggctacactgtttctctttgtctttaaaaatgtgaaacaaagataactacagtcgcaaaggtgaagagtgtnnnnnnnnnnnnnnnnnnnnncttattt

SEQ ID NO: 18479 - DNA, 931 bp, Diabrotica virgifera
  misc_feature (779)..(779): n is a, c, g, or t
  misc_feature (799)..(799): n is a, c, g, or t
  misc_feature (810)..(811): n is a, c, g, or t
  misc_feature (820)..(820): n is a, c, g, or t
  misc_feature (837)..(837): n is a, c, g, or t
  misc_feature (839)..(840): n is a, c, g, or t
  misc_feature (849)..(850): n is a, c, g, or t
  misc_feature (854)..(854): n is a, c, g, or t
  misc_feature (861)..(861): n is a, c, g, or t
  misc_feature (888)..(889): n is a, c, g, or t
ctaaagtcaccgaaatagtacaagcaatatattattcgatggctaggaagactcattggtccttcgagccggattcaaatgtactgatagcggcatttaccttgttccaatagagctagactcaagttacactgatatggttgtggaagcggataagaaatgttaattacaagataaaactaatgcaattcgttaacgtggtgacgtaaaaagtgaataggcttggttaaagtcgggaagtcaacaatgtgagactcagaaagacggcgtctatttttgcaagttcaaaaaaaaagataatactggatttcgaagtagcgaagtaagttaagagtgatatcagcagatccagcttagcgcagcattaatacaaataaatgacagcgaatatgtgctgtgtatgcaagtgaaaactagacaattctggaaaaccataagagctagataaatgcaatggtgatgagacacctaagaagaatagttggaaaaacataatgggatagattaaacatacctaatggaatagatactattaggagaatggttaaccaagaaccaataatgaataaaataggaaagagacaaataaaccggtacaagcatttgaagaggatacaagatacaacccaatagaattacaagaaaagtccacgaaacaaagaacatagtaaaaagaaaaagaggcagaccaagaagaaaatggatacagcaagtagtaaaggcgggagaagttaaaaaaaatcactcgaggaattgaaaataatggcagaatatagaanagaatggaagagatgcgtanatggaaattannatagctagnccaaacctttctctttntnnctgctctcnntctntatatangcagtactgcctgtttttctttcacgnntgcttcattctgctcctaaagtgtcattccatctttttcctt

SEQ ID NO: 18480 - DNA, 598 bp, Diabrotica virgifera
aacgatattgcgaatctatattttatttttgtatcgtgagaaaaagtgggaagagcttctttaaatattctatgatcatctcaactgaaaagaaccgtacctttattagaaactgttcttttatataatgctatcagtaacagatgatggattaattatatgttatgtttatacatataccaattataattggagttcttgagatgtgactggtacccataaaaaatggggccctctatatgaacatctcacctcttatacgtaatactggatatttgaatgcttccctcgtatctttaagtatgattatgatctacgatagtacagtaaagacgacgaagtgatcagtttgtccaaaacacttatgaaaaactgtaagaaatttatctccggaaccaattctaatgaaaaatcctctagtagtagttcatataaaccaaaaaaagaaaaagaggagaagccgagtcgcgaagaaaaagatagggataaagataaaggaaaccttccaaaacagtatccagataggtcaaataccacagattctgtaagattgaagcgtagattattgttgacagctgtaattaggactaattctcaa

SEQ ID NO: 18481 - DNA, 189 bp, Diabrotica virgifera
  misc_feature (178)..(178): n is a, c, g, or t
agcccgacatgttggatacgaaaacgccggtaccgttgagttcttatgtgatgaaaagggcaatttctatttcattgaagcaatgcgagattgcagtggagatacggtactgaggaaatactggattgatttggtgcagtcgagatcaggatgctgaagaatgaccttgcccgagtgngaatcagcaga

SEQ ID NO: 18482 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18483 - DNA, 64 bp, Diabrotica virgifera
  misc_feature (29)..(53): n is a, c, g, or t
gtttaaaccggtgtgagccaggttggttnnnnnnnnnnnnnnnnnnnnnnnnnagtacgaaagg

SEQ ID NO: 18484 - DNA, 791 bp, Diabrotica virgifera
  misc_feature (191)..(216): n is a, c, g, or t
  misc_feature (658)..(678): n is a, c, g, or t
gtttatgaaaaaacaaaagatgtagatctttgaaacacactcagtgatcaaaagatccacaggtactggtttggacgaccactcgtacgaaaacaaacacatgaaatagagaatgcggaaaaatccccttacgaacaattcacacatccactacttcgggctgggaaaaattttttgaatagaatcttagnnnnnnnnnnnnnnnnnnnnnnnnnnctactttgcttagtataaaaagttagttttttcagctattaaacagaaaaatattgcttaaccatatttactttcggcgatagaaaatttccatttctgagtgaaaatttttgacgaaaataagttacttatttcgatccataaacttttaaaaaggagagaatgatgatttttttggcaattgcttattacagtgtctgtgagtctctttcgacaattccacttttgtttatggataatataataggtatctaattcttaatctatctattcaaagcgaaattcaaattatagtggatccatatgtaaagaggtcgttgcgttgttgctccaggtaactagatcagtcgaagaaaagagttcgcttttttaagacatttttatttggaatcaaaacatacaaaagataagataattaaccttaattactcgttaatttcgnnnnnnnnnnnnnnnnnnnnnctacgcatcgagctttctgttcgggccgatgtgacgatattttgtacatgaatgaatgattttgactatcgcgtgaaataggaattgcttttattaatacgacatgaatgcat

SEQ ID NO: 18485 - DNA, 901 bp, Diabrotica virgifera
  misc_feature (517)..(534): n is a, c, g, or t
  misc_feature (698)..(722): n is a, c, g, or t
  misc_feature (816)..(816): n is a, c, g, or t
  misc_feature (833)..(856): n is a, c, g, or t
ctcctagttaaatatttcaagctactatacgtttagttttcgattaggtataggcgactgaaggaagcgctaaaattggcaacattgctcagtccactctcgttgtccgcggaaaatcgaacgacggagttagaatcggcgagtagcgtgggaagtgggaccgtctgatactccacagcgcgcgttgttgacatttatagcccatatatctaatttaaaactaaacatgctgtatatttggtttatggttttcgttgtacagatctgtcacgtctagttaaccattgcgtgatattttatggataagaaaaatgctgtgccgttttgggaacattttttgctgttggattttttgtcagattttataaaaatgtttctggtagtcgcgtttttttactctttgtttcaaatatttattcacaaactattggttgttgttggtgatagaattttgttgaagagagttcgacatctacctgtggttttttggttgattgtaccaagtttctaacaaacnnnnnnnnnnnnnnnnnncttataaaattcttataatattcttataaaattcttataaaattcttataaaattcttataaaattcttataaaattcttataaaattcttataaaattcttataaaattcttataaaactcttataaactatttatgaaactcttataaaattcttatgagannnnnnnnnnnnnnnnnnnnnnnnncaaatatattttgcgtacaaagttggacaaagtggacaaaaccaaattatgttttatattaattatttaacaatgtttgatattgcctattaantttagtagacacattgnnnnnnnnnnnnnnnnnnnnnnnngtctaaatttttgtacatcaattttagggatctaccaatttttat

SEQ ID NO: 18486 - DNA, 680 bp, Diabrotica virgifera
  misc_feature (183)..(202): n is a, c, g, or t
agtcatactaagatgaacctcgagcctgtagtaacatcccaaaaaaagttcatttaatgctaggtaaaaattctagcagagagaatatactatatttacaaacaaacaaaatgttttttgaacctatgcgtatcaacaacgatgacatatgaaacatatatttcattattttctactacaacnnnnnnnnnnnnnnnnnnnngttattgtaacaacaatgtcacatcaatttttcgaaaagaaatgccattcaatgttaaatatatctaacttataagcaagtaaactcgactaatttattaacgagatataaagagttattaccattgtatattactatgagtaaatactatacaggtaagaactaagaaaccatcattgatgaccctgtacacataaaatacaaaaaaaacatgatcactgtcacatcacaaaatgagtgagcagtaatcattgttgcaattgttactgaagaatttataacaagaataacttagaatgtactaacacgagaacggcgcttctatgcattcacccttgatggaatacaaattattgatgtagacgactaaatgagctcgactgaaccattatatctgcgcatgctcatttcgaacatgtcttgtatatgtattatcctcataccttcagctgaccgctgactacccagctggcgctgc

SEQ ID NO: 18487 - DNA, 874 bp, Diabrotica virgifera
  misc_feature (322)..(345): n is a, c, g, or t
  misc_feature (777)..(777): n is a, c, g, or t
cattgataaaaggttgtgcatcaagatgagttatcctgggtataatccatatcaacagggatcagcaccgggagcacccagcccatacccccaacaccctcaaggaggagcaccttcctacccaccactcaatcctaacgctttcggttatccctctaacatgcccatgcaaatgccccaacccatgcaaatgcccacttaccctcccagcatgccaggctatccccccgccgttcccgggggctatcccccaccccagtctagcggaggatacccgccatcgagtgggggatatcattcgggcggcggtggggcttcgtannnnnnnnnnnnnnnnnnnnnnnntccgcagcagccctattctagtgctcctggtgctcctcccggtggacatggccatcaaggatctcagggaccttacggagggttttcgtatacacagcacagtgctcctcaaagttatgcagctcctcgcaggacccagaggactcccaccgtcagacctgcccaaccattcaaccccaatgatgatgctcaagttcttagaacagcgatgaaaggtttcggaaccgatgagaaggccattatcaattgcttggcaagaagaaccaatgaacagagactacatattgctgctgcgtttaaaactatgtacggaaaggatttgatcaaggacttgaagagtgaactcagcggaaacttcgaaaactgcatcgtggctatgatgactcctcttcccgaatactacgccaaagaattgcacgatgctatgagcgntgttggaactgatgaagacgtcctcatcgaggtcatgtgtaccatgtccaacagggaaaatatggtcatcagggaagcgtaccacaaattatactac

SEQ ID NO: 18488 - DNA, 735 bp, Diabrotica virgifera
  misc_feature (2)..(15): n is a, c, g, or t
  misc_feature (20)..(533): n is a, c, g, or t
  misc_feature (540)..(577): n is a, c, g, or t
  misc_feature (597)..(610): n is a, c, g, or t
  misc_feature (613)..(635): n is a, c, g, or t
  misc_feature (643)..(665): n is a, c, g, or t
  misc_feature (695)..(727): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggtgggtnnnnnnnnnnnnnnnnnnnnnnnnnnnnnnnnngaaaggac

SEQ ID NO: 18489 - DNA, 136 bp, Diabrotica virgifera
  misc_feature (6)..(30): n is a, c, g, or t
  misc_feature (66)..(66): n is a, c, g, or t
ccgctnnnnnnnnnnnnnnnnnnnnnnnnntcccttgaaacgactaccaccactaaccaccaaagntcgaggaagggagcggggaagaatccaggaaattcatcaaacgtcaagatcagaagagatcagaatctcg

SEQ ID NO: 18490 - DNA, 902 bp, Diabrotica virgifera
  misc_feature (790)..(790): n is a, c, g, or t
  misc_feature (797)..(797): n is a, c, g, or t
  misc_feature (841)..(841): n is a, c, g, or t
tgatcgttcacctgttgttgtgaccttttcgtgtttgagtgcaatcatttttttgtccttaagaatggctgttgactggggatattgcgaaattaacggacctcactcatgggtatctaaatttcctgatgctgctggagaacgtcaaagcccgattgatatttcgcctgtgagcgtaacaaaattccataccgaagaaaggctgcaatggaaatatgaaccggaatcgtcgactaaattggaaaatactggagctgcttggaaagttggcgttaaaggcaaaggatcagaattaaaaggagggcctcttgatgatgaatatgtgctggaccaattccactgccactggggagaaacaaatgacaaaggatcagaacacacaattaatggtgaaccttttgctggagagcttcatatggtacactggaactctgctaagtatgccgacattaatgaggctgcaagtaatccagatggattgagcgtgttgggagtatttttaaagcctggaaagaaaaatgacgagttggaaaaagtagttaaatacttggatcagattacacataaaggagatgttgttgaaattcccgaatcaattgatccaaaattgctaattccgaaagataccggagggtattacacttaccatgggtccctcactactcctccatgttcagaatgtgttatttgggttgtcttcaaggaaccgatagaagtttctgatgaacagttgaacgccttcagacaaatcaggaagtacaacaaaaacgacgaaatatgttgtgacgcnaactgtngatggtatgtaaagaagaatttcagacccacggtgcccattggnggagagagaagtaaaagaaatgcgacataaaagggtatggaaagttttgacagattatttt

SEQ ID NO: 18491 - DNA, 907 bp, Diabrotica virgifera
  misc_feature (862)..(862): n is a, c, g, or t
gaggcgtagaatttcttaaacaagagacctacctgacttatgaaatgatcccttgtttttgtaatttcacacctcgaacagtagcatccctccagctgagctgaatattaatgagtctcttggacagctggtactactataacacataagaaagtatgtcatttcgcgcaattttatatcacaaaatgccactttcttttgcaaacattaaagtttttcagttcccattttgttcgctatataatcgatatgttgtatttttataggaaaacttctctacaactaaaatttaaactgaaaagtgggttggattggttttcctttacaggtgtgctcgctagctctgctgaggaagtgtgtaagacaaaaacagctatccagggattgtgcatccctctgaatcgaaagcaagtctttttcttaactaaaatttaatttgaatctatacaaatctatatatacaaatagtataaaataaaaagaatttcgtcgattttgtgaggaattgtacctacaaagaaaatttggtaaaacatttcatgagattatcacaaatttgttactattttaaacatttatatcgttagttaaagatacgtctgtgtaatattcctatgtctttaaaggttttcgcttatgctatagagagcaaaataatggaaatgcatctaggatatttttaagggatgtttcgcatattgatttgtcttggcactttagcagtttaaaaatcgtttagagcgttgtaggtcaaataatataatgtacttatttattaccaaactgttgatattttagataaaattgttaatttggatttagcaacaaataatgctcatttttaaaggcatttttgtccagntttaaacttttaataaatgttttaattattttgtctcctacctcg

SEQ ID NO: 18492 - DNA, 519 bp, Diabrotica virgifera
  misc_feature (9)..(51): n is a, c, g, or t
  misc_feature (78)..(147): n is a, c, g, or t
  misc_feature (149)..(176): n is a, c, g, or t
  misc_feature (198)..(215): n is a, c, g, or t
  misc_feature (217)..(239): n is a, c, g, or t
  misc_feature (270)..(304): n is a, c, g, or t
  misc_feature (319)..(340): n is a, c, g, or t
  misc_feature (350)..(369): n is a, c, g, or t
  misc_feature (388)..(424): n is a, c, g, or t
  misc_feature (432)..(491): n is a, c, g, or t
gttaaatcnnnnnnnnnnnnnnnnnnnnnnnnnnnnnnnnnnnnnnnnnnncatatttagtaaatatatataggttcnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnagccccgggattttgacgcgcnnnnnnnnnnnnnnnnnnannnnnnnnnnnnnnnnnnnnnnnctaggaacgagctgatggaaaataaaatggnnnnnnnnnnnnnnnnnnnnnnnnnnnnnnnnnnncaaaaagctcaaacnnnnnnnnnnnnnnnnnnnnnngctcctacannnnnnnnnnnnnnnnnnnngaactttttttagctatcnnnnnnnnnnnnnnnnnnnnnnnnnnnnnnnnnnnnngggcgggnnnnnnnnnnnnnnnnnnnnnnnnnnnnnnnnnnnnnnnnnnnnnnnnnnnnnnnnnnnncttctccccccatttttttcttggaaaa

SEQ ID NO: 18493 - DNA, 53 bp, Diabrotica virgifera
  misc_feature (10)..(50): n is a, c, g, or t
cttaatcgcnnnnnnnnnnnnnnnnnnnnnnnnnnnnnnnnnnnnnnnnnata

SEQ ID NO: 18494 - DNA, 819 bp, Diabrotica virgifera
  misc_feature (44)..(61): n is a, c, g, or t
  misc_feature (785)..(785): n is a, c, g, or t
  misc_feature (809)..(809): n is a, c, g, or t
aaataaaaaacagaacagagttcagagtgcaaatgctataaagnnnnnnnnnnnnnnnnnntgggtgcaaaatataaggaaaaatggctttaaaaggactcaaagtaatagaattttcagggttgttgccagttccttattgtggtatggttcttgctgaatttggagcatctgtaattcgaattgataagattggatataattctaatttggactgtttaggaaatggaaaacaatcaatgagtctgaatttaaaacattccaaagctatcaatataattaaatccctaacaagagaatctgatgtattaattgaacctttcagaaaaggaattatggaaaagctaggcttaggaccaaaggtattaatgaaggagaatcccaggttgatatatgctagactcacaggatatggccaaaatggaagcttcagttcaaatgcttcatgatataaactatgttgctttatcaggtctactgtctttatttggtagatatgaagagaatcccctccctcctgtaaatgtacttgctgatattggaggtggaggtctcacatgtgccatgggtattctattagcactcatagagagaagcacttcaggtaaaggccaaattgtcgacacatccatggttgaaggtactgcgtatttgggaacttggttttatagaggaaaaaatactcttcctatatggggccagggaagaggtcaaaacgtattggatagtggaactcacttttatgaagtatataagaccaaagatgacagatacatgtctgttgnagcacttgaaccctcattctatgnataactaatt

SEQ ID NO: 18495 - DNA, 364 bp, Diabrotica virgifera
  misc_feature (12)..(32): n is a, c, g, or t
aaagggtgtcgnnnnnnnnnnnnnnnnnnnnngaaccacacaaggcaactgtttgctcttggtagagctattaacaaccaagttgtaagaaatgcatccgttgatgtaggacctaggaccgccaggctaaaggaacttcaaaagaaattacaggttgacgatggagtaccagtccacttaaaaggcggtgttaaagataaactcctttaccaatttactctccttttaacagttgttggtttaggtatgtctgccgaagccatttacagaattatgactggcaagaaataaacatccatgtgttacttagtttaaatagtacctttatataatataatttacttcagaaataaatgtaattaat

SEQ ID NO: 18496 - DNA, 519 bp, Diabrotica virgifera
agcttattagctgtgtttttctgtctactttttagtgatcaacggaaaaatttactattagtgaagatgaaattgacaaatgagttgctattgtcaaatgtatcttcctgacgttccccctccaatgtacctgaacgcagagagcaatgacaaaaatcgtttgagtactcgaatacattactttttttgttagaagatgtgatatacgattgagatagttttataggaaatttgaaacaaccaaatattatgtaagcattatagatgaccctggacacagaaagtaagttacgataatgatatgtaggaaataattagagtaactgatctgtacgctatgtagctaatatacaaggagaatttaaagaacactataaaaagaattttcatagacgtgaactagttaatgttgcttccacgattgctgaataacaacttattgctgtggtcaaatctatggaactcaaaagacctagcctacataacgtctggaatcaaggaaatcggaaaggaagtatc

SEQ ID NO: 18497 - DNA, 221 bp, Diabrotica virgifera
  misc_feature (2)..(159): n is a, c, g, or t
  misc_feature (165)..(208): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttannnnnnnnnnnnnnnnnnnnnnnnnnnnnnnnnnnnnnnnnnnngttttttagtatt

SEQ ID NO: 18498 - DNA, 828 bp, Diabrotica virgifera
  misc_feature (762)..(794): n is a, c, g, or t
ggacgatgtgttggtagaggtgtttaaaatttatacgtgtaatttcgtggtattcatagtttaaataacaaacaagatgttgcatctaagaaaaggtgtattattaacgctgtttatttatgtaattcatggatttcgtgaaatccacgcttcttcacaaaagtatgtaacatgtggctcggtggtaaaacttttaaatacagattatagagtaagactacattcacatgatgtaaagtatggaacaggtagtggacaacaatcggttacagggactgaagttcaagaagatattaacagtcattggttggtaaaaccagctactggaaaaagcttagaaagagggacgccgattaaatgtggttcgaccatcagattagagcatgtagataccaaaaagaatttacattcacatcatttttctagtcctttgagtagtaatcaggaaattagttgctatggagacaatggggaacgagattccggagataactggatggttatatgttcaggtgacagttggcaaagggatgaaagtataatgtttaaacatgtagacacagacatgtatctgtctgtatcaggtagaacttttggtagaccaattaatggtcaaatggaagtaattggagtacgctcatctacaggatcggtgcattggcaaacagctgaaggtgtgtttttacatgctccagatttatctgctcgacatatgcactcagttcattctgagctatgaaacaaacaattattagttacagnnnnnnnnnnnnnnnnnnnnnnnnnnnnnnnnntgtgaaaatgtttgtaataaacatgtggttagat

SEQ ID NO: 18499 - DNA, 161 bp, Diabrotica virgifera
  misc_feature (3)..(39): n is a, c, g, or t
  misc_feature (44)..(65): n is a, c, g, or t
  misc_feature (67)..(143): n is a, c, g, or t
gcnnnnnnnnnnnnnnnnnnnnnnnnnnnnnnnnnnnnnggggnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnccttagaggaaaacaggg

SEQ ID NO: 18500 - DNA, 312 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattaggattgaccaccctcagtgttctcttgggtgtagatattggatctgaaaaaactatggatactgaaccagcg

SEQ ID NO: 18501 - DNA, 685 bp, Diabrotica virgifera
  misc_feature (82)..(105): n is a, c, g, or t
  misc_feature (339)..(386): n is a, c, g, or t
caaaacatcaacaattttttattattttgaatagaacttatcactactgttaacaaagctctttaggtacacaatatttggnnnnnnnnnnnnnnnnnnnnnnnnctactacactaaggtatccaacaattctttggtttggtagacatattgggttttactcttccttttctctagatcaaattgttgcattttggtaaacaataaggcttgaagcatctcatgctcttgatcctcatttactaactctcggtgaagattctccaaaaatactctcctagtttctaacttctccaaagtttcttctaaaactatttcattgtgctgcatctcacaagnnnnnnnnnnnnnnnnnnnnnnnnnnnnnnnnnnnnnnnnnnnnnnnncttcctctttgttcttctcgttcttctggtatttttttaagtttgcctctagccgtactagattctcttcttctttcagtagtcgtttattaagtttgttaattttttcaaacaggccgacttgctctttaattgtacctccgcttacagttgaactagaatcgtcgacctttgggtccttgattgattcctcgaaatatgaagaatctgtttcagagagtggatctcatctcccagcctgtgttgccgcaaatccataatgctctgtccgcacgcaacgtcaccacactattcactga

SEQ ID NO: 18502 - DNA, 862 bp, Diabrotica virgifera
atactttgtggccgtcaagatttgctggaagaaaaaaaaccagaaaatttatttaagagtcatcgggtctgtgcagcacattttgaaccaatatgctttgtaaatgatcttcgaaataggctacaaccatgtgcagccccaacaatacttcctgtatcgacagtcaacagtccattagatcatgcagcgtactgtgcatttgtactggagaaaaggtttggtaaacctgtttctccagttaatgataatgatggtggtgacgacgttattgataatgatggtggtgatgtcgttattgataatgatttttatctggatgaaaatgatgttgatgaagttccatctcaggatacgggccagaacattcaaaaagaagctgaaggtgttgaaaggcatcatgtagcccaaaaaagtgaaattataaatgtctcaaaaatgactacggaaactgttttgctctctgagaacaaatctttactgcaaaagcgtctggaagagagtaaagttttacaagtagaaaaagaacgtgagaaacgccaatccacagatcaaattaaatgtgataataccaccattacacagaaaaatgaagcatctaataaagaaaacatttcaaatcgtttcattattacgaaagaacaattggagcaaaagtgtcggacttgctttgttagaagtggaacaaataatgtatggattaaataccatgatggaatgatattccgagatatattgaaaaatttttctttagttgagattcatcgatcggatggtttacctcaaagcatttgctatgtttgcacaaactatattataaaattatgcacgttaaaaatgaatattgatagacccttgaaaaatc

SEQ ID NO: 18503 - DNA, 817 bp, Diabrotica virgifera
  misc_feature (277)..(326): n is a, c, g, or t
gaacaactgcagagtggtgtgtacaggctaacttgtggtgactgtccgaaggcgtacatcggtcgaactggcagaacttttgacaaacggatggcagagcacaagggggcattcaacagtggaagggcagacacttctacatgcgcacttcgccttctggatcatgatcattctttcaatgaggagtttggaattctgcatattcaaaatagaggccttgagctatcttttttagagtctatggaaattgataagctgaggaatacagatgtaattnnnnnnnnnnnnnnnnnnnnnnnnnnnnnnnnnnnnnnnnnnnnnnnnnnttgaagattgggaaggcaaacacattgtgaactgtattacttgagaggcgcactccgccgaagcggctgtggtcactgggatataatggattttgtggaagtgtggaaggcaaacgttttcagatttttattgttagataaaatgaacttccatcaaggaacggtcgaatccatcaattacatacaacagtagttgtgacactttatagtcttgtttcacttttgataaagttaggctaggtgttcacaatttgtatctagtttagaatcatgaagtttgttccaactcgatgcaaaaccgttcttgaatcgttacgtgcgtgcgcaataacgaataattatgcgtagtaacatattttcgttgctgcgcatgctcgtcaccgctcagaaacggttttgtgtcgagctgagacaaaagaaagttgttatatttctagaaaaagaaataaaggatgttggctacattccatgatattcgtgatactttatat

SEQ ID NO: 18504 - DNA, 883 bp, Diabrotica virgifera
actcaccaatttttatgaaaatcgatggaggttcaacgaaatctgaggtaataactcatatccaccttcattgactccactatttattgatctgccataaataattaacatataatattactcatgaacacacgattcaaaaacattttcggcgttgacactaaacaggattcttccaaattatctgtttactaaacatgggactatttacgtttagatttttgtacttcacagagttgccagatttgaatttgcattccaaaatgttttatagttttttggtcaaaaggttgaatttagaaaagggtgttataggagttttttgttctacatggtgccttttacctatacctttgaggagcgcactgttttccgggacaccctgtatacatatatgtgataagttaggtctcttaagccttaacagtactttatatttattttatagttaatagtttcaatagtcattaaacattttcttatattttgttgcaattcccctattttctgtttttcattttatgttcaataaataattgtacagtagaacctcgattatccgtcagggcaccggaccaagggtatgacgcataatcgaaaagacggttaacagaacattaaaaaaagttaaaattgataatacaactctcaaattttatttgtttgttatgtttgataatacaataagaggaatttgtgttcgtgttaatattgtcgaatttggtttaaaatattctgaaatctttgtttgttttactgatgcttcacattttgcaagggctgaattttttaatcggcgtaaaatcatgcaatctactttattggattcttcttgtcgagaataccacttgatgaatgggtgcatgtgtgatgcagcttctct

SEQ ID NO: 18505 - DNA, 187 bp, Diabrotica virgifera
  misc_feature (10)..(185): n is a, c, g, or t
gctggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngt

SEQ ID NO: 18506 - DNA, 824 bp, Diabrotica virgifera
  misc_feature (14)..(31): n is a, c, g, or t
  misc_feature (65)..(87): n is a, c, g, or t
  misc_feature (313)..(333): n is a, c, g, or t
  misc_feature (412)..(431): n is a, c, g, or t
  misc_feature (496)..(544): n is a, c, g, or t
  misc_feature (677)..(677): n is a, c, g, or t
  misc_feature (684)..(704): n is a, c, g, or t
ggtcatcctgaagnnnnnnnnnnnnnnnnnncaggatttggattaatttctcatattgttaggcnnnnnnnnnnnnnnnnnnnnnnntttggtactttaggaataatttatgctatgatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccattaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattgnggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 18507 - DNA, 767 bp, Diabrotica virgifera
  misc_feature (2)..(95): n is a, c, g, or t
  misc_feature (97)..(214): n is a, c, g, or t
  misc_feature (216)..(613): n is a, c, g, or t
  misc_feature (615)..(687): n is a, c, g, or t
  misc_feature (734)..(757): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnattgtattgagagctggaatgaaggattggatgaaaaatgaactgannnnnnnnnnnnnnnnnnnnnnnnctatttttaa

SEQ ID NO: 18508 - DNA, 913 bp, Diabrotica virgifera
  misc_feature (365)..(383): n is a, c, g, or t
  misc_feature (670)..(689): n is a, c, g, or t
  misc_feature (783)..(783): n is a, c, g, or t
  misc_feature (851)..(868): n is a, c, g, or t
cggttattaaaaaaaatctcagggatgcaaccgagataattcaaaaggactatgaaataaaaacagctaatcaatttttccacagaattttttaaatttgtgagaaagaacaacgcttccattcacctccgtataattccatctaagcaaggatttgttgttaccggaataacaacaaacaaatcaatacatgtaggtacatacctacaaactgataaaaaaatcttgaaaatcggagtacaaatagtgaagttataaattgttaaacttaatcaagaatttttagtggcggagttttgtgccggtgagtgtattttcctacgaacttttgctatagaaattttaagattgcttctttaatttcnnnnnnnnnnnnnnnnnnnccctaataaaattatcatttattaaacggcgtacccatgtcgcaaggctgcggcgcgcggcctggcacgagaggcaaacttggtatttgcctcgcgcggtgcatcctcatgattttattttaaatcaacttgtgccgcgcgcttcatttccaaaagtttcctgattttctttgtttatttttaactcacagttgaactgaaaaaattatattagagtaggtacaattattagcgttagttgttttgtaaaatattttcttttccaacattttaacttgaagcgcacnnnnnnnnnnnnnnnnnnnngttgaactactaaaatgatttagagtacatgacttacgatcttacgaaatatcccttgtagaaaaaacttttctaaaatagaacatcataattnaaactttccgatattctccttttttataaaagccaaaacaacgtgtttattataaatacaatatgccnnnnnnnnnnnnnnnnnncttggcaaaaagtattggaatatttttttacgcggttctactaac

SEQ ID NO: 18509 - DNA, 704 bp, Diabrotica virgifera
  misc_feature (523)..(546): n is a, c, g, or t
  misc_feature (577)..(595): n is a, c, g, or t
ataatttgctgggagctttcaaccgatgttctacacactgttgttgttgttttatgttctatttaggatatagggtaggattctttattagattagggtcaggacaggttttgttatttctgtttaggattttggtggttcttctccaggatttgtggttgatttttagagtgtatcctacaaataaatgccaaaaattaccactgggtggtactttctgggcatttggtgatgcggatggccgttgagatgttgagtcagagcagaaagatgctggttggacgttgttgttctttccagttgtgtagtgaaagtttatatatacagtgatgagcgcgctaatatccggataaataacgcgaaagatggataacatagagagatcattgtgaaaactatggaatgtatatttatacgattatatcgtttatttccacttctactagtatcatctttttgcttaacaatggatcatgtattccttcttttgagtatttttgacgttttttacactcatctctgnnnnnnnnnnnnnnnnnnnnnnnngatgtgatatgacgatacatttatctggtcnnnnnnnnnnnnnnnnnnngatgattttttgatcctttttttacgattatgagaatactttaccttaaggatatcagcataattcgatagtggagtgcaaatctaatatatagattgcgaactcgatg

SEQ ID NO: 18510 - DNA, 915 bp, Diabrotica virgifera
  misc_feature (772)..(772): n is a, c, g, or t
gccgctgagtttcttcagaggactactagcattgtcacattggaggtggcaaaggccggagcggtttatcatggtctagctacgttgttacaacaacccagcccaacaccacatcgaggtccaagacggatgtcggagcgcgacctgccatctagggtagattctgaacgttcgatcccctcttccaaatctgttcccgcccttcaccaaatccattcccccctcgttaatgaacaacaacctttaaggccaaatcagacttcagcttcagatgtatacagtcgaacttcctcaaacaacagcattaacaataatcaaaatgggcaagtactaatgaacggaggatcagtagctgccaatacggccttgcggagtagatccacgcacaatttgcatcaacaggacggagggttttatcagaacttaagcgtttacaggaataaaattcccagtcctcaacaattgggagatagaacttcagctcttcgcagctcacagaactcacttcactcatccatcgccaactcccagcgcccttcttcggcatattatcctccagcctcttcaataacttcccgacctaacaacctccatcagtctatacccaatctcaaaaacccacctaatatgtacagacttcaaaatgacgaagcttccagaacaggatcgttcccaaatgtccagtacagtccaaactacttccctgcatattcaaaaaatagttatcctagccccgaagagactaaggtgccttataacaacacttacatgnggcaaaatcagtcgtatccgagtcccacaaacagttctacacaaggatatccgaacagcgttcaacaacccctgcatatcaaccataacttacgaccagaagaaagaaatcaagatgtaagatacaacaatgggaggtttatt

SEQ ID NO: 18511 - DNA, 437 bp, Diabrotica virgifera
gtaatttacttaattcaaaatacatgttactactgtcagaaaagagaaagaaatgtttatttgacaaattaaataatctaaacgggaactgttgtttccgtcggcggcctgtcgtttttgaatattgtcagtgggagctgtttgtgagaatggtagccattttgtagaaggcacattaaatgtgattttttgaacatttaagggtttttgccctaaccagtggttgtatccctgggtttattttagactggggaatgtgtttgttcgaagttttctcttcttttgaggtttttacacctataggacgtaagtttcactttgtggttttttatgaatgagatttttcaacttagtctttttgtgttatggctctgatgatgttatagagtcgctgagggggattggatgatttagaagaatagattgcgcgatgatga

SEQ ID NO: 18512 - DNA, 723 bp, Diabrotica virgifera
  misc_feature (5)..(569): n is a, c, g, or t
  misc_feature (576)..(613): n is a, c, g, or t
  misc_feature (649)..(671): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattagagtgtataattggnnnnnnnnnnnnnnnnnnnnnnntgttcgacttttaaaattgtacctgatctgaggttaaaccggagtgagccag

SEQ ID NO: 18513 - DNA, 592 bp, Diabrotica virgifera
  misc_feature (450)..(482): n is a, c, g, or t
  misc_feature (484)..(497): n is a, c, g, or t
gcccctctagcgtccgaccgtgtgccgacgacgtgagacgcgaccttaaaataccagacttatttacatattattgtattttgttagtagagttgaggaagatgtgcaaagtgttgaccagtttatgtacatgaattgtttaaactaattggttagatgtgattttagctaattaatgatttatttattaattgtgtatctaatataggtttgaagttaaaataggtgttgaattgtagatattgtgcggaatattgtttgcaatggtgtggtattgattattataaaagtctatttttttaagtatgagttttgatgatattactaatcaaaatatatatgttttgagaggttttatattaggagttgtaattataattaagccccccgctactgaataaatttttattaagttttaatttgtagagtgaaattatacttaattactannnnnnnnnnnnnnnnnnnnnnnnnnnnnnnnngnnnnnnnnnnnnnngaatcttatagattttttattaaaattggtattttagttatttatatactagtagtagggatacgataattattactcgtgtaggagatttattt

SEQ ID NO: 18514 - DNA, 113 bp, Diabrotica virgifera
  misc_feature (15)..(33): n is a, c, g, or t
  misc_feature (42)..(56): n is a, c, g, or t
  misc_feature (58)..(74): n is a, c, g, or t
  misc_feature (77)..(95): n is a, c, g, or t
atagggtcttctcgnnnnnnnnnnnnnnnnnnnctttttaannnnnnnnnnnnnnncnnnnnnnnnnnnnnnnngannnnnnnnnnnnnnnnnnncccttcattccagctttc

SEQ ID NO: 18515 - DNA, 170 bp, Diabrotica virgifera
  misc_feature (2)..(169): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 18516 - DNA, 655 bp, Diabrotica virgifera
  misc_feature (15)..(142): n is a, c, g, or t
  misc_feature (144)..(251): n is a, c, g, or t
  misc_feature (253)..(280): n is a, c, g, or t
  misc_feature (282)..(317): n is a, c, g, or t
  misc_feature (319)..(407): n is a, c, g, or t
  misc_feature (434)..(461): n is a, c, g, or t
  misc_feature (481)..(494): n is a, c, g, or t
  misc_feature (497)..(519): n is a, c, g, or t
  misc_feature (580)..(607): n is a, c, g, or t
  misc_feature (621)..(654): n is a, c, g, or t
ctttttttcacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnncnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttacggataacagcgcaattttannnnnnnnnnnnnnnnnnnnnnnnnnnntgcgacctcgatgttggatnnnnnnnnnnnnnnggnnnnnnnnnnnnnnnnnnnnnnntgttcgacttttaccattttacatgatctgagtttaaaccgctgtgagcccaggttggttnnnnnnnnnnnnnnnnnnnnnnnnnnnnctacgaaaggaccnnnnnnnnnnnnnnnnnnnnnnnnnnnnnnnnnna

SEQ ID NO: 18517 - DNA, 874 bp, Diabrotica virgifera
  misc_feature (420)..(434): n is a, c, g, or t
  misc_feature (851)..(851): n is a, c, g, or t
cttaggcctacatatgggcaagggactcacttggaagactcatatatggcctaagtactttacagtatctaccgttgaaacgggagcattgttgagtacttaggcctacatatgggcaagggactcacttggaagactcatatatggaaaaaaagaaaacatcttgataccatatatagaaaatactattggttgctcggaagaaaatcccagttgttgagaaataaattactagcatacaatgccatactcaagccaatttggacgtacggaatacagttgtggggcactgcttctaaatccaatctagcaatcatgtaccggtttcaaaacaaggtgctactagcaataactgatgcgccgtggtttgtaagcaacaaagacatcctacaataccttcaagtgccaactgtgagtgannnnnnnnnnnnnnncagtgataaatatttacagcgacgaaaactacccaaaatgtgttagcgctaaatttattggataatagtcaacaaattagacgccttaagcaaaaatttccattagatttaccattcttaagttaagaaacactaattgtaaacgtaattgtaatactcatgtagagtaaatatttattgaaatatttctcttcgcgccattgtaaatttcaacaaatatgtttatggtctgttttttttgactgattgcacagtaaacacacaataaaaaaatctactcatcccagtcagataattgaatcaagaagaaggatgagaactcaaattgagggtccgtgctgtcctataccacagagagcacaggagaacattcgatggcctatctccaaatgatacaaatagtctacaattcacggntatatgtcaactaatttctataa

SEQ ID NO: 18518 - DNA, 618 bp, Diabrotica virgifera
  misc_feature (249)..(266): n is a, c, g, or t
  misc_feature (292)..(314): n is a, c, g, or t
  misc_feature (320)..(343): n is a, c, g, or t
ttggaccatttcttcagctattaattcgtcttgagttttaccaaatcggtctattgcagatttaactcttttactgacttttccttctatatttaaagaatcaactttaaacttggttttgaaatagtctttaatagatttctgactatggttttcctctaatctcttaattataggattcaatatttcttcggttttttttatgatccaaccaaatttttgttgtgcaaaaatggtcagacctataannnnnnnnnnnnnnnnnntaaacgtatctctgattgtttctatnnnnnnnnnnnnnnnnnnnnnnncaactnnnnnnnnnnnnnnnnnnnnnnnntatgatatattctgtaaattattattatgaactgattgaccggcaactcctgttgtacgcattaaagactaacagagaaattctttaaatgcacacaataatagcgttctgttataaaggaaagaccttgtgatctaccgttcacaagtaactaagcacaatattaaattgactagcattgaagggtatagactgaacaagcacgtgcaatagccgctcctacatggtaatgcttccgttgctgatcataaaccatatgaccatattataatgag

SEQ ID NO: 18519 - DNA, 180 bp, Diabrotica virgifera
  misc_feature (2)..(176): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggg

SEQ ID NO: 18520 - DNA, 905 bp, Diabrotica virgifera
  misc_feature (755)..(755): n is a, c, g, or t
  misc_feature (785)..(785): n is a, c, g, or t
  misc_feature (823)..(823): n is a, c, g, or t
  misc_feature (857)..(858): n is a, c, g, or t
gaatcattgtccgaattttctttcttaaagccaaattcaaaaacatttgtgaataaagtaccagatgcttttacgattttctctagtgaaggcgacattgttgtaccaggacagagaccagaagagtttacatcgtactacaaagaacagttaccattgaatcaatttaaaataccacgtgaactagaaaatacattccaagtactactaactaaatatcctcaatttggaatgagagtacctgtactgtacaaaacaatcagtaacatattggagattaccccaggcattgaccaaaataactattttaccaagcttgaaaaactattacacgtagaagaaaatcagttaagaatagacataagaaattatgacaccttgtccactttgaaggttgtcaaaggaaaatccttatatgaactagaggttcctggattggctgaagccaggccgtcccttttacgaaatgataaagtttatataaaagaaaagaagtctgattctgtaaagtatgaaggatgtattcacgtagtacttgaaagaagcgtacatataggattaaatcataggttcaacaaaatatttatccctaacaaaaaattccatatcgaatttggttttaacagaaggtcaatacgagtcgagaaacaagctctatttttagctcatacacatggaattattccaactttatatccgaaggaaattgggattgggttattgactgaagtcaacctggcaatgtcaaacagaanattaaacgaagaacaggtacttgctgttanaaatattgttaagcataggagttatccctttataattnttggtccaccgggactggaaaaacagtaacattnngtggatcagtgtatcaaatttggaaaaatatcccccaatcagaattc

SEQ ID NO: 18521 - DNA, 411 bp, Diabrotica virgifera
  misc_feature (366)..(388): n is a, c, g, or t
cttgaacttgagaattgaaaacttgaatgacttgaataaatacaataaatatatttaactattaataacatttttcataacgcgctgtgtaaaagtttttcgtttttaacgttaaataatatctataaaatttgaaaagtaaatttaattgtatgtcaaatcttgcaacataggagaggtctgtgaaacggcataaattctgacactcgatttttatcatcacaaatatttgtaaagagactttgcttcttgacgttacttgcagacatataaatagacgtacttatatgagaatggcagtatgtaatgatctttgagtcgacttatgttcagatgctttaacatcacgctgactcaatcgaaacnnnnnnnnnnnnnnnnnnnnnnnccagccgatacgcgcaacgatga

SEQ ID NO: 18522 - DNA, 934 bp, Diabrotica virgifera
  misc_feature (859)..(859): n is a, c, g, or t
cgcagcagctctcggtcatgatcccagtgaattgccgctctcaagaagcactattcaacgggaaaggaaggaagcacgaaaaactatatttcaaactattaaagaatctacctcttttgataatcccgtcattgtacactgggatggaaaaattcttcctgatattttgggaagtgacaaggtagaccgtttgcctgtcatagtatcttgtcctgctgacaatacagataaattgcttggtgtaccaaaattagttggtggtactggtgaaaattcagctaatgctgtttacaaaaagcttactgaatggggtttgggtaaaaaggtagtgggtatgtgttttgacacaacatctgtaaacacagggttgaaaaatggagcttgtgttctgattgaacacctagttgaaggagaattgttatggctagcatgcagacaccatgttttagagattgtactcagtaaagtatttactttctgttttggtccctccagttcacctgatatacctatattcaaaagattcaaagcagcatggcaatatatcagacaagatagttatcagtctttgggaaacattcctggcagtgaagatttcaaacaatctgcagttgatgttctccaagttgccttaaaaggcaaaaatcagcctcgggatgactatatggagttgattgagctggctttaattgctttaggccacactccagccaaaattcattggagagctcctggtgcggtacaccacgcccgttggatggctaagttgttatatggcatcaaaatctatttgtttcgtgatgacagtggtttcgtgacaacgcaaagggagaaagctcagcttgaacgctttgtgaanatttggagttcttgtctacgtcaagtactggggtagaagctcctttagcttcaaatgctccatggtcagatctct

SEQ ID NO: 18523 - DNA, 74 bp, Diabrotica virgifera
  misc_feature (5)..(5): n is a, c, g, or t
  misc_feature (10)..(62): n is a, c, g, or t
gtaanaagcnnnnnnnnnnnnnnnnnnnnnnnnnnnnnnnnnnnnnnnnnnnnnnnnnnnnntagtttttttag

SEQ ID NO: 18524 - DNA, 797 bp, Diabrotica virgifera
atactctttgccagtgacagagaatgctctttttactcctcgcgtattgtctccaacttgaagggtattcgtatcttaagaagccacaataactcacatcgttgtaaggcatgttctctgctcgacgatagaacaaagaatcgctcgtctgtatggacagactaacgcgaatgctcacatctgaccacacttcgcaatcaatatggtggcgcttacactccacacaagatccgaactacgatccgcgacaaggcgtgttgaaaaaactgaaaaagatgtgctccccgctgcctcttgattatgatgacactgctcttgtagaacaacaatatgatgaacttcgtatacaacttgaactttctcattgcccatttgaaatcgacagagatgtccaagagacagaaaaaaaattcgaatacacccgcaagaatcacctacttcgacctcgactccatgcaagtctcgcttgttatgaaatgaaaggaaacagctgaagcccttcttatgaagaatagacaccgaagctgatatcactgaattggaatattctttggacctccctagccaggctaccgctgatgctcaaaacatcgtctggacgtctcaccaattacaacattattgacaccacccacctgctcttgaacatcgactatgagctcgagatgaaggccgagaacgacttgaaatttctcatcgtcgagctgacggtcgtcactatggacgtgtcgaatctcgcactcgtctctgacatctctaccgtgctcgccgctgatgtgaacactaactgggagatg

SEQ ID NO: 18525 - DNA, 1073 bp, Diabrotica virgifera
  misc_feature (621)..(621): n is a, c, g, or t
  misc_feature (1018)..(1063): n is a, c, g, or t
acatgctgaaaccacaatcagaccatctttattattcacttggtctggagcgttgacagtgatagtctcgtgagattcgagaatggattcaaaacatttacttattacagaccgtaaaaaaattcgtgaagcgtggggtaaaagtgatgaagatgtgatgcaagatattcaaattattagggtttggttaggtacacagaaacatcttcctgaaataccaactgatgctatgatcgagttttttttaacaaattgtaaatatagtatagagaaaacaaagcaaaatttagatatgtactatactgccagagacttggtacctgatgtataccgcaacattaatccaaccataccatctcaagtagaggcagcgtacgcaacagcgtgcctggtaatactcccaaatttaactccaaacctacacagagtctcaattattcgatttaggaatgatatgctccaaaaagcagacattaacaaatttaatgctaattctctatcaaatttttatgaagttcgaatccatgaagatttaacaatgggcgatgtaactgtaatcgattacgaacactgctcatttagtgttatggctaaactgtcactggtagccatgaaacagtngtgtgtttgtttttgagaaagtacaaagcagcagacttaaacaattacatctacttaatcctcctgcttttgtagataaaattctaacacttttgaaaagtttcatgaaaagtaaactaaaagaaaggatttatatacacaaatcaatagaagacgtttatcactatataccccaagatacgctaccatcggattatggtggaaaagaaaatctatggcagaatagaagatatatgaaaaaggaaattttggagtcaaagaccggtttgatatttgacaaaatacagaaaatgagctttgagaccgaaaaactaaaaatgatgaatggtaggttactacgggaatttttagaaattcaaattgtttaaaataatccaaagaaattaaaaacgaaccnnnnnnnnnnnnnnnnnnnnnnnnnnnnnnnnnnnnnnnnnnnnnnattttttttt

SEQ ID NO: 18526 - DNA, 211 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (178)..(178): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttggtttctatcttttatttattnaatatatttagtacgaaagggaccaatatataa

SEQ ID NO: 18527 - DNA, 688 bp, Diabrotica virgifera
gagtacccggatggatatcataaagatttaaaacgaaaaagaactgcaaatggatgacactcaaaatcaacctagtcgaacctagaacataaaaaatattggggacactatccaacatgcttctcaagaacacaaaaaaaccgacaatggaccctggtagtaaaacaagtacgctactatggatttgataccgataaaaatggaccccattaccgaccctgcagaccaacgtatgaataactggaacgaaatttacaacgtcactcatgtgactacaagtctgcggacacaaccagaccattgaatgaaaagcaaaatacccttctgccaatctaatagtcatgaatgacctttgaacaaatatgattccgacatgacagcttctgatgtaccaggaatcaatggatacagcatgtgaaccatcatctgcacacgaataacttccccgattatacaggacggatagagaacacaccatgatgaggctgctcgtgtacttgagatatctgcacccatcgcatgccatctgcaatatcgaatgctccatatccgaccacacgtgcaagaacgtttgcattgagcctcatatcccaacacatctgactgaacgctgtgtatgggaagaagtgtactgttcctgctgataggtatagtgatgaaccctcaatagagacgtacatcattactt

SEQ ID NO: 18528 - DNA, 896 bp, Diabrotica virgifera
  misc_feature (4)..(738): n is a, c, g, or t
  misc_feature (766)..(786): n is a, c, g, or t
  misc_feature (804)..(804): n is a, c, g, or t
  misc_feature (852)..(853): n is a, c, g, or t
cccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctccatgttttcgcaatctcaagtannnnnnnnnnnnnnnnnnnnncaacttatggaccacgancaagatggcatcatctctaagagcgatttgagggcaccttcgatgctnngtgtaaactcggcagtgagaaagagctcgacgagatgatcaac

SEQ ID NO: 18529 - DNA, 881 bp, Diabrotica virgifera
  misc_feature (809)..(809): n is a, c, g, or t
  misc_feature (835)..(836): n is a, c, g, or t
  misc_feature (846)..(846): n is a, c, g, or t
ctttcccgttagacagttgaacgttagacgatttttggttttgaaacgttgttagtgacttttttgaaattgtgaaagaaatggctcctgaaatatcacataaaaccaacatccatcctccagaagagcatcctccatcttcagagagcctggcgtccaaagatataagagacaaatgcagagagttgattttaaccaatgaaaaactacacaaattgatgaaagtatttttggaaaatgttcacagaggtttgaaaaaagaaacccacccaacatcgatcgtgaaatgttttccaacatacgtgcaagatcttccaaacggaacagaaaacggcaaatttctagccctagacctgggaggcacgaacttcagagtcctcctcatcgagctcagtggcgaacactttgaaatgaaatccaagatcttcgccattccccaacacatcatgttaggatcaggcgaacaacttttcgatcacatcgccgagtgtctggctattttcgtcaaagaagagcaggtggccgaccaaaagctacctttgggtttcacattcagtttccccttgtcgcagaaaggattgacagttggataccttgaaagatggaccaagggattcaattgctccaacgtagtgggaaacgacgtggtgcaaatgttgaacgaagctattgaaagacgtggggacttcgaaatatcagtcatggcaatattgaacgattccactggcactctaatgtcctgtgcttggttgaatcgtcagtgccgaattggtgccatcgttggtaccggctcaacacctgttacgtgnaaaaacaagcgaacgccgaaacatgnnagcgacgtgnacatgggctctggaaacgtgctgatcaacctggaa

SEQ ID NO: 18530 - DNA, 86 bp, Diabrotica virgifera
  misc_feature (8)..(33): n is a, c, g, or t
  misc_feature (35)..(50): n is a, c, g, or t
  misc_feature (52)..(84): n is a, c, g, or t
caaactcnnnnnnnnnnnnnnnnnnnnnnnnnncnnnnnnnnnnnnnnnncnnnnnnnnnnnnnnnnnnnnnnnnnnnnnnnnnca

SEQ ID NO: 18531 - DNA, 439 bp, Diabrotica virgifera
  misc_feature (107)..(124): n is a, c, g, or t
  misc_feature (307)..(325): n is a, c, g, or t
  misc_feature (336)..(355): n is a, c, g, or t
tattggaataataaaacatccctttaataacacaagcgaatcatgtaattgaatgatagataattagacttgtgagaaagcatatgattattataacaagaaaatgnnnnnnnnnnnnnnnnnnaagcagggattattcattaataatcacatacttatcattttcccaaattaaaatgaggtaacaccattaaccaatggttatagtacgatagagatgttaaacgcgtctatggtaatgaaatgcaattcgaattgtaatcatatctaacttacgaagaaataaactaaaccgatttatgaactnnnnnnnnnnnnnnnnnnngatgctatctnnnnnnnnnnnnnnnnnnnnagggatgagtataagaataaaaatctatgtacagttgaattactttgtaaaaattacgattaagaagagttcatatgcttaaag

SEQ ID NO: 18532 - DNA, 832 bp, Diabrotica virgifera
  misc_feature (586)..(613): n is a, c, g, or t
attacctggatgctttcgaagacgtatcctgcctgttactggaatacatagtaaacatgagtgattatagtgggaacacagccatgcactatgctgtttcccatggcaactttgatgtcgtatccattttgttagattctaaagtttgtgatatcaataaacaaaataaggctggatatacaagtgttatgttagtttctttggcggaagttcggtcccaaacacatgccaacgttgtccgaagactgttccagttagctgatgtgaatattagagcgaaagagcatggtcaaacagcactgatgttagcagtaagccacaataggttgaacatggtcaagatgttgttggaagcaggtgcagatataaatattcaggacgaagatggcagtacggcgttaatgtgtggtgctgaacacggccatatcgaaatagttaaacatttcctttcccaacctgactgcaattcgaccattatggatatggatggcagcacagctctagcaatagctatggaagccggtcaccgacacatcggagtcctgctctacgctcatgagaggaatagccaaaagtctcataacgnnnnnnnnnnnnnnnnnnnnnnnnnnnntagtccgaaaaccccttcctcaccactggctgcaagaagtagccatcgtgccttaacagatacgaaacctaaatagtactaacccatttctaactgtgttttaacttaagaaggtaatgcgtgttgtttcgctgttaacgattctgttaaccatcgtgatgtattcatatacgatggttctagatttttggcatgtaaaatgcatgtttattcagtgtc

SEQ ID NO: 18533 - DNA, 553 bp, Diabrotica virgifera
gggggctctgctgagtgtcagtagctcccttttgtaattgtgaaagatatttatataatgaggtacgattagaattgatcaagagtattgtctgtctatacccacgctttcaatcttttatgtgagtgaattgaaggattgcccttaagaagaattattcgactgttatccactttattattgtttctttattagaattaatatggtataataatgattgtcaagaatattttattgggagaggttgttcgatgtgtaatataacagttacttaagtcatcaataattgataataagtaacgctatgtctataagtatatatttttatgtaaaccattaaatttcatggaatgaaggtgcatggacgactgtgatatttgagcctaacttttgtgctagatatatatattaaaaattcacataatagggaagtctctgatcatgtatattcataggataataatggtatgatttgtaaatatgttgtcacctatttaatatacctgaatatcgcagagatttgattttagtataagaaatcattgattgggta

SEQ ID NO: 18534 - DNA, 944 bp, Diabrotica virgifera
  misc_feature (528)..(550): n is a, c, g, or t
  misc_feature (554)..(572): n is a, c, g, or t
  misc_feature (618)..(638): n is a, c, g, or t
  misc_feature (752)..(772): n is a, c, g, or t
  misc_feature (799)..(799): n is a, c, g, or t
  misc_feature (828)..(828): n is a, c, g, or t
  misc_feature (839)..(840): n is a, c, g, or t
  misc_feature (919)..(919): n is a, c, g, or t
  misc_feature (929)..(929): n is a, c, g, or t
cgcaatcttaagcaattaagtcttaagtcaaattatttgaagcagttcaatacacaagacgttttggaagacttaggatccctacaaatattaagtctcgctattaacgatttgaagtgtgctgatttgagaaatattgacagggaattgaaaagaaagcgagttgacctcgaggaaggtataaataaacaaaatccaaatacataccgaggcataaaatgtactaattaataattataaatagtatatttagggccagttgttcaatcaatggttaactcatggattaagtaaaccatgattaaatttaattcgaagattatttctaattaagttgttcaatgcaggttaactttcggatttattaaacccaaatactgaagcagtgacaatgttgccagttattaattaacgacttggaacaaattttatcatgaaaattgtaccgaaaaatgttctgtggtataaacgatggtgttcatgacttttgatgtagtgacgtccccatgtcagggattgttttcgtgnnnnnnnnnnnnnnnnnnnnnnntggnnnnnnnnnnnnnnnnnnngagaactactagctttacggctaatgaagaagaaatattaatatcnnnnnnnnnnnnnnnnnnnnntattctcgagaataagaaagtgatgcaattacaaattacgagaaaatgaaaatctgggaaaaagtagcccaataggccaaactagtttgtcctgaaatcaggtttggccggtannnnnnnnnnnnnnnnnnnnnctattataaatagttcacctatttgtnagatgagctatcctgtctcttatacgatncacaatcatannaactgtttcctttggtacacgaaatctattcaaaaactcatttatctggcactttatgaaaatggttttcttttactcngaaaacaggnattttttcgtagagg

SEQ ID NO: 18535 - DNA, 202 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(132): n is a, c, g, or t
  misc_feature (179)..(180): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttaaaccggtgtgagccaggttggtttctatctttaatttattnnatatatttagtacgaaaggacc

SEQ ID NO: 18536 - DNA, 59 bp, Diabrotica virgifera
  misc_feature (8)..(53): n is a, c, g, or t
caataagnnnnnnnnnnnnnnnnnnnnnnnnnnnnnnnnnnnnnnnnnnnnnnggggtg

SEQ ID NO: 18537 - DNA, 493 bp, Diabrotica virgifera
  misc_feature (2)..(292): n is a, c, g, or t
  misc_feature (294)..(404): n is a, c, g, or t
  misc_feature (410)..(492): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 18538 - DNA, 686 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(397): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnngctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 18539 - DNA, 852 bp, Diabrotica virgifera
  misc_feature (231)..(248): n is a, c, g, or t
  misc_feature (830)..(830): n is a, c, g, or t
gtgagtaacaattgtcactggtgacagttttatgaattataatgtgatagtgcgtataatgagttcattattcctgttgtgaaagtataaaaactcggttacagtttatatatcaaaatgcctattataatgtgatgtgcgtataatgagttcattattcctgttgtgaaagtataaaaactcggtcacagtttatatatcaaaatgcctctattcttgttaaaaagtggnnnnnnnnnnnnnnnnnncattcttgatagtgatacatttttgtcaaaagtgtttcaattaattgttaaaaccgtgaccagacatctcgtaacgcgacagttcgtaaccgggcaactggtagcgcacaattcgtaacagcgacagttcgtaacggcgacacttcgtaacggcgacagttcgtaactatacaaattcgtaacgggtaattcgtagcgtcaaaattgaattgttctgtttatttttgttaacgtgagaactaactgttattgcagttataattaaaattttgtttattaatttaacgaatcagtaccgggtaaaatatgttcaaaacatgttatttttcgtgtttcagaatatattaacaagtctttaacacaaacaaatatttaaatacacacaaacttttaacaatctttttaaacgtttatccctcttattgttccttaaatttgcatatacctagacaaaggaataatgaagtaattcctcaaatatttaggccaacaaccgtcttcagacattcccaattttctagtaaacattttataaaggaaatattataattatccgttaatataataaaccttgtgattggntatagcgttgggggtattcaat

SEQ ID NO: 18540 - DNA, 532 bp, Diabrotica virgifera
  misc_feature (116)..(136): n is a, c, g, or t
  misc_feature (317)..(340): n is a, c, g, or t
ctcctcgcgtccgattaacaacgtaaatttttaatattatctcttacaaaacataaatgattattataaataaacttgtgatattcgatcattttgaacaaaatgaacgcttgatnnnnnnnnnnnnnnnnnnnnngtgacactgactgtatagctgaagaaatatacaaatcagtgatgtgggtggcaacaactcccaaaaaaatctacgcaatataacacccccttgctaatgaatgaacatacttttatgactcacccactgcattgtaattatgaaaagatgaaaataccatccatccacattgactctgtgnnnnnnnnnnnnnnnnnnnnnnnngtttttcttataaattcctatttaaacagaaatagatttctgaaacttaatcactcataaaaaatcaacttttatgcacgaattaacacctgacagaattgtataaagatatcttattttctacgatagtttatgatttagaacattttcaacataaaccttaatagaaaaattcttttcctgatcacgaaa

SEQ ID NO: 18541 - DNA, 214 bp, Diabrotica virgifera
  misc_feature (14)..(38): n is a, c, g, or t
cgctaaggaagctnnnnnnnnnnnnnnnnnnnnnnnnnctgcaatgaagggccggccgataaaaaaaatgcctttattaatttcataaaaagtttttcttttagccttacagtttcaattctttttaaagaagcgaagcccccatttagctgtttattctatctatcaacgtctgttcctttccacctcttctcctcttcctctccccctcctt

SEQ ID NO: 18542 - DNA, 850 bp, Diabrotica virgifera
  misc_feature (702)..(723): n is a, c, g, or t
  misc_feature (824)..(842): n is a, c, g, or t
ctcttacgcgcccgaaaataacatagatctgacttttttatgaatatttcttaaacgccaaaatgtctttccttgatgtagatccctggctgtatgaatatgagtgttgcgaaaaattatatcgggatataatggaactacttacacaaagagaaaaatatccaaggatcagtgataattattctaaagcatcagctgttgtccgattgcgtttaaaacaatataatgaagaagttagtcagttacatctaaaattggaaaataaatctggcacagggagcataacacctgcagagtttgagagaagaactagacaaattgaaaccttacattcaaaaagtattcaaatgaaaaaaattttcgatgaacaagtcgttagtaaatcacaagaagatagaaaagatttgattggatttggtacagccaacctagatggtccaagtacaagttactcggtaaatgatcttaaggaagcccaaaaacgaatgataggacaacaaaatgagggactcgaaaatttgtcaaaaattatttctaggcaaaaagatatagctactactataaccaatgaagttgattaccataatgatctactggatgatttgggaaatcaaatggatcataccgacactatactaggtactgctacaagacatatcgaagttgtggacagaaaagacaaaacttgtgtatattgggtgnnnnnnnnnnnnnnnnnnnnnngcattgtaacagtttctgcaatttaatagataataatccataccaaagcttttattaatcagatttattataaacatatctttattgtgaatagtatggcnnnnnnnnnnnnnnnnnnncatttatg

SEQ ID NO: 18543 - DNA, 939 bp, Diabrotica virgifera
  misc_feature (3)..(936): n is a, c, g, or t
aannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 18544 - DNA, 872 bp, Diabrotica virgifera
  misc_feature (11)..(30): n is a, c, g, or t
  misc_feature (76)..(96): n is a, c, g, or t
  misc_feature (195)..(215): n is a, c, g, or t
  misc_feature (270)..(291): n is a, c, g, or t
  misc_feature (338)..(366): n is a, c, g, or t
  misc_feature (471)..(488): n is a, c, g, or t
  misc_feature (669)..(687): n is a, c, g, or t
tccccccaggnnnnnnnnnnnnnnnnnnnngcgtacttaaatcttatattttattgactgtaatctacagtgtatnnnnnnnnnnnnnnnnnnnnnatgtatctatactgtataaacaatgatacttcaaaatttgtaacataattatatatacttagacagaaaatgcttcaaaaaaatccgcctaatagaacnnnnnnnnnnnnnnnnnnnnncttcttttgcttaaaaattagtaacctttcatttattatcaactgcacattagtnnnnnnnnnnnnnnnnnnnnnncaaccacatacagattttgtttaaaacaataaatattaaagtagttnnnnnnnnnnnnnnnnnnnnnnnnnnnnntagaaactgcgaccaaaagaaaatatgggaaagcgacgaaaacaatggtagaaaacatgtaaaattgatttacgatttcttaaaatcaagcaaagattatgacannnnnnnnnnnnnnnnnngctatagttgaatacttcgaagcctgttcatgattattgttgtttaaattaatgaccaaattaaacggcttaggctggaggtcgtgcgaaaaatcagaagaaaaagtacatcgcaagagtacagattggcagataacgtgtttaatcttagaggtcacacgatgaagagagtctgattacnnnnnnnnnnnnnnnnnnnaagatcggaggttcatcagtatctttactctatctaccactgctctgaagagttctgctaaactgtctttaaactagccttttaaatttttcaaccatgacactctccttttttctagtcactccctcctatctgtccatgtatgatcaatcttatcattccatatcgctgtccccttattacgt

SEQ ID NO: 18545 - DNA, 895 bp, Diabrotica virgifera
  misc_feature (120)..(143): n is a, c, g, or t
  misc_feature (156)..(173): n is a, c, g, or t
  misc_feature (207)..(229): n is a, c, g, or t
  misc_feature (455)..(475): n is a, c, g, or t
  misc_feature (554)..(573): n is a, c, g, or t
  misc_feature (638)..(686): n is a, c, g, or t
  misc_feature (826)..(847): n is a, c, g, or t
ccttacgcgtccgctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtattatattatgaaatattgtatcttctattggatcactaatttcctttatttggggtattnnnnnnnnnnnnnnnnnnnnnnaaaaagctttttccttttcaaccgaaaaagaattaagaccctttaaaa

SEQ ID NO: 18546 - DNA, 102 bp, Diabrotica virgifera
  misc_feature (2)..(68): n is a, c, g, or t
  misc_feature (75)..(94): n is a, c, g, or t
gnnnnnnnnnnnnnnnnnnnnnnnnnnnnnnnnnnnnnnnnnnnnnnnnnnnnnnnnnnnnnnnnnnnggggtgnnnnnnnnnnnnnnnnnnnncctttttt

SEQ ID NO: 18547 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18548 - DNA, 196 bp, Diabrotica virgifera
  misc_feature (4)..(192): n is a, c, g, or t
ctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggg

SEQ ID NO: 18549 - DNA, 346 bp, Diabrotica virgifera
  misc_feature (302)..(343): n is a, c, g, or t
cattacgcgtccgatctgatttatctaggtatgaagaatcttctatatgatgtggaccgttcaacctcttccaccgtaccaaacttcatgtatgaaccgaactgactcccaccggcgtcagatcaaaccatggaagaccctaaaagaagagcagacttagtactatagctgctgcaccagttatatgctttaacgccacatccgggtatgaatctatcttatcaaatgatactctccaatacgattacgcgtgccatccctacagaaaattaaacataccaacgaaagacgtgcaaccagannnnnnnnnnnnnnnnnnnnnnnnnnnnnnnnnnnnnnnnnngaa

SEQ ID NO: 18550 - DNA, 915 bp, Diabrotica virgifera
  misc_feature (2)..(908): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttt

SEQ ID NO: 18551 - DNA, 933 bp, Diabrotica virgifera
taaaataataatatagtagattttgcgcttcaaataattccacaaagttcattttgcggaaaagatataatcgacagaaaccatactagaaacatcgcaaccattacatagtgcactggaaggatcgatcttgacccagatgccaactcttgcatcaatagtagtagtagaaataatattgcatacactcaccaaaagacgttttttcgactaatggttaaggttaagcagaagaatgtattataatcatttgaaaaatggaggtcagccccaaaacagtaaaacaaacgcagtggcaagtgctcagcgatttatcgatagcttattaaatgaaggaaagagaacctatgtagaatcaagcgtttgtaaaaaatgtcagctaccaacctattacgatgaagctctttacaaaaggggacagcagtttttcttcaggcatatttttgcgatgttatttgccaaactcaacggacttttggcagttttatcaatacctacaattctgaacattttagtactaacacagaagtcgagcagtgactttactgcttatatacgatatatatcgacgatttttcatatggtaatatggtataaagaagacctaaatcctggatcaaagttatgggggtctatacaggaagtcaacaaaaaacacaccgctgctagtaaaaaaggctcgacgtatggtctatgtagaatatcccaagcagatatggcgtttacacagtttggatttatgggattccaagtagcaaggccaggaatggttgggttgcacaacgtcaccgaagaagaatggaaagctttcatccatgtatggagagtagtgggatatttaatgggaatagaagaaagattcaatatttgccgtgaatcagttgaagaaccaaagaaatatggcaaccttttaatagacagatcattttttcc

SEQ ID NO: 18552 - DNA, 113 bp, Diabrotica virgifera
  misc_feature (3)..(60): n is a, c, g, or t
  misc_feature (62)..(109): n is a, c, g, or t
ggnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnggtt

SEQ ID NO: 18553 - DNA, 864 bp, Diabrotica virgifera
  misc_feature (12)..(863): n is a, c, g, or t
ctcccggcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 18554 - DNA, 155 bp, Diabrotica virgifera
  misc_feature (2)..(73): n is a, c, g, or t
  misc_feature (75)..(103): n is a, c, g, or t
  misc_feature (112)..(134): n is a, c, g, or t
gnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnncattgagcnnnnnnnnnnnnnnnnnnnnnnnctttagcattaaatttatttt

SEQ ID NO: 18555 - DNA, 948 bp, Diabrotica virgifera
ctttacgcgtccgggcgcgtgtggcaatgtcggacgaaagaattatttgttttgagtataatatgtcaccatcgactgaaagacatgaaggatgagtgtaacctcgaacaacaattacgaattaagtcctgcaactactcctggatcttccatagacgaagaaaaatgcttggtgccttatcagataagtcctaaatttaggaaaaaatggtttaggtgggaaaatactccttttggtattttggccattagttttatccaggtactattccaaatttaaaagctctgcaagtttctgataatcctttggtatatccaagcagacctgttatagtatctggtacaaagaccataataaattttctaaaggcacaatatgaaagtgatcgagttaaaaagcaaagagaagatgatgatacagataaaactacagcaacggacagttccataattaatgaagaggaattcaggagagatgaacaactggtaaaggtaacagaaatagggagttataagagttataataacatggaaacatccgctaaacccagtaaagaaactaacagaccatctagcaaaaattcagtagttaggactatcagaaaaaaagtatcagatggccagactcttaatccagatctaaaaataaaacagttgctctcaccagaaatagtgagatgtaagagagatacagataaaacaaaaatagtacacaaagtaagtagaactggatcaaaattattcttaaagtcttactttaataaaccgttatgcggaggtgatggaaaaaagttcaacaatttaaaagaaggatggttaaatgaattaagaatattattaacagaccaaggaacggatattgcaaccaagaaaaaaacctcagaaaccatctccaggtggaaggatgaagaaaaagacaaaaaagtgaaaatgattcccaaaattttc

SEQ ID NO: 18556 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18557 - DNA, 927 bp, Diabrotica virgifera
  misc_feature (522)..(553): n is a, c, g, or t
  misc_feature (753)..(753): n is a, c, g, or t
cttactagcgtccggtaaagtaggatttagaatttataaatacatagtaataaataaaatgcgcttataacaaaaacaaatatgaattcaagaagtttgtgcaccatttgtaacaaagtatttcaaaataaaagatatttacacaggagtattcagttaaacaaaagacaacatgaaaatcccttctggaggactattagaatattaggtgatgactttaaaaagtttaaacaacataaagagcctacagaagaagaacaacaatggctcttaagaaggcactttccaagacatgcagatattgtaattgttggaggaggagctgtaggcagtgccattgcctactatttaaagttaaaatcaaattacgatggactgcgagttttagttcttgataaagatcccacatttaagaagtgtacaacagcaatatctatgggagcattaacacaacaattctcattgtctgaaaatattcaattggcatcatatggtgcagaatttctgaggaatatcaagacnnnnnnnnnnnnnnnnnnnnnnnnnnnnnnnnaacccagtggttatctggtgctggcaagtgaaaatggggcatcacagcttgaagacaatataaaattacaacaagaatttggagctattaatatgttgttaactccacaagagttaaagagaagatttccctatttagacgttactaatgtagctgccggcagtataggactagaacgagaaggctggtttaatgcctgngacatgttaacagctttaagaaaaaagtctatggacttgggagcgcagtatattactgctgaggtagttgactttttattgaagatagaacagatataagaattgaaggagtggatgtaagaaataccagagtacaatgaaattgtggaacaacttccaggaaaaaagaaaata

SEQ ID NO: 18558 - DNA, 828 bp, Diabrotica virgifera
  misc_feature (3)..(40): n is a, c, g, or t
ctnnnnnnnnnnnnnnnnnnnnnnnnnnnnnnnnnnnnnnggaaaatagtttaattatttaattacatttaaaattccatacgttaaaaatccttaactctcaattacgtaaggcatagattttcgaaatatttaacaaactcgtaccattatttttctctttcagagaacataaagcaaatattttatgtaatcagtacttttatatacaatgcaaaactgaagtttttgctgtgtggattttcaaagttgtaagaaaaagatttggacgaaaattgagctaaatttttaaagttcgtacttaggaagctaaccacctccgcctcccaactcatcttcatactgtttgcggaagcagtcacccactgggaagaagtcccagcatctctgttggtacatgttccagacgtatgtctcttgaccggtgtgttctgtatccggtttgttgattaagtgcataaggaagaacatgtaatttgctagattgtgttcttgttgtacgtgcgtgtcgaacccgtgcggcaccttatcaaagtaatcctttcctatgccacagatgaagcagttcgattccatgtcttctttcacgctttccagttgatcacgaagctcaccaaaagcatcaatgatcaaacccctgaatgatggccaacagaaatgacaataacgaagaagaaaaacgtaatgtcaaacatgatacggtacccttcgtagtcatcgccatctgaaggctcgatttccgcaccaataccaacaccagctctgacacctttgtaaagatggaagacaaacacgataacatatcggggactttttttataatttctt

SEQ ID NO: 18559 - DNA, 804 bp, Diabrotica virgifera
  misc_feature (2)..(627): n is a, c, g, or t
  misc_feature (632)..(692): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatnnnnnnnnnnnnnnnnnnnnnnnnnnnnnnnnnnnnnnnnnnnnnnnnnnnnnnnnnnnnntttttttggctataagaataaaattaccttaggcataccagggaaatttattggagagcccaaatcataataaagattgcgacccccacggcgggataagcttaaactggcg

SEQ ID NO: 18560 - DNA, 457 bp, Diabrotica virgifera
ttcacggcgtccgtacaaagtttgcatcggcttggttcggactagacgaagtatccactgcttgtgcgttggcagtattaggaacacagttaggagctgctgttggagctattattccgccttttatggtggtgaaaggagaaaccaaagatgaaattggagatggaatttttaacatgactttgtataatactatcggtgctgctgtaattttaatactaataattttgttttttagagccagaccaaaactaccacccagtcaatctcagttacaacttttaactttagacgaagaaaagacgaatttctggaaggactgaaaacttttaatgaaagacaagaactatatattacttttaatgtcatttggaattataaatggtctatggaatgcttttggcatcgctatctcgagtgtgctatgcacttactttcctaatcggggaactgacat

SEQ ID NO: 18561 - DNA, 447 bp, Diabrotica virgifera
  misc_feature (13)..(20): n is a, c, g, or t
  misc_feature (56)..(56): n is a, c, g, or t
  misc_feature (325)..(343): n is a, c, g, or t
acataaaaggggnnnnnnnntattttacacaagatgaaatcagcctttgagagtgnattcttcgattgagaggaaagtaaataatagggagaggagggggaggaagggggaaattgagtaaggaggagtagaagagggaggatgggaggagaggaaggagaataggaaaaagagaaagagaatagaaggagaatggggattgaagagaatgaaaataatgagggtgatagaggaggagaaagaagaagaatagaagatagaaggtggttggggtgatggaagagagatagaaaggagagaagaaaggggagaagagggaagagtnnnnnnnnnnnnnnnnnnntgaataggaagaaagaaaaagaataagatagaggtggagaagaaaggagagaaagagaatgagaagaggatggagagaagggggaggggggaatgatgaaagta

SEQ ID NO: 18562 - DNA, 555 bp, Diabrotica virgifera
  misc_feature (10)..(10): n is a, c, g, or t
  misc_feature (32)..(32): n is a, c, g, or t
  misc_feature (34)..(34): n is a, c, g, or t
  misc_feature (36)..(36): n is a, c, g, or t
  misc_feature (41)..(41): n is a, c, g, or t
tttctcgcgnccgataaaactaagacatgctngngnattcnttattatataaagtgttatctagattgttaaattattaacaaaaagttaaaattgttctattgtttcatttgctttattagtcaggtgaagtagtgagtagtgtctataggaataacgatcaaaatggttattggtcacgcagagttcgccattgcatacaagaaaaatgcaatggaaacagacaaattctacttggctcatatagtttttctagtttttggaatcatgcatttattacctgtgtccttttttgtaacggcaaatgattactggatgtacaaatttcggaacacgacgtcagacaacacggaaccaaattacaggtctatccttcaatccaactttgcatcataaaagaatgcagcgtattcccctcccgaccgccatacgaatttaccatactctaacagatatgattagataataatacagatcataatgaatatctttatatacatactcccacacacatatactttatttcccccactccctccctcctcttacctcccc

SEQ ID NO: 18563 - DNA, 910 bp, Diabrotica virgifera
  misc_feature (506)..(524): n is a, c, g, or t
cattacgcgtccggtaatgtcatgaaaaaatttcgttattacatctaaatacaaaacaaactgctgctaaaaatactataaaaagtattcatataactaatattttgatatctcttataatgtggatttagagtttacaagcagttgactgtactgtgacgtctgtatatataaaatgtcattcatgacgttcaactaaggacacaatgtattgatcatcgttaagctatcttacggctctcacgttgttgccggaaaatattactcacatcgttttctgttctttctatcaggttatgagggatcaattctcaaaaattccgtttaaaacaattttgagagcctttgtaagtccgtttaaaatatttctttctgcaagctggatcagatcttgtccatactgaagaaggtaatggaagttcataaaaataactcaaactaataatcatccttggatcatttttaatctaaaagttggatatcaataaagattttaataacaaatnnnnnnnnnnnnnnnnnnnatcattaaatcaagaaatgtcgaagaaaagactcatgatcatttttcttcttcttcaggtgccgtcctcgttccgaagtttggctatcatcaaggctatgcgtatttttgataccgtagatctaaataattggcagctgctgcacttgtaccaatctcttaaattcttcaaccatgaatgttttcttctgccaatggatcttttacctattatttttccctggataattaattgtagtagctggtacttttgtcccctcattatatgtcccaagtattgcagtttgcgctttttaatagtaagcgcaagttctttttctttctgcatccttcgcaacacttccatgtttgtcactctctctgtccacgatattctcagaatcctgc

SEQ ID NO: 18564 - DNA, 928 bp, Diabrotica virgifera
  misc_feature (148)..(166): n is a, c, g, or t
  misc_feature (306)..(324): n is a, c, g, or t
  misc_feature (696)..(865): n is a, c, g, or t
  misc_feature (885)..(919): n is a, c, g, or t
gttttgtctttttttgtcagaaagtgaacataaaaattgagggttgagttgagacttttgagagtttcctaaatagaatttttaacgtgatttcgctttttgagtgtaaaattattattgagaaacagaatcaagtgtaatcaaatgnnnnnnnnnnnnnnnnnnngggaggaaatgtgtgaagtgaaaaaagagtataataaatttgatgatgatgatgtccttttggatggctttaaatgtgaagacttaaaagaatatcccataaatactgaaatcgaaaaacatgaaaataaactcaacccnnnnnnnnnnnnnnnnnnnggttatctccaagacgaacacaaaatggaaattacagagacactaattgaagattcatcttacgaaggaaattatacgagtcaacgctctgaagaaagaacattaaatgaaaatatggaagttgtgactgaacaaagaccttacaaatgtgaaacttgtttcaaacagttcagtaaggcaagtgtccataaaagacatttgaagatacacattggagaaaaacctcacaagtgtgaaatatgtgcaaagcacttcgttactggaagtgacttgagaagacatttaagaactcatacaggagaaaaaccatacaagtgtgaaatatgttttaggcagtttaatcgagactgaaaattgtaaacgcatgtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccagtcaaaaccttttnnnnnnnnnnnnnnnnnnnnnnnnnnnnnnnnnnngaagggggt

SEQ ID NO: 18565 - DNA, 617 bp, Diabrotica virgifera
  misc_feature (58)..(58): n is a, c, g, or t
  misc_feature (61)..(61): n is a, c, g, or t
tttttcaaaaggcccgcggacgtgtgggtgctgtagtgcacaccctattaaagcctcnatntaagaattgactggaaataattaattataagatgactaaagacccagctgtagtttttttttatggtacgactaagtgatatgacagaagatgacgcgtataggataacattgagacatataaatgtgtatatatttaagtgggttgcgtggtctatgttcacaattaaaacaatctgcgatttggaacataagttacttgtacgaacatacctatatcctagcatgaggtgcatccaccataatattgatgacacagagttatgtacatagtaatgattgcgagaggtatattatgacccctgtgtcatggatattattgagttataatgatgggatgccaatttttagtctgcagacaaaaacatttcaacctcaatatgctgctattaaacactcatatatacgagcgaaatagatgtctatgtcttccatcattgaataatcaataaatagagctcaatgttaatcacctatatttgttgcatgttgttgacactcggcaatggatgatgaataagtgggttctggggaagactcaatgtacaatgtccctt

SEQ ID NO: 18566 - DNA, 536 bp, Diabrotica virgifera
  misc_feature (32)..(32): n is a, c, g, or t
  misc_feature (46)..(337): n is a, c, g, or t
  misc_feature (344)..(381): n is a, c, g, or t
  misc_feature (401)..(414): n is a, c, g, or t
  misc_feature (417)..(439): n is a, c, g, or t
  misc_feature (447)..(469): n is a, c, g, or t
  misc_feature (499)..(530): n is a, c, g, or t
gccctcaccgcgtccgaccgtgctaaggtagnataatcattagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 18567 - DNA, 622 bp, Diabrotica virgifera
  misc_feature (8)..(8): n is a, c, g, or t
  misc_feature (18)..(20): n is a, c, g, or t
  misc_feature (25)..(25): n is a, c, g, or t
  misc_feature (27)..(27): n is a, c, g, or t
  misc_feature (421)..(421): n is a, c, g, or t
tgagctanggggtccggnnntaagngncatcttaacttttgtcatgaggggcagcgtatgggggggaaagaagtagaagagggagagcgagggagggaggggaggagaggaggagccatgcggaagaagagagcgcgagagaaggggagagaagagacgacagcaggaacagcgagaggataaggtttttgttttgttgggtttgggagatgatagtgatgaagtaatagatagggtgtgttgggagttgtgagtagtatttgttttgatatttttagtgattttgtgatgatggtatgagggataaagtgtgaaaaattatgattaagacgagtttgggagggtataggaagttggtttgtgatatttatttattggggctggatcatatgttgggtatagtggtgtgggtaatgtaagnttgtaataataacgcgaagtaataatgattgttggttgatttgtggtgtagagggggtatatgtatagagatggtagaaataattattgtatttttatggaaagatcattaatttttgaattgtggaagaacagagtatgggatgatttttgtttggcttgaggggatgtcctagagtcgatgtttgtttattatgtgggg

SEQ ID NO: 18568 - DNA, 891 bp, Diabrotica virgifera
  misc_feature (2)..(691): n is a, c, g, or t
  misc_feature (698)..(735): n is a, c, g, or t
  misc_feature (755)..(768): n is a, c, g, or t
  misc_feature (771)..(793): n is a, c, g, or t
  misc_feature (803)..(803): n is a, c, g, or t
  misc_feature (858)..(877): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgactnttaaattttacatgatctgagtttaaaccggtgtgagccagggtggtttctatcnnnnnnnnnnnnnnnnnnnntagtacgaaaggac

SEQ ID NO: 18569 - DNA, 603 bp, Diabrotica virgifera
  misc_feature (6)..(33): n is a, c, g, or t
  misc_feature (212)..(241): n is a, c, g, or t
ccttcnnnnnnnnnnnnnnnnnnnnnnnnnnnnattaatactttaccatttggtaaaatgctaatactctttaatccaaattctttggtgtggtcactgtatgtcttcatcgaaattcttcataaaatattttgtattgtacccaattttgccattaaattttcatccatttatctatagaatactctaatgctgctatccatctctttttnnnnnnnnnnnnnnnnnnnnnnnnnnnnnngtgtttcttgttagagtctggtggtacaatttcaaaagcatactttttagttcctgataagtattgttgtactctatatccatgtaaataagcaaccccaaaagcattttttgcattagcatcctgataaaaatataaacacgcgtcctttagaatacaatatctcctactccagctcttccactgtgtgcccaattttaccaaataaccaaaacagtctggttctttaatcgaacagggaggtaacatcaaattacttttcatactatcaagaaaactgtctaaaagctgcttgttatctatcatcagtttgttcatctcttctacccatttttcttgcatactcgaggattctgcggtta

SEQ ID NO: 18570 - DNA, 597 bp, Diabrotica virgifera
  misc_feature (4)..(44): n is a, c, g, or t
  misc_feature (48)..(183): n is a, c, g, or t
  misc_feature (185)..(201): n is a, c, g, or t
  misc_feature (222)..(242): n is a, c, g, or t
  misc_feature (319)..(348): n is a, c, g, or t
  misc_feature (472)..(491): n is a, c, g, or t
ctcnnnnnnnnnnnnnnnnnnnnnnnnnnnnnnnnnnnnnnnnnctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnncgaattaaaaatagtataagnnnnnnnnnnnnnnnnnnnnntttttctattttaaatggttttcctgtcttgatatgtcataatttttgaagaaataattaacattctttcacaaacnnnnnnnnnnnnnnnnnnnnnnnnnnnnnnatatcattctagatatttttggatgacgctcaaaattaaattttgttaatctaatattcctcatgaataaatatgaggatatattttcatcttctattaaatatccttatctatttatatatgnnnnnnnnnnnnnnnnnnnnctgatatttattaaaatataatttgaaattcatataattttaatgttgttgatgatgttagtattacactattgaatatgtagtaaatatatataggataaatagc

SEQ ID NO: 18571 - DNA, 736 bp, Diabrotica virgifera
  misc_feature (16)..(44): n is a, c, g, or t
  misc_feature (48)..(537): n is a, c, g, or t
  misc_feature (544)..(581): n is a, c, g, or t
  misc_feature (601)..(614): n is a, c, g, or t
  misc_feature (617)..(639): n is a, c, g, or t
  misc_feature (647)..(669): n is a, c, g, or t
  misc_feature (699)..(730): n is a, c, g, or t
catttacggcgtccgnnnnnnnnnnnnnnnnnnnnnnnnnnnnntatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 18572 - DNA, 824 bp, Diabrotica virgifera
  misc_feature (2)..(15): n is a, c, g, or t
  misc_feature (28)..(75): n is a, c, g, or t
annnnnnnnnnnnnncaaaaagtctccnnnnnnnnnnnnnnnnnnnnnnnnnnnnnnnnnnnnnnnnnnnnnnnntgattatgctaccttattacgggtttcctaatgcgatttataagcatacgcgataatgagtttagagtaatcctagcgcatccttcgctacgataagagttttatttatattagtttgtttgggttcttaatgtattaaaaaagactcgtgttgtaggcaagggaaaatgtttgtacctacctatttaggactttcttaaggctggaaccaatataacatgaccccgatttatgaactataaaatattgtaaagctatatgacacccgtctgtgttatggagatacatcaagctgaactctgtcttcggcaacttttgtttacagaaagatcgattttaacatcaataagctgtgataacaaaccatgatcaatctgcagaattgatgactatgttttccaacattgaataaacaataactacagctcaatggataccaccttaatttttgaatggtgttgaaacctatatggatgatgattaactggcttccctgaacgactcattgcaaatgcccctacaatttgctgcctctactgcgtttagaggactaataacatttgcgataatggtttaagctcctgaactcgccactcgaaggttgtaagaagccatatgtcctcagaggcatcaacaatttaaccgctaaaacgtttccacggaaatgctgggaatacagaaaccgccctcacgccagtaagccccccccaatcccaggcagcctctaaacacccgtgcaaaagcaacct

SEQ ID NO: 18573 - DNA, 623 bp, Diabrotica virgifera
  misc_feature (151)..(173): n is a, c, g, or t
gccctttaaggccccgcggttttattatataggatgaggccccctttaaggacaagtaatgagtggatataatgataaaagttttgttgtagaatatgtatattatataatttttctcgaaggatatgtgattcgtatgtagataatttgnnnnnnnnnnnnnnnnnnnnnnngtttgttattatgagatgagaaagaattaaagattgatgtattatgattataagacaaaattaaagaggagtagtagaaaaaaattggatttaagttgaatgttattatagattttagagtaaatgattttcatgtctatagatatgttattattaattctttgacgataatgatgaataactcttcatatattttgtatcagaatgataattttatgtttttttgaggtggtaatgtggatgaataatatcaaggagatattggatgctctgataatatatgcggaagcaaatgtgttaatacgaacacatattttacacatgataacttaaaaaatgttattttgtgtagtagatcacctatgattgtcatggccgtgacacaaatttgagtagtctgagcgtctttatagttgcgaggtgacgcccgtgttacatgctatatttcta

SEQ ID NO: 18574 - DNA, 1035 bp, Diabrotica virgifera
  misc_feature (15)..(42): n is a, c, g, or t
  misc_feature (47)..(144): n is a, c, g, or t
  misc_feature (147)..(147): n is a, c, g, or t
  misc_feature (150)..(150): n is a, c, g, or t
  misc_feature (160)..(160): n is a, c, g, or t
  misc_feature (162)..(163): n is a, c, g, or t
  misc_feature (182)..(203): n is a, c, g, or t
  misc_feature (440)..(460): n is a, c, g, or t
  misc_feature (678)..(678): n is a, c, g, or t
tctaatagggtccgnnnnnnnnnnnnnnnnnnnnnnnnnnnnctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnaanattttttttnanntgtttattaaaaagatgtnnnnnnnnnnnnnnnnnnnnnngtaggatgagaattgattaatttgaatggaagtggtattttgaaagtgataaggtagtataataattagattttttattgaaagatggaaggaatggtaggataagaaaatgatttgtgttgtattaatgtatgtagaggaatattataatgaatgtgagattaagattatataggaaaaatgaggtgtatgatatttttgttttaagagaaatagatttaaattttaatatgatgnnnnnnnnnnnnnnnnnnnnngagaggaattgatgtgtatgttttttaatattgaataaagaataaatagaggtaaatggttataagaaatatttttgtatgttgatgagaaatgtatggatgatgaataattgggttatgtgaaagagttattgaaaatgataattagtttgttgagatttaatgggttaataggatttataatatttgggaaaatggtttaagttaatgaaattggnaatgaaggttgtagaaagatatatgtgtttagaggtataaaagatattagtgtttaagaggtttaagaaatgttgggaataaggaaagtggttttaggtaagaaagataattaaaagataggggagtttttaagatttgtttaaatgtaatttattgttgttggattagtaaagtaggtatttaaaatttgtattaaaatgggattttgaatttaaaagaatttataaggagaggattagaaagaatttttgagtttgttattaatggaaaaaggtaatttaaaatttaaggggtgtattttttaaattgtttgtttttataaatggtgaattttatgggaaaaagaaatataattt

SEQ ID NO: 18575 - DNA, 752 bp, Diabrotica virgifera
  misc_feature (133)..(153): n is a, c, g, or t
ccctacagcgtccgggacttaatgactatcggtgctttcttcccttatgtgatagtagctgcatcagttatagtattaaggtatgaaacaacatccactgtgatagagccagtatcggagcagacgtttgctnnnnnnnnnnnnnnnnnnnnnttcggaagcctattcaacatcagcaaaaacaagattcccaataagacatcttctatagtgaccaacatcagcacacttttcttcactatgatgacctgtatattctgtgtgatattcaagaaccctcaattatttggcactcatagggcatactacaccagctgctcatttaccgctgtattaatgatattgatggcacttatcattttcagacaacctcaatctaaagagaagatatctttcaaggttccacttgttccttttattccctgtttgagtatcatgttcaatctttacatgatgatgcagttaagtttattcacttggattggatttctaggatggattgtcattggttgcttcgtatacttcttttacggaattaaacacagcgaagaaaataaacacactcctaaagaaacggcggaatgatgacaaataattaaacacttttgaagacataaaccatgatgagattggattctagtcagtaatattttctacttattattaagtactatgttagcgacacatcttataaaaatgtaattatattataaagattttcatatttataatgaaatatatttatatagagc

SEQ ID NO: 18576 - DNA, 935 bp, Diabrotica virgifera
  misc_feature (474)..(491): n is a, c, g, or t
  misc_feature (525)..(542): n is a, c, g, or t
  misc_feature (822)..(845): n is a, c, g, or t
  misc_feature (915)..(934): n is a, c, g, or t
gtgaaacacctttttatagaggccctgcttcttagatacttaaggaaaaccagctaatagaaggttttctgttcttttagccactggagggagactataacaaaatttaagtcacatttggatgcttcatttatttatggaataaacaatcattttggtattattttgggtttggattggaagagttttggatgtttttttttctcgtttctggaatagacactaagttctatcgacactagcaagtacctcctcgtcaatactctgtgttgctgttccttacctcccgaggattgggaagatcggaggatacgtacctggctctctcatcatcaacctcaccaggattttggagaagccacaggcctacttttgtagaaacgccaggtttttataataaaatttgaattttcaagccttttaaataatagttttcaattttcaatttttttcaataactcaaatacataaccnnnnnnnnnnnnnnnnnncaccttcttaaaccctattatctttataatattnnnnnnnnnnnnnnnnnnaacgaattttatatttcattttcatgattgtatcaggtatttaaaataatctcaggattgtaaactatctgggacgatactgtgcacactatcgaagggtttatttcctactcaataatatttattccattcaccagatattggtcaggttgtcacttccgatcagatacgggattgtcagccaatcttgtattctacagtaataattagtttgtacatgcatatttagatcaaatcacttccttagtagaataaattcattacgtatattagttttttnnnnnnnnnnnnnnnnnnnnnnnnacaggagtgtactaccatagtacgtcggatatttagctagtgtataaaattgtatatagggtttataggnnnnnnnnnnnnnnnnnnnng

SEQ ID NO: 18577 - DNA, 747 bp, Diabrotica virgifera
  misc_feature (364)..(386): n is a, c, g, or t
  misc_feature (474)..(494): n is a, c, g, or t
  misc_feature (502)..(526): n is a, c, g, or t
cttccagcgtccgctaaaataatctagtaaagatgaaacaacttactgtgatttttgttttgttcgtttttcttcactgtgtatggtcttttaatacaccaccaccaggaagtactttccctccaggaggtctagattggcagaactgcaccaaacccaacgaatactatgactgtggcagcccttgtcaaagagaatgcaaaactttaaacgaaccttgtaggattaactcctttagatgtgttgacacctgttattgcatccaaggttatgctagggatgacaaccaaaattgtattccggaaaaggactgtaacaaataagtttttagattttttgtaaaataaacaaattatattagcannnnnnnnnnnnnnnnnnnnnnnaatcccgtttgaatccagacccaatcggtttagatctaacctctggggaacccatcaatcctaaagatgctggcatctatgacaactnnnnnnnnnnnnnnnnnnnnntcaattcnnnnnnnnnnnnnnnnnnnnnnnnnttattggttgatgaaattatgagggctggaatgagcagcttaaagggataaaatcgaactattcaaatttaaatctgtatttttgtgcttgttttaatttatcattacattatgtattttcttaacctctgaaaggttgctacttaatatttagtggacatacacataatgctgtaacgttgataacatacacacgtaacatttataatatttgcaataat

SEQ ID NO: 18578 - DNA, 702 bp, Diabrotica virgifera
  misc_feature (2)..(626): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattgaagagttcaaatagataataaagattgcgacattaatgttggattaaagtttataac

SEQ ID NO: 18579 - DNA, 866 bp, Diabrotica virgifera
  misc_feature (203)..(232): n is a, c, g, or t
  misc_feature (333)..(560): n is a, c, g, or t
  misc_feature (565)..(599): n is a, c, g, or t
  misc_feature (707)..(752): n is a, c, g, or t
  misc_feature (777)..(796): n is a, c, g, or t
cattgatattacatatcgacgttcctttcacttaatgttttgatttaacttgtttgcaaatgaatcacgtttgtgcaaagataaaatggaacaactataactgaattagttaattcctatttaattgattgtattgaattgatttccttcgtatgcccactaatttttattatctgtctcatgcgagaattattttcttttgnnnnnnnnnnnnnnnnnnnnnnnnnnnnnnggagttctctttccatggtgattatttgttatattctattaaactaagaaacaattcttatgaaaataatgtaaatgtttcctagagtaatttaataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatannnnnnnnnnnnnnnnnnnnnnnnnnnnnnnnnnncccccaaaaaattatccccgggggggcttttttaaaaggaaggggagagaaaacagggggtgaaccccacttaatcccgtttgtaagaacccccccctttttcccagnnnnnnnnnnnnnnnnnnnnnnnnnnnnnnnnnnnnnnnnnnnnnnttgtccccccgcctagggaaaagannnnnnnnnnnnnnnnnnnnttattataggggccgcgtggggggggggaacccaccgccgaatccattactttagcccgccccccacgcc

SEQ ID NO: 18580 - DNA, 954 bp, Diabrotica virgifera
  misc_feature (128)..(144): n is a, c, g, or t
  misc_feature (347)..(414): n is a, c, g, or t
  misc_feature (898)..(898): n is a, c, g, or t
ctcctagcgtccggcgctgcgcagcgcagtgcttcgtaatcgtaacagtgctgcgcagaatagtgcacatgtcctccccattagtcgcccaagcctgcgccgcccaacaaatagctcagcagccctgnnnnnnnnnnnnnnnnncaggatagcgcagccggtgagattctagctttagaactgttgcacgagcaatttaattggactatctgttcttaattttttaaatcatattgaaaactgttttgagcaatgtttttattgactaaagcgctttttattttgatctaaattattttttatacgaactattcggaatgatcttttaatatgctagagtagtgcannnnnnnnnnnnnnnnnnnnnnnnnnnnnnnnnnnnnnnnnnnnnnnnnnnnnnnnnnnnnnnnnnnntcgattgttgttatgtcgcaagttcgattgttgttacgtcgcaagtcaagttacagtgaagctttgacttttaaatcattatagctataacatgtcttcagcaatagccataaaccattgaaacatacattgacttggttttcatgattgatacttatctgagtcaaatattctcgtttttgagttacaaaaacatatagtttcgtatccattaagcaaaagagcaaacctaaatgagtcagttctaagtaaagactcagagtcatatatttttgccgttacaatactgcttgtacattatattagaaatagcaataaggtgtagagcgatctgggctaaacttcttgtattatttttgaataaaccaatggctggataatcattggtcttgtattatatattgtgatatatatgaacaaaaagtattagatttttatctgtaagagactgatttttgtaattattcgaaatatttttctatgncatctcagatttgaattgttctttggaaatcatatgaaaaaagatattgcaatttt

SEQ ID NO: 18581 - DNA, 621 bp, Diabrotica virgifera
  misc_feature (16)..(16): n is a, c, g, or t
  misc_feature (20)..(39): n is a, c, g, or t
ctcaagcggccgaggntagnnnnnnnnnnnnnnnnnnnnccctttttctcaagatatttagacagaattaactgcttatactatttccgcttgaatttagtggctctagaatacagctaagagatgttggtaagattcggtaattttggtaatgtggtccctttgctggagcagaatggacagcaacaacagtaaagggagatggacattctgaaagatgtatacatcggagtggactaggacgagcactttgctaccgctgtatatgcctctcagatgtaggaggagatgtataacaagtgggtggaccacttgaaggcaatgcctgcaaccgatgcgataggtccaatgtgcccattatggctgtaggctaaaatcgattcgtgtttgaagatgtatctcaggtggatgctgaccatgacttatttcccgttgccctatattccgctgagcgccacagcgccatccgcgaaattcaacgtgctgttgttggctcttaatctctcacaggtgtggaatatccccatgatgaggctgtagccgaagattcttaacatgttgccgtcgctgatagtcaagattgcgcatcttccggacgaacaaaaatacccctatttggga

SEQ ID NO: 18582 - DNA, 956 bp, Diabrotica virgifera
  misc_feature (82)..(102): n is a, c, g, or t
  misc_feature (646)..(669): n is a, c, g, or t
  misc_feature (860)..(860): n is a, c, g, or t
ctcctcgcgtccggacagggccattccatccgtattgacagctcattgttcaaaattcatatttgttcataacctatttccnnnnnnnnnnnnnnnnnnnnncaatatcagtaggtaaaatagtttaagataaagtgagtgagaatttgtaattccataaatttgtctcatataagtttttcctggcttttaccatcttatatgtaatgtttgttatggcgtttataattcccgacaaaatattagagtcattaatttgtactttctgccataaatacttatcagtaaaacccgtaacagtttatcgaaatagagatgtagaatgtggacgttgtacacaggctgataaacaaaatcaaagaataggtgttgaatccctatatggaagaattgctgaaacatgtttatttaaatgcattaacagatttgatggatgtatcgaattgttaacatattcccaagttgtcgatcatgaaaaggtatgtttggaaaaaattcataagtgtccaatttgttatgaagaagtgacgagttttctaatccttcgacactttaattccaaccataaggatgcagtattgaattctcctgcatttgtttttgatttaaatgattattcagaaacgcccagtacttttatatatcnnnnnnnnnnnnnnnnnnnnnnnntatatattagctacagtaaatcagaaaatacaataaaattagaattggtttatttgggaagtgataaattagctttaaatatataccaccagtttacagtaactagcaaaaacaaagatttttatattaactataattcaaaaccttcacatactaatgagtttttcattgtggatgcaacgaatatgtcnaatttaataaatgttaaatttaaagtaatttatcacaacttacaatttttcactatatcagaaaatgatcattcgtcaagcattaagaatagttca

SEQ ID NO: 18583 - DNA, 854 bp, Diabrotica virgifera
  misc_feature (534)..(598): n is a, c, g, or t
cggcatccttcaccgtcgtcaatatgtccttaaaatatatagatgatatgaacaactattatctataagtgtgatcaaaaagtgtttaggaattcttaggaaatcaaatttttaaatatagtgttaattattgttaaactatatttaatagttctgccttccatcatgattttaacagttatattcttgggtcttctttatttggtacacgcaaatgatgacagtcttgtagcagtacatttgctcttccgacatggagacagaactcctgaaattgaaaatttgtacaaatctagcccatattataatggttcctattttaaacctttcggatttggtcaactaactaatgaaggaaaactaaaagtttataatttaggaaaggaaattcgccaacgttattcggggtttttggacgaagagtacagcattgatgtaatcaatgcacgaagtagtgattttaatagacccaaggcatcattacaattaatgctggcaggattatttccacctaccaaggatctaacttggttnnnnnnnnnnnnnnnnnnnnnnnnnnnnnnnnnnnnnnnnnnnnnnnnnnnnnnnnnnnnnnnnntcggttttggatgtgaaagatgggatccgatattccaagacttcttagcatcaaacgatcttagcaaatatgacaagctactagcaactcttactaataaaacaggagaaccctgtaactctctcttaagaggttatcttttatattttggatttcaaattttgactgaacttaattacaccctaccagattgggcaaatgaggtttatccttacccattaacgaatctgacacttggttaactatggttatgatt

SEQ ID NO: 18584 - DNA, 738 bp, Diabrotica virgifera
  misc_feature (480)..(501): n is a, c, g, or t
  misc_feature (535)..(553): n is a, c, g, or t
catttacgacgtccgcaacaaaatacgaagtaattgtgaccttgtaaaaacaccctgtatattgaaatttttaaaaacgtttgcacacctgaagagaggacgaaaaactaagtttaatgtcccgctttaatttttttgcagacaatttaatgacattactttttaaatcatatcgaaatttttattatgagttcccagagttcttaaaaatttcgacataagttcaaaatcaaatttattaaattgtctggccaaaaaattgaagcgaacgattaaacttagttttttgtgttcttttcatacctatgtgcaaacggattttgaaaatttcaatatggagggtgttgtttcaaggttacaattactttatattgttttgttaatccggacctggatttttcttgtgattaataattgggtcgtttcaatgtggtaaaaataagtattgattaattttaaaatgagtatttattcagtagnnnnnnnnnnnnnnnnnnnnnngttagtaatacctgctttttaatgtcagagttcnnnnnnnnnnnnnnnnnnnttcaaaattaaagtcataaaattgtctggccgaaaaattgaagcgaacgatcagacttagttttttgtgctcttttcaaattatatgcaaacagatttttagaatttcaatatacagggtgttgttttggggtcaccagttgctttataattttttgttgatccggacctggattattcttgtga

SEQ ID NO: 18585 - DNA, 723 bp, Diabrotica virgifera
  misc_feature (3)..(595): n is a, c, g, or t
  misc_feature (597)..(610): n is a, c, g, or t
  misc_feature (622)..(639): n is a, c, g, or t
  misc_feature (651)..(673): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnttggtcgcgccnnnnnnnnnnnnnnnnnngcagaataatcnnnnnnnnnnnnnnnnnnnnnnnccaaggaaaggtcgaatgaaacaaaaaaaactggctttatagaaagtaaa

SEQ ID NO: 18586 - DNA, 661 bp, Diabrotica virgifera
  misc_feature (8)..(9): n is a, c, g, or t
  misc_feature (218)..(240): n is a, c, g, or t
  misc_feature (281)..(298): n is a, c, g, or t
  misc_feature (493)..(511): n is a, c, g, or t
  misc_feature (629)..(654): n is a, c, g, or t
ttattttnnagcgtccgaaaggtcacacaggagccctcgtacgccctttaaactcgaagaatggtgtaaagtgagaagaagagaagataagagagtaaggaagataggaaggtgaagtattcctgtgtatgatggagttttgtagtaaaatgaggaataaaaaaagaattaatgtgtgggataatattagaatataagggtattaaggagttagtgtnnnnnnnnnnnnnnnnnnnnnnngaaattaatagttatggagtgtggagaggattagatagttnnnnnnnnnnnnnnnnnngatataagaggagatgaataaaatagtaatgttgatataatatggatagatgtgttaaattgatttatgtgagattaatgatgttggtattataaattttgtgtggtatgatgtagtattatgaataggatttgagtatagaattttaattattaaatagatgaatgtatgagatgagtaaggatgtataatgtnnnnnnnnnnnnnnnnnnntatttgaataagatatggatttaaaattgtgaaattagtgtggtattgaataaaaggatagtgatatttattttttaggtgaagtagattaatgaaatattaggtatttgaaaagatnnnnnnnnnnnnnnnnnnnnnnnnnnttgatta

SEQ ID NO: 18587 - DNA, 447 bp, Diabrotica virgifera
  misc_feature (376)..(393): n is a, c, g, or t
gtagaaagaagataggtgttgagtaattggtttaagtaagatattatgttgttagtaataattgtttttggaattttgatgttaaatatgtaaagaagaggaattaatatatgaaaaaatattaggaaattaaggtgttaataatgtatgattttttgtggaaatagatggaggaagattgatatgtatgaattgtgaagagaaaaataaattagtatattgtagagtttatgatagaaagaggagaaaaataaaataagaatgttggaataatatggattgttgaaggaaattgagtatgtaatatttttgagaatggtatgaaagtaattggataagtatgatgttggagaagaagtgggaattgagtataggnnnnnnnnnnnnnnnnnngatgtatagtataggatttgggagggatgtattaatgtggaatttgtaaaagaa

SEQ ID NO: 18588 - DNA, 960 bp, Diabrotica virgifera
  misc_feature (396)..(413): n is a, c, g, or t
aaaccaattataagaattggtcatctttaacttggcacaagacatcatgcacataaagccacatctattacatccatcactttcttttatgattccttgttttatttctctttttgttagcattttgatcaaatggctagatccttttttcttcttgtcaccgtcatcaaatatatcggttattagttcattattttcctcatatattctccatgaccctgtttgattggtctttactatgcatggaccacctacacatgataaacctccatctgtattccagtacaaagaacctaacacctcactatcatctatgtctagcataatgattttactatttgttgagacaaataattttagttccatactaatttcattatatctttttatatcagnnnnnnnnnnnnnnnnnntattattcagcaatgcataaccaaattctgtgttacatagtatcaatgtcccatttgtattatcacattcggctcttatggtatttcctaatttcactttaaagatagagttgtctattatcaaagtatctgctactaaattcatcagcatgccacttttcaatattgatgaatacctactatctcttaataataattgtaatgtatccttcttttcataatatttgctttttatctctgactgtctatagcttttttcactccttctcccatcttcattttcccttaataaattgccaaagtaaaaattccctaataatttcaaagtatcatgagcagaatatctataatgcttactatttcctattaattcataagtataacctatgtgtttgttataaattatagtagcatttgatttcaaacttgatattcttctattcttaagtagacctttattatttgcaactttcaatactttgcccccatcttgtatattgattagatcatcaaaagaccgttattttgcatattcccttacatatca

SEQ ID NO: 18589 - DNA, 534 bp, Diabrotica virgifera
ctctaagcgtccgagaaataatatttaatagatttggtacacttgtttcttgtgaagttatcagagacagaaaaactggagattctttgcagtatgcatttatcgaatttgctgaaaggaaatcatgtgaagatgcgtattttaaaatggataatatacttattgatgatagaaggatacatgtagatttcagccagagtgtatcgaaagttaagtggcttggtaaaggaagaggggtagctcattttgatgacaatggaaggtctacaaacaaatctaataatgatataggaaaaggaaactacaaaacccgacgaaaatcaccaaaaagaaataatcaaaatcaatcattttcaaactcaactcatagtcgagatagaaatagaagagataaatcaagaacacccactaggtatactaataaagaaaatagttcccataagagttcggatactaatccagtgtcatgacgagaagtataaaaatagagccaaaattagtgtcagaaacagcactccataagtcacgatccag

SEQ ID NO: 18590 - DNA, 869 bp, Diabrotica virgifera
  misc_feature (2)..(843): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaagggataaccagcgtaattta

SEQ ID NO: 18591 - DNA, 362 bp, Diabrotica virgifera
  misc_feature (13)..(13): n is a, c, g, or t
attcagcgtccgngtgagatgatttcagaagttcaccctgccctttcttgtgttgcatagacacatcagtgacaagcgatccaccagatccagaatggagtgacacttatagcggacaaggaactattcatttgacttatgtactaatatgacagcctttccatggttgatatgatcggagatctataaattcgcgcattgattactacaatgatcaccgctaagacataccaacttgataggaaatggaaatggtgtacaactggatgtaactcgattcactagggaagaggtgataaaccaaacgacgtgcttccaaataaatggaactgtggacggtccggcgactccccactcgaatt

SEQ ID NO: 18592 - DNA, 915 bp, Diabrotica virgifera
  misc_feature (2)..(905): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaccttag

SEQ ID NO: 18593 - DNA, 676 bp, Diabrotica virgifera
  misc_feature (37)..(56): n is a, c, g, or t
  misc_feature (89)..(112): n is a, c, g, or t
  misc_feature (120)..(141): n is a, c, g, or t
  misc_feature (373)..(373): n is a, c, g, or t
  misc_feature (658)..(675): n is a, c, g, or t
gtagagagaggaaaaaagaggagaaaggagagaaagnnnnnnnnnnnnnnnnnnnntacaaaagttgatgaagacgggagagaaaaaannnnnnnnnnnnnnnnnnnnnnnngaagaatnnnnnnnnnnnnnnnnnnnnnnaagttatgaatttttgagaaaatatataaatgaaattgataaggatggagtgtggagaggaaaacaaagatgtgaaaaaatttattaatgatgtaaatggagggaaagaatattggaatgatggtataagattgattgtatgggaaaaattgattatgtgttataaatggtgatggtatcaaatattttggttggaatgttgttgtattatgaggaggaaatgagtattganttataagtataagaatagaataatggttgagtgaggaatgatgtaaaatgtgtatttgattataaatttgtatgtgaaagaaatatagatgaaaaatgggaagatttgtttggaaatgaagaaaaagattggtagaatatgttaaatgtttagaaaaatgataaaaatttggatattttacatgttaatggaaaggaattgtatatatattaggagtatagaggaaaattattttgaagtattagattattgtgaagtttataacatgaaaataggaattattgnnnnnnnnnnnnnnnnnng

SEQ ID NO: 18594 - DNA, 978 bp, Diabrotica virgifera
  misc_feature (8)..(757): n is a, c, g, or t
  misc_feature (768)..(844): n is a, c, g, or t
  misc_feature (848)..(878): n is a, c, g, or t
  misc_feature (882)..(913): n is a, c, g, or t
  misc_feature (918)..(949): n is a, c, g, or t
  misc_feature (951)..(977): n is a, c, g, or t
cctttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtatgacnnnnnnnnnnnnnnnnnnnnnnnnnnnnnnnnnnnnnnnnnnnnnnnnnnnnnnnnnnnnnnnnnnnnnnnnnnnnncatnnnnnnnnnnnnnnnnnnnnnnnnnnnnnnngtcnnnnnnnnnnnnnnnnnnnnnnnnnnnnnnnnggggnnnnnnnnnnnnnnnnnnnnnnnnnnnnnnnncnnnnnnnnnnnnnnnnnnnnnnnnnnnc

SEQ ID NO: 18595 - DNA, 905 bp, Diabrotica virgifera
  misc_feature (109)..(129): n is a, c, g, or t
  misc_feature (780)..(797): n is a, c, g, or t
  misc_feature (838)..(876): n is a, c, g, or t
ctttacgcgtccgtgctggttagggggtgattttcgcgatctttttaccagggaatggaggggaccaacaatattttgagcgtaactcgcttactttgaatgctaaaannnnnnnnnnnnnnnnnnnnnggactttttttgaacactttaaaaaggttgaaatgaatttgccccgaaaggtgctccgtttttgggttgtttcacattgaaatgttcgatttggaatttgatggagaggaacctgcttttcattggctacaactctgcttctgctgggtctgcggacctcaagcgtacaacgtttttttcagttttttataagctgggtttttgctaggaatatttttttcgctcaaatacttactttttgagttatttctggaaacccgtccgaagacatgttttttttctgttaaaaatgaacatattcacttgcaaataactcgaaaagtgtggacttagggaaaaagctctgtagaacgggagttgcttggaattagtcattttatccaattccggacttattttggatgtatattttttcacccccgagaaagtgtttttcaccccgtattttccaatttttgtaaaatggaggggatgtagaattgtaaactttatcttatgtaatggtggacagtttcaactgcctattcccaaatttttatccttcctttatttttttggggtcatattgttctttgatcgggctatttagtgaaagcttcaaacagtaactatgaaaaacagttcggtaaatagtattatatattaaaactnnnnnnnnnnnnnnnnnncacctaaatctacgacatttaagtaattttaaatatcaaannnnnnnnnnnnnnnnnnnnnnnnnnnnnnnnnnnnnnnacttatttattattgtaatataaatattt

SEQ ID NO: 18596 - DNA, 926 bp, Diabrotica virgifera
  misc_feature (673)..(722): n is a, c, g, or t
cgtgacacaagagctaaagaatcgccgcggctggaaaacctataaaaaccagtcaacacttactacacgcgtttctacgacttgagagattcttgaaactcgcgatcccgcgaaggatcccatgaatcacagtggttgcgtatgcgtcggcagttttgattgatcgaggctcttgatctgtcaatattattggttgggcgtgagttttttttatatctcggtaaagttcggcaaattaggacactagcaatatgtattgaacacattttattggtgacgttttagtttagaatgggaacatgcgcagatggaaaccaagtgggtaaaggattggtggtggctataagacctccctttcaacgcatcaataactcgttgcgacgaaccaactcgcagagatatatccatagaaggccagcttcaatgtcctgctcccatttgcttccgcaagagtgcgatgaccagaactttgtgaaatgtaactattctgaaggaccttcggtgtgggccgggtctttcgaaaagctgttagctgatcccttgggacttcacatgtttgcggaattcctaaagaaagaattcagcgcagaaaacatctacttctggatagcctgcgaacgtttcaaagtattaacctcagaaaatgacagaaggaacgaagcccaaagaatannnnnnnnnnnnnnnnnnnnnnnnnnnnnnnnnnnnnnnnnnnnnnnnnncgcaggcgcgtcaaagcgtcgagaggaatctgcattccgccgatctggatctctttgcgcaggcgcagaaacagatcttcaacttaatgaagttcgacagttatccgagattcttgcgatcggattaatataaggaagtgtttggtccggtgaagaggataaaattcagatagatgttaggcttattttacacccatatcgacg

SEQ ID NO: 18597 - DNA, 950 bp, Diabrotica virgifera
  misc_feature (68)..(84): n is a, c, g, or t
  misc_feature (844)..(862): n is a, c, g, or t
aaagagacaatagaaaataattatggcagaatcaaaatatgcacaactacaaaaaacttaccaattannnnnnnnnnnnnnnnnggaagaggaggaaaacttaattcaagacctaaacaatatgttaaatcaaaaaacttttatagaagataaaattaaaggaatagccaagctaatacctaccttaaatattattacacatgaagcacaagatttagtaaatactgttaatgaaatatcagtatcttcagagaaaattagtggtaaaattagagctttagacacagcaaggagtcgtgtcaatgagtgtcaagcaagagtaagtgatttaattgatttggaaatttgttcacaaggagtgcaagctgccattctagactctgattatgaaaaaggagctgcacatgtccatcgcttcctctccatggatcaattattgcttaaaagaactgcaaatgatatggataatgtgtcaaatatgttaaaatcagtaagaactctacaagatgctgcaagtcaacttagagctatagtttcacataaatttgcagaggcagtaaacactgaagatttagtttccattgaaagattttttaaaatatttcctttgctgggattacacgaagaaggaataaaagagttttgtaactatttaaggaccaaagtttctttaactgcagaaaaaaatctgaaatctgccatcaatacaccgccatctgacaaaagacatacagtaatttacgctgatacgttaaccttactttatgaaggtctagcaaggataacagatacccatcagcctttattggaaacgtattacggccctggacgtttaatatcggcnnnnnnnnnnnnnnnnnnngagtgtgatatcccaactaaacgagtattgttggaatgggggaaaacacgacagctccaaaaaaaagattcaagtataaatgacttat

SEQ ID NO: 18598 - DNA, 586 bp, Diabrotica virgifera
  misc_feature (2)..(447): n is a, c, g, or t
  misc_feature (467)..(468): n is a, c, g, or t
  misc_feature (504)..(504): n is a, c, g, or t
  misc_feature (508)..(508): n is a, c, g, or t
  misc_feature (511)..(524): n is a, c, g, or t
  misc_feature (526)..(544): n is a, c, g, or t
  misc_feature (547)..(547): n is a, c, g, or t
  misc_feature (557)..(578): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattgnnagagtcaaatcgataataaagattgcgacctcgatngtgnatnnnnnnnnnnnnnngnnnnnnnnnnnnnnnnnnnaangtctgtcgannnnnnnnnnnnnnnnnnnnnnagttaaac

SEQ ID NO: 18599 - DNA, 441 bp, Diabrotica virgifera
  misc_feature (410)..(431): n is a, c, g, or t
tagatgaccacgaccattgatctcttctggaacctatgactaatacaactttactatcattgtgttctcggcgagagatcggagttctgcctttcaatgtataacaaattttctctgtgcagatccacctcttataatttgtcatcatctctcacgtatttagctagattcctcaatcatcatataattttcaaacggacagtcatgacactgagtgataacttttgcattatacactagaattacttgactgtgctcgattgattaacaaacatagcctctaccccagaggaaatgtacttgaatttacgtcgcccataaagggtggattttattccaggtgacctcgtacaaagtacatcctatgtttagcgatggacatgactgttgtgatcttactatgctgcgtnnnnnnnnnnnnnnnnnnnnnnatacaatgct

SEQ ID NO: 18600 - DNA, 80 bp, Diabrotica virgifera
  misc_feature (6)..(79): n is a, c, g, or t
gcgggnnnnnnnnnnnnnnnnnnnnnnnnnnnnnnnnnnnnnnnnnnnnnnnnnnnnnnnnnnnnnnnnnnnnnnnnnng

SEQ ID NO: 18601 - DNA, 784 bp, Diabrotica virgifera
  misc_feature (161)..(300): n is a, c, g, or t
aataatgcactagctcacatgggcctcaaagaattaagattatatatgctgacatataacacaaagtacttactttttaaaacacaagctttgcaagaagagcaggatatcactacaacattataattctcatattgggtggctaactttcggaagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactataagatacccttacaaaaactcactccctctgaagatggtcaaaaaataataaaatcttgtcccaacctcttgctacatccaacagttatcatcttaattcaagactcctgacataatgacttacctatctgctcctgagccaggcaatgcatgtatacaaaaacaccccgtgctacttgaatctggaagttatagtgttgtccatttccaacaggaacaagccagcttaaatccaaaccaagccgaaaccatcacagaatattcttattctttagaagccctttcacatgatgatgaatagacggattcaagttccaacactaggttttcacagaaccccttaacgataaatacttcattccatgctataactgcccgacacttgtctgctgctattgcattatgcacatctacgcagtctaatacgaacagtgctgttgtacctaccactaactctaattcctcggatataatcacaa

SEQ ID NO: 18602 - DNA, 712 bp, Diabrotica virgifera
  misc_feature (37)..(73): n is a, c, g, or t
  misc_feature (199)..(216): n is a, c, g, or t
cttggagaaactaacatcgttgacaaccatgtgcggnnnnnnnnnnnnnnnnnnnnnnnnnnnnnnnnnnnnngggcgaagcgccagctgccgctcctgcccccgccgaaaccaggtcctcctcttggagctcctccatgagagccaaaaggactaggaccaatgtcttcaccatgttctcattaactcgagctaatgnnnnnnnnnnnnnnnnnnaaattatgtacctcaactaagatgtttgttcgctaagagagtcggagttacaccttctaagtgttgaagaactcaacagagatatataattacgaatatatgtctacgaagctacctttacattataattctctcaaatgttgagataggacgttacccgtatgattgaatccgaagttactgactatgaagaaattgtcatcaaggatttccgaatcttagacgatgacattatcaatgacgatatctgattacgtcaagtcctcatgacctgtttagaaaaatacaccgttaaagaatgcaacgtcgctttcgatgccatgtacttcgacgacaacaacggatacgacgcccaggtacttatcaccctcatagcagcatccgacaagatatatgaagcagaagctacagcagaataaactacttcatatatcactactaccagtattagtacatcatctcgtacaccgagtggatccactaagacgactaccta

SEQ ID NO: 18603 - DNA, 702 bp, Diabrotica virgifera
  misc_feature (50)..(77): n is a, c, g, or t
  misc_feature (123)..(141): n is a, c, g, or t
  misc_feature (187)..(203): n is a, c, g, or t
  misc_feature (205)..(227): n is a, c, g, or t
  misc_feature (333)..(354): n is a, c, g, or t
  misc_feature (430)..(449): n is a, c, g, or t
  misc_feature (461)..(488): n is a, c, g, or t
  misc_feature (544)..(562): n is a, c, g, or t
  misc_feature (669)..(686): n is a, c, g, or t
gccccccccgcgcccggatatcttgttaaataataaagtattatcttagnnnnnnnnnnnnnnnnnnnnnnnnnnnngatagctaactagtattagtgagagaataccctatttttatcaacnnnnnnnnnnnnnnnnnnnccttgggtatccacgctgattcattaacaattatatgtttattaannnnnnnnnnnnnnnnngnnnnnnnnnnnnnnnnnnnnnnncaaatgaatatttcaaagaatttttttgtaatggaatgaggttcctttttaaatatagctcatttcttacgaaataaattagatttattcattaacagaagattcnnnnnnnnnnnnnnnnnnnnnnccaacattaaatattcttacgaatgagcttagcaataaaactttattaaaactctagttgttaaagaacaattatnnnnnnnnnnnnnnnnnnnngaaaacatgtcnnnnnnnnnnnnnnnnnnnnnnnnnnnngattctctatgaaatctttattacaatagaacgctcaagtatctataattgacccnnnnnnnnnnnnnnnnnnnctttatttgcaaatttagaaaaaatataacagcctcataccggaattcgccgacactttcctcccctgtctattaaaaacatgtgtccctgtagcaaacatccagannnnnnnnnnnnnnnnnnggtttagatgagccgc

SEQ ID NO: 18604 - DNA, 649 bp, Diabrotica virgifera
  misc_feature (139)..(160): n is a, c, g, or t
  misc_feature (194)..(224): n is a, c, g, or t
  misc_feature (243)..(264): n is a, c, g, or t
  misc_feature (269)..(288): n is a, c, g, or t
  misc_feature (312)..(332): n is a, c, g, or t
  misc_feature (350)..(390): n is a, c, g, or t
  misc_feature (436)..(455): n is a, c, g, or t
  misc_feature (458)..(474): n is a, c, g, or t
  misc_feature (476)..(490): n is a, c, g, or t
  misc_feature (534)..(551): n is a, c, g, or t
ccgggggggccgggcgccgaattccccgggcccccccccgcgccggctatattctatgagaataacgtattactccaggacaggcaaagaaagactttatttagtgatagctaattagcattgtagagagaccacttcnnnnnnnnnnnnnnnnnnnnnngtgttttgtaccttgtgaatcaccgcgtatgaannnnnnnnnnnnnnnnnnnnnnnnnnnnnnnctaaaagagctacaaaagnnnnnnnnnnnnnnnnnnnnnnctatnnnnnnnnnnnnnnnnnnnntgacaagttgttcgcttttaaacnnnnnnnnnnnnnnnnnnnnncaaatgtaaatttattcnnnnnnnnnnnnnnnnnnnnnnnnnnnnnnnnnnnnnnnnngattaaatattcttacggacgagcttaacaatagaagtttattccnnnnnnnnnnnnnnnnnnnnccnnnnnnnnnnnnnnnnncnnnnnnnnnnnnnnncattatttatgcctagatattattatttctattttttatagacnnnnnnnnnnnnnnnnnngttacagtatttcaatttagccctgatgatcatattactatcagcaaattgcatatttactaaaaatatatcggcctaataccggaatgcgccgaccc

SEQ ID NO: 18605 - DNA, 967 bp, Diabrotica virgifera
  misc_feature (377)..(395): n is a, c, g, or t
  misc_feature (580)..(596): n is a, c, g, or t
  misc_feature (839)..(839): n is a, c, g, or t
  misc_feature (877)..(877): n is a, c, g, or t
acaactcctttgtcttgcaagagctatagtacgaaacaataaggttcttgttatggatgaagctactgccaatgtagacccaggcactgatgccctaatccagaaaaaaatccgtgagaggtttagagactgtactgtacttaccatcgcccatcgacttaatactgttatggattcagaccgcgtgctggtaatggatgccggagaagcagtagaatttgaccatccttttaaacttctacaaaacccagacggatattttagtagaatgcttagagagacgggaccagctatggaagaaatgttgaaggcagtggcagaggaagattataataagaagtacggcggaataaaggggaaaaagggggaatagatannnnnnnnnnnnnnnnnnncttatcgttgaaaatgacgatgcaatagacagaagttgaacagtgtattgtaaagttattccttccgtaacgattggaagtattacaaaagtttaaactacacttgagtgcaaaacagtcgactcaaaagcgagatttgagattgcccctgtttcaatgtaagaaatatgaaaataagaatattnnnnnnnnnnnnnnnnntttattatagttgttccattttatctttgcccaaacgtcatgactcattttcaaacaagttaaagaaaaacaataattgaaacgtacgtctattcatcatcatcaataattcatcatgtcattgatacgtactgtcaatgtaataataattaggaaatggctattatcggtggacgtattttataaagttatattgtacatttatattttactgtgatatttaacacaatataactttataanatgaacacaatataagttataaattccaataacataancaaagcgctaatgtccctgtcattgaaaatgataaacgtcaaaattatagtaaacaaggtattaaagacatgccgtattgtttatccatg

SEQ ID NO: 18606 - DNA, 712 bp, Diabrotica virgifera
  misc_feature (18)..(35): n is a, c, g, or t
  misc_feature (125)..(142): n is a, c, g, or t
  misc_feature (261)..(281): n is a, c, g, or t
  misc_feature (313)..(339): n is a, c, g, or t
  misc_feature (344)..(384): n is a, c, g, or t
  misc_feature (430)..(449): n is a, c, g, or t
  misc_feature (527)..(545): n is a, c, g, or t
ggggccggccccgaattnnnnnnnnnnnnnnnnnngccggagctgttgtaagataataacgtattacttcaggacagagaaacaaagattttatttagtgatagccaattagcattgttgagacnnnnnnnnnnnnnnnnnncacaaaaacttattgttttgtaccttgggtacccacgccgtattaattaacaattatagatttattaatcttcgaattcaaaagaggtaaaaaattaaaacttttattggcaaataacnnnnnnnnnnnnnnnnnnnnntatggcaagtggttcctttttaaacatctcgnnnnnnnnnnnnnnnnnnnnnnnnnnntttcnnnnnnnnnnnnnnnnnnnnnnnnnnnnnnnnnnnnnnnnncattaaatattcttacggaacggtgttaacaatagaactttattcnnnnnnnnnnnnnnnnnnnnacctatggtttagaattctactattttcagatatagttattatttatgtttagatattattattttcagttctcatgnnnnnnnnnnnnnnnnnnncagttacattatctctaatcaccccagatgataatatgattattcgccgattgcacatttgttgaccatatacctgcctcatacaggcatgcgcccacccctttttcaccctgtttataagaacctgccctcctcgtcgcaatcgccaaggctcgcctgcccactga

SEQ ID NO: 18607 - DNA, 969 bp, Diabrotica virgifera
  misc_feature (864)..(864): n is a, c, g, or t
  misc_feature (899)..(899): n is a, c, g, or t
gcattccctaataaagggttatagaatgaatttttggttgtttttgtttaaatatgtcaacaaaattaaagttatatctaggaagaaaggtaatagatgttctacataactcaagaaagttatccgctttggaactacagcctttaataagactaggaaacactgccgaagataaaatagaactcagtttacctcttaacgtcttagaaaaacaactaggcgttacaaatattacagaaattttgaaaatacagccagatgatatcattaaaaatgtacaagttgtacgggaccgtgcaaacagaaggattgcttttgagatcgataaatacatatttgttaaagatgtaatggaaaacagtgcttccccagaccttaatgataaacctagaaatgttgtcatagactatagctcgccaaatatcgcaaaaccttttcattttggccatttgaggtctactatcattggtaactttcttagcaacttaaatcatttcttgagtaataaagtgaccagattaaattatataggaaactggggtactcagtatggttttatcaaattaggggtagaagatttgaagtataccattaaagacattgaaaaagatccactcaaattgttgtataaaagttacgtacatgctaacactatggctgaaagggatcccaagttcttacaaagggcaaaagacatattttcgcaattggagagtgggtctaagaaggaattgcaattttggaaaaacgtaatggaattttcgaaaaacgatttaatagaaacatacaagagacttggtattaagtttgatgtttataattacgaatctgattataatgttaaggaacttgaggatgtattgnagattctgagaaaaaagatattattcataaagatnaagatgggaaggaatcgacagttatagacgatagaagagtcacagtagtaaagagtgacggttcaggttt

SEQ ID NO: 18608 - DNA, 626 bp, Diabrotica virgifera
tttcacgcgtccggaagtgtcgagagcgttgcgtagaactttttttacagaaattgcgaaaaatgggattgttccgtcgactaacacctacgaaattatcagatacaccaaaattaaaatctcaagttgcagtcgtcctcagacagctaagcgttagtccagcggacctcgaagatgtacttgcagataatataccacaggaaacagttcgattcttgaatttccgcaaacaacatggagactctaaagtcgtagaagttatcgttgaaccgaggaatggtggtatgagaggaatcaaagccttgaaagcggatacctcagtgttggaccccgacctgatgaccaggttctgaggactttccattccggaatgccaaaacgatctcccccaagcaccatgtgttcgcttttcactccgacaaggactcttctggatcttgatctcctgcaacacaccaacctaagctctattcccacgaccatccatactctgcttgcgatgttgtgaactgtcgtcacacgacgatcaagacttgaacttcccgccgagatattcgcatccccatgatgtcggtacccgcacctatattcgcagtcgacatagacccattagatatggccctaat

SEQ ID NO: 18609 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18610 - DNA, 842 bp, Diabrotica virgifera
  misc_feature (2)..(44): n is a, c, g, or t
  misc_feature (52)..(769): n is a, c, g, or t
  misc_feature (771)..(838): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnngtga

SEQ ID NO: 18611 - DNA, 638 bp, Diabrotica virgifera
gtagcgatgagagctaggtcgaaagccatcgtggagatattgttgaggaatccgaagaatagccagcttttgtatagaccgaatagatcgggggagactccctataacatcgatgtgaatcaccagaagacgattttaggacaaatttttggtgcaaaatgatagtatgacatctcacaactacattgtggaagatctaggagaagatggtgttatgccatagaggaaatggtcattgaaaatatcatcgaatttgtttctttttagggagattaaatacaaatgaagacaacgaaaatatgttaggttatgatctgtatagtagtgcgttagctgacatattaagcgaaccttccctttccatgcccataatggtaggcctctatgccaagtggggtagcggaaagtcatttctactcagtaaacttagagatgaaatgaagaatttcgcccgtgaatgggtggatcccgtcttccagttttccacattgctctttcttgttattgcacacatttccatagttatagctatagttttaggcctttcctttcaatcatgggaagtagggttatctgttagtgccggtgttataagtttatgttacgtaatactcgtcaatagttggatcgcatagtaa

SEQ ID NO: 18612 - DNA, 679 bp, Diabrotica virgifera
  misc_feature (35)..(57): n is a, c, g, or t
  misc_feature (97)..(126): n is a, c, g, or t
  misc_feature (139)..(159): n is a, c, g, or t
  misc_feature (163)..(177): n is a, c, g, or t
  misc_feature (179)..(198): n is a, c, g, or t
  misc_feature (203)..(261): n is a, c, g, or t
  misc_feature (281)..(331): n is a, c, g, or t
  misc_feature (333)..(356): n is a, c, g, or t
  misc_feature (382)..(401): n is a, c, g, or t
  misc_feature (474)..(493): n is a, c, g, or t
gcgcccgcttatttatatttttagtgatcttagcnnnnnnnnnnnnnnnnnnnnnnnggtaaagaaaccattttatttaatgatagactaattaggnnnnnnnnnnnnnnnnnnnnnnnnnnnnnngagaactctatcnnnnnnnnnnnnnnnnnnnnnaccnnnnnnnnnnnnnnngnnnnnnnnnnnnnnnnnnnngtttnnnnnnnnnnnnnnnnnnnnnnnnnnnnnnnnnnnnnnnnnnnnnnnnnnnnnnnnnnncaacgccatggtattcgggnnnnnnnnnnnnnnnnnnnnnnnnnnnnnnnnnnnnnnnnnnnnnnnnnnngnnnnnnnnnnnnnnnnnnnnnnnnattattagcattaaatatttctaccnnnnnnnnnnnnnnnnnnnncttattaaaacgtaacttctagataagaatcacccttaaaacccctcccatcttaaaatatgccatctattcnnnnnnnnnnnnnnnnnnnncttatctgtcataaccttcccactagaatataactctacgccatcctccctcagccatgatgataccattagcattaaaaccgtggcccacgaagcaaaaatatataccctcactaacggactcccccccccccctcttcacctgttttattccaaaaggtgtcttccgcgcctctactataaaga

SEQ ID NO: 18613 - DNA, 910 bp, Diabrotica virgifera
  misc_feature (427)..(452): n is a, c, g, or t
gccatcgccttggaccaaatagtgatgacgacgatgattcaggagagccaatgactaaggttgaagatgacaccgacgatagtgataatgacgatggacctccgttcgttgatgtaccatcaactagtgcagatgatcaacctggaccctcgggcgttggcaaagatggagtagaagcaccgtgagtacttgttttatttcacaccaaattgtaccttttacctgggtgtacgtcacacggtgctggttctgtcaatatttttggttgttttactttttttcgatgatagtttcgcgaagaatttacgattttattagaattatttctcaaaagaattttgctgcgttattaatttgagatagttatttattttatcagtttttcgtgtaatgatttatcaattttgtcagtcagttatcacttttnnnnnnnnnnnnnnnnnnnnnnnnnngaagtgtttcggtctagggatgatatttttatttgatgtggcaaaaccagtagtttttttgttttcatgtttttttattgcagtcattttcaattgtttatgtataaagaaaagtacatccaggtaacctttataccatcagcaaatgctaaaatggattgtcttgaaaccttaaaaaagttcattctcctcgtttttcttttgattttttgtgaatttaattgtgtgattatgtttttgtttgataatgcgttgttgctttatttttatatagaaagagagttgattttctgctcagttctttcacaaaaataagaaatattacttaatgtttctgtctggtttgaagaacatttttgaaaattgattggccctttgaattttaaaaaaaatcatttgaagacctgtacaagacttcctaaatggtttttaatgaagttttgccttggttttagcat

SEQ ID NO: 18614 - DNA, 690 bp, Diabrotica virgifera
  misc_feature (3)..(48): n is a, c, g, or t
  misc_feature (53)..(491): n is a, c, g, or t
  misc_feature (498)..(535): n is a, c, g, or t
  misc_feature (555)..(568): n is a, c, g, or t
  misc_feature (571)..(593): n is a, c, g, or t
  misc_feature (601)..(623): n is a, c, g, or t
  misc_feature (653)..(684): n is a, c, g, or t
ggnnnnnnnnnnnnnnnnnnnnnnnnnnnnnnnnnnnnnnnnnnnnnnatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 18615 - DNA, 740 bp, Diabrotica virgifera
  misc_feature (34)..(55): n is a, c, g, or t
  misc_feature (65)..(85): n is a, c, g, or t
  misc_feature (207)..(254): n is a, c, g, or t
  misc_feature (271)..(302): n is a, c, g, or t
  misc_feature (316)..(359): n is a, c, g, or t
  misc_feature (376)..(417): n is a, c, g, or t
  misc_feature (457)..(541): n is a, c, g, or t
  misc_feature (715)..(736): n is a, c, g, or t
agggggtgcccccgcgggagccggcccggaattnnnnnnnnnnnnnnnnnnnnnngagttgttgnnnnnnnnnnnnnnnnnnnnncaggaaaacgtaagcgaaagactttattataatgatagctaattagtagttgtgagagaatactctatttttacaaaacaacaatttagtttttgaaccttcgggtctccgcgcactattgnnnnnnnnnnnnnnnnnnnnnnnnnnnnnnnnnnnnnnnnnnnnnnnnctaaaacttttattgtnnnnnnnnnnnnnnnnnnnnnnnnnnnnnnnnggaagggtgttccnnnnnnnnnnnnnnnnnnnnnnnnnnnnnnnnnnnnnnnnnnnncattaacagtagatcgnnnnnnnnnnnnnnnnnnnnnnnnnnnnnnnnnnnnnnnnnngaacgaggttagaaaaaaaagtttattaaaatttagattnnnnnnnnnnnnnnnnnnnnnnnnnnnnnnnnnnnnnnnnnnnnnnnnnnnnnnnnnnnnnnnnnnnnnnnnnnnnnnnnnnnnnaaactctttattaaaatagaaagataaattatttaagattagacctgaggataatattacgtattaacaaattgcatatatagaaaaaatatatagggctgatacaaggattcgacgagccttttttcacctgtttatctaagaacatggcctttagtagcgaacatcaagtcnnnnnnnnnnnnnnnnnnnnnnagaa

SEQ ID NO: 18616 - DNA, 421 bp, Diabrotica virgifera
  misc_feature (2)..(420): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 18617 - DNA, 155 bp, Diabrotica virgifera; identical to SEQ ID NO: 18375
  misc_feature (20)..(33): n is a, c, g, or t
  misc_feature (36)..(58): n is a, c, g, or t
  misc_feature (66)..(88): n is a, c, g, or t
  misc_feature (118)..(149): n is a, c, g, or t

SEQ ID NO: 18618 - DNA, 209 bp, Diabrotica virgifera
  misc_feature (6)..(28): n is a, c, g, or t
  misc_feature (31)..(50): n is a, c, g, or t
caagannnnnnnnnnnnnnnnnnnnnnngtnnnnnnnnnnnnnnnnnnnntatgttgaggatgataggttggacgtctctaaatattttaagatccatactgtattttttcattcaaggcgtgctactatgctataaggtgttagaacatgtgaaacgaaatgaacttacaagtgtggatgacaatcaaaataaattcttactatattg

SEQ ID NO: 18619 - DNA, 924 bp, Diabrotica virgifera
  misc_feature (563)..(581): n is a, c, g, or t
aatataaataacttttaaatgcaaaaacaggacaaaaaatccaacaaactgtcagccataagtaaacaaaccagtattgtacttaaaatctgaaaactgaaaacataaattgtacttaaaatctgaaaacgtccccaatcgtcctttttgtacctattttcgatgtactgagtctagagcgttcataaaaataacatgtgtctttacttaataacaggcggtagctgtttgtgtctttagtttcatgcgtggaagacaatgatgctagataaaaagtatgtgttttatctcgccaggtattaatgatgcacgggtaaagcaccttggactcaactgtataccatatggaagtataagtgctgtataatcttgtacaaagtataaatgaaattgtagtagctttcattagttgttcctgagtttagtaataatacaatctcatagactcctttagtacatgtacttaagaatataatatgttacatatattatttagactgaatattgttgagttgaagtattccaaattttcctagatctcttagttttattagtgtacatgnnnnnnnnnnnnnnnnnnncactacacaacaattacaaaagttgttgtttctctctgtattttattccccttaccatgatcacctaaattctgttttgttctagtctattatacataaattataatctctcaactaattttgtgatcaaatccaatctagtaggtacttattatttaagtaaagaaacttattatttctaccactgtagtctcctctgccatagtatatctaccctcaaaagattgtaggagagtgtccagtgtccacattgtgcttcaaatgaacagtgacactaattacgaaagtgtcttacccgaattaatttgtttctaaatacaatcagaggcttcacagccaaatc

SEQ ID NO: 18620 - DNA, 826 bp, Diabrotica virgifera
  misc_feature (113)..(131): n is a, c, g, or t
  misc_feature (487)..(505): n is a, c, g, or t
  misc_feature (677)..(695): n is a, c, g, or t
  misc_feature (772)..(796): n is a, c, g, or t
gtgtgacgtggatatattgatattgtgtgacttatgacggaggctcgaaacgagtgactatggatgaaaagccctatttcgaatttatttattcctttgtgagtatctattcnnnnnnnnnnnnnnnnnnnattaacagataaattagcactgctaaaaccatttttactatcaaattgttttatattatccttattctgcagatagatagatcctttgatagatataaaactactaaactatagagaaaatcggaattggagaaatttatagtcacaataaatacatagttcaactttttaatacaatttttgaacaataaatacatttacaatgttctaaaatttcattgtatcaggtgataaaattagtatatctgtgaaaaaatcattgatttcatgtaaaaaatcttatatagatatttgatggttttaaatacgaggggtagctgatgaaaggtctgtgcagaagtacggctgattttgcnnnnnnnnnnnnnnnnnnncacggaaagtgaaaaaatcattcatcaaaacgtttctgcaagtacttggagggaatgcgagaaacgatcgtgctcgaatagcggagaaatcttgcaactttcttaaacaattcatattgtcaattgaaattgtcaaattgatgtatatttcatatctactgaccctactgtnnnnnnnnnnnnnnnnnnntgttgctccacaatagtaatatgatataattgaatatgaaaatatttcattaattgtattttgcttgcagtactgcnnnnnnnnnnnnnnnnnnnnnnnnntacctacaattgtttaccttttaataacat

SEQ ID NO: 18621 - DNA, 720 bp, Diabrotica virgifera
  misc_feature (2)..(719): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 18622 - DNA, 561 bp, Diabrotica virgifera
  misc_feature (237)..(254): n is a, c, g, or t
  misc_feature (435)..(453): n is a, c, g, or t
gcgcctgcggggaccgcgccgtatttcccgcgccccctcccgcgcgcgactttacttatataataataagacgtcagcccactagaaaaagtaaagaccaacattagtccgctgcttggtaatgaccgtatgagagagtatttctcaccattatcaaagtatattctatttcttgtacgttgtggatcatgcatcataaactaagaattatctatttattatttcctaagagacaannnnnnnnnnnnnnnnnngcttattgaaaaacacatataatatattggttatgagcaacgtactgacatgcgagtgtctaggatatctaaatatataagaaataaattgtatttatccatccaccatatattgataatacagtgtattcccaaaatgaaacacagtaagacgtaggcatgagttaaaaaccaaactacnnnnnnnnnnnnnnnnnnncataaatcactaggattagtcatattcttatatgagaacacgccattacttatatttatatattagtacccgtactacttataacgtctttacagaaatattctgtta

SEQ ID NO: 18623 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18624 - DNA, 916 bp, Diabrotica virgifera
  misc_feature (2)..(14): n is a, c, g, or t
  misc_feature (17)..(29): n is a, c, g, or t
  misc_feature (183)..(204): n is a, c, g, or t
cnnnnnnnnnnnnnctnnnnnnnnnnnnngcaatgaggatattattttacaagatttaaagaaagggggctttatggtacatgcaagagaagagcccatgaatattgctcatctgaaaatgggcttaaaatcttatgcaaagttacgtgccatgtctttagctctgaaagaccaaaagagagnnnnnnnnnnnnnnnnnnnnnngacctgtacttccttagcgaatcagctgttttcaacgtctaaaaaagtgtttaatacaaagacacccatagttagcagaaactctaaaagaagctggtcgacctgatttgtcgatcttgtttaataagcacatacatgacagaagtatgtatactagatttatggaaataggcaatactatttctaaagatcaagcaatagcacatgtggattgtcacaacgtaaatatgatgtgtcaatataaggatgacgataaatctgttccacttcgcatggtgttgatagatttccaagcgtcttttattcattcaccagtactcgatctctcctattttctatgcatgaatttatcaccaactgaagctccgaaaataaaagattttgtggagtattactatactgagttctgctcatatctaaaacaattagggagtgacgctgacacagtatttccgagaagcatttttgaagaacatttagaacaatatctaccatatgaatttcttttgatactagcattattacaaatattttatcttgaaaatgaagatacaccgatctttccttgatgaaaccaactctttctttggaggtttgtcgaatgacctaaaattaaaatcacgcgacccatatttgaaacggctgctgccactagtggataccttttttcatggtccatatgcgtaaacccaaaattatcctggctttttat

SEQ ID NO: 18625 - DNA, 797 bp, Diabrotica virgifera
  misc_feature (241)..(268): n is a, c, g, or t
  misc_feature (540)..(560): n is a, c, g, or t
  misc_feature (759)..(771): n is a, c, g, or t
  misc_feature (773)..(790): n is a, c, g, or t
cgcctgactgattggcgcgtgaatggcacctgactgaagtaaccatatcacgcgctggagtgtgatcgtcagcgaatgggttaaatgacaagtggttatagatgtttatacagtctaaataaatacagtgagttaaatattgggtcgagctctccgtgggtaataataattattggttcaaaaggatccaaacttgtcacgggttagctctgccggacaatagattcagtaaaacacaggnnnnnnnnnnnnnnnnnnnnnnnnnnnnaatccaatacaataaaataacaacaaaatagtattcaattctccgactattgtctcccttttggcacccatatcgagccgttgttgatgaaatcgggtctcttagttctcttgtttgactataacaattttctttgttatcgaatatttggatctggcatttattatcttaatatctatctttttcacatttttacaaataacacaaattatttacgtaataacacaagttattacatacacttttatacctatataatttctataaatgcnnnnnnnnnnnnnnnnnnnnnacatttaattacatcagtgattcatcatttcattacatcagtgattatttgtgttttgcgaataaacttgatttagcatgttatataagaattttgtattagatatttggtttatatagaaaaagtccatgtttctcagtgatttgctagaatatataatgcaatccacaattgaatacaaattttctcgatagactgnnnnnnnnnnnnngnnnnnnnnnnnnnnnnnntggttac

SEQ ID NO: 18626 - DNA, 629 bp, Diabrotica virgifera
  misc_feature (30)..(60): n is a, c, g, or t
  misc_feature (64)..(91): n is a, c, g, or t
  misc_feature (114)..(155): n is a, c, g, or t
  misc_feature (172)..(209): n is a, c, g, or t
  misc_feature (215)..(269): n is a, c, g, or t
  misc_feature (288)..(333): n is a, c, g, or t
  misc_feature (398)..(417): n is a, c, g, or t
  misc_feature (419)..(433): n is a, c, g, or t
  misc_feature (568)..(586): n is a, c, g, or t
ggaattcccgggcccccccccgcgcccgannnnnnnnnnnnnnnnnnnnnnnnnnnnnnntccnnnnnnnnnnnnnnnnnnnnnnnnnnnngtgacagatatttagtagggagnnnnnnnnnnnnnnnnnnnnnnnnnnnnnnnnnnnnnnnnnncccgtgtgtctcagggnnnnnnnnnnnnnnnnnnnnnnnnnnnnnnnnnnnnnnataagnnnnnnnnnnnnnnnnnnnnnnnnnnnnnnnnnnnnnnnnnnnnnnnnnnnnnnngaagtgacgcgatacgcgnnnnnnnnnnnnnnnnnnnnnnnnnnnnnnnnnnnnnnnnnnnnnncgaacaatatattaataataagatattgttatactaataatatcgaatatcatgagggatgactnnnnnnnnnnnnnnnnnnnncnnnnnnnnnnnnnnngaagaattaggataagaaattttcttatttaaacaaagggaaccattcatctcaataaataatcatcttgacacttaaaaatttttaacgaaaatataacgttcacttatcttaacttgaggcggctgataatgnnnnnnnnnnnnnnnnnnntacttaggaacaagatacagggttaataaaggaagtcagccac

SEQ ID NO: 18627 - DNA, 357 bp, Diabrotica virgifera
  misc_feature (15)..(32): n is a, c, g, or t
  misc_feature (100)..(117): n is a, c, g, or t
ggttttttgttgtgnnnnnnnnnnnnnnnnnngatgattatgtggagaaagaaagggggggggggagaggcaaaacgatgggggaagaagagagggaacnnnnnnnnnnnnnnnnnnaggaagagactgctgagcggaagatgcggagaggagggaggagacgagaagcgaggagagatgagagagaagggaaggggggagcgagaggaaaagacggagaagggaagcaaagaggaggagtcgagggaagaggtgagaacggaaagaagggaagagaagagaggggcggcagtgaaaggaagggggaaaagaaggaaatagaaggagcagaaagagaagggattgagagagtagaag

SEQ ID NO: 18628 - DNA, 422 bp, Diabrotica virgifera
taatgaagtaaaaaattattatgcttaatggaacataagtagattaagttgctttgagcaacgtcaagccatgcaataattggatgttgttatgtataggaaaaacactgatattatgtaatcacaatatattgatccaatattgtattatcaaaatgataaatgtgaagacagagcgcaagactgaaggaccaagctacaatgaatttttaactttaacaacaacactagcaattgacatagttgtaaatgcggaaacgacattaattatatgtatatatatagtatcccccactaatacttacgtttttaatgaaataatattggtaagtgatctcacctcggaattgagggtatgacaggtatggaactatttctcacaaataggatccatctttgatatttaattgccgtttgccaac

SEQ ID NO: 18629 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18630 - DNA, 732 bp, Diabrotica virgifera
  misc_feature (93)..(118): n is a, c, g, or t
  misc_feature (266)..(293): n is a, c, g, or t
  misc_feature (306)..(333): n is a, c, g, or t
  misc_feature (432)..(468): n is a, c, g, or t
  misc_feature (491)..(530): n is a, c, g, or t
  misc_feature (532)..(558): n is a, c, g, or t
  misc_feature (567)..(588): n is a, c, g, or t
ccccccccccccccactccctactccggaaagctgttccgccctccaggtacccgccccggcatcccccccctcccccccctcctccgatccnnnnnnnnnnnnnnnnnnnnnnnnnnccccctagaagaagtaaagaaaaatcttctctcacgatagttcatcagtatcgcgagagaatacctccccttcataaaagaaaactctacttttcgtacctcgcgcatcagcgatcattaaccaataattatctacttatcatcctcnnnnnnnnnnnnnnnnnnnnnnnnnnnntcttatcgtaaannnnnnnnnnnnnnnnnnnnnnnnnnnntgaaacgctattcgttcttaaacacatctaatcttttaagaaatcaaactaaacctatccaccaacaatatattataactcaatattttcccataaccnnnnnnnnnnnnnnnnnnnnnnnnnnnnnnnnnnnnncctctattaaaacttaatttccnnnnnnnnnnnnnnnnnnnnnnnnnnnnnnnnnnnnnnnncnnnnnnnnnnnnnnnnnnnnnnnnnnnctttcatcnnnnnnnnnnnnnnnnnnnnnntacaaatttaaattatctaaactctcctaccgatgctcatactagaataaaaaaattgtctccccacaagaaatacataggtttaataatggaactcggccacatcttttctccccgcctatcaaacacacgcctcttcgtatt

SEQ ID NO: 18631 - DNA, 163 bp, Diabrotica virgifera
  misc_feature (4)..(44): n is a, c, g, or t
  misc_feature (50)..(92): n is a, c, g, or t
  misc_feature (111)..(143): n is a, c, g, or t
  misc_feature (149)..(161): n is a, c, g, or t
gagnnnnnnnnnnnnnnnnnnnnnnnnnnnnnnnnnnnnnnnnnataacnnnnnnnnnnnnnnnnnnnnnnnnnnnnnnnnnnnnnnnnnnnctatttacatgcgtgatcnnnnnnnnnnnnnnnnnnnnnnnnnnnnnnnnncattannnnnnnnnnnnncc

SEQ ID NO: 18632 - DNA, 79 bp, Diabrotica virgifera
  misc_feature (9)..(9): n is a, c, g, or t
  misc_feature (15)..(78): n is a, c, g, or t
ttattatantataannnnnnnnnnnnnnnnnnnnnnnnnnnnnnnnnnnnnnnnnnnnnnnnnnnnnnnnnnnnnnnna

SEQ ID NO: 18633 - DNA, 762 bp, Diabrotica virgifera
atggcatatggatcgagggtctcaatatctgacagcttccgattctaaaaacgaccgccccatataggtcattcttgcgcagagagtccctcctccaccccagattaaattcgaattcgatgatattagaccaccaaaaaaagatgatacgacaaggttgtttatgccggacttaagggaggatgcaacggctgtgctgaaacgatcgcacttattgatataaccgattagataaatgactgtaatccaaataacttcacccgcgcccattgaaactctgaataggaaaccactatcttcttcaaaaaagaagagaccgtcgtattgaagataccagacatatcgcaaatctcttcagtgcctaagatgggatctatggaatgcgggaactactctatatgacaatatagattatctgagttatgctcacttttatggtgacataggacttctctcttttagcgcccagtcgagtcattgcagatatcgtagtatgaagagattaccatgtttcagtggaaagacagaacatagctgactgtgatcgactactatagacgtgcatctatactttaaaagctatagtggtgctattcgctgtcgatcattggaaaattatagttgcacaatgttattatgccaatcgagaccatggattgattcagtatgatagggactgccagttgacaagtcgaagattttcccagattactgcagcagagaggtagacgattctgtcctgagtgctctgatcctgatgaa

SEQ ID NO: 18634 - DNA, 446 bp, Diabrotica virgifera
  misc_feature (26)..(41): n is a, c, g, or t
  misc_feature (44)..(76): n is a, c, g, or t
ctgttaacagccgattacaagtactnnnnnnnnnnnnnnnnagnnnnnnnnnnnnnnnnnnnnnnnnnnnnnnnnncgctgatcccgttgcctttatgaaacatttcctctctgtttggatctccgccgcaaaggaataagaattgaataaccatatttcgtaatatattagcaatgagaaaaactttaatattaagatcatatatggacaattagagtgttctagtatttttttgggacgggcccggaagctcatatttacgtctaaataattatgcaagaaataaattcactgaatctagtaaaggttaatttatgagtacatatacttatcgcactactatgtacgacatttttcctaataatattataattaaatattgtattaatagacagtgtttaagccgaggatggtaattattttgtcgaccgcgaaaaattgatct

SEQ ID NO: 18635 - DNA, 332 bp, Diabrotica virgifera
  misc_feature (154)..(170): n is a, c, g, or t
  misc_feature (203)..(203): n is a, c, g, or t
  misc_feature (224)..(247): n is a, c, g, or t
cttgatatatgaaccagcaactacgttagacttaactattcgtatatcgctattaccactattacgccaaaatataatacgaaaaatcgaaaattaaacgtacctacctacgggagaatttgatttttatcacaaacatgttgaaaaatttaannnnnnnnnnnnnnnnnttaccgagaggcttttatttacaaatggctcanaatgttttgccattccaactnnnnnnnnnnnnnnnnnnnnnnnncttggaccatttgtgtgcccttgatatcaattccagagcctcgtttatccgtctttctggaataatatgtaccattggacccgct

SEQ ID NO: 18636 - DNA, 575 bp, Diabrotica virgifera
  misc_feature (20)..(37): n is a, c, g, or t
  misc_feature (101)..(139): n is a, c, g, or t
  misc_feature (169)..(191): n is a, c, g, or t
  misc_feature (235)..(256): n is a, c, g, or t
  misc_feature (315)..(328): n is a, c, g, or t
  misc_feature (331)..(349): n is a, c, g, or t
ccccccgcgccgcgcggtcnnnnnnnnnnnnnnnnnngatgttttcttaaaagagcagaaaaagtcatattttgtgagagccaattacgaattgtcgggannnnnnnnnnnnnnnnnnnnnnnnnnnnnnnnnnnnnnncgctcccggggcaccccggattaccaaccnnnnnnnnnnnnnnnnnnnnnnncgaaacaagagcaggccacaattcgaattattatagcgcaagannnnnnnnnnnnnnnnnnnnnntggagcgagcgcgctccgcggctacatatatatcctcttttttaagacaaacataaacnnnnnnnnnnnnnncannnnnnnnnnnnnnnnnnnttatatacctaaactacaaatattctgcagagatgagcctataaataaaactttatataaaatttaattcttagataagagatacaataaacaaaatttccaatttcaaaaacggggaaatcttaacttatacataataataattacctcttctaaaaagtttataataaaagaatcacttaaactaatcaaatgtagtggcggcgaacacaggaccaataaaaga

SEQ ID NO: 18637 - DNA, 984 bp, Diabrotica virgifera
  misc_feature (830)..(830): n is a, c, g, or t
  misc_feature (837)..(837): n is a, c, g, or t
  misc_feature (871)..(871): n is a, c, g, or t
  misc_feature (948)..(948): n is a, c, g, or t
cgacaaatacggatgcatgtcaatgacaatcatcggagggatcatttgcactattggtcttgctctcagctcgtatgcccgcaccataggggtaatgtatttaacctttggagtcatcggcggcctaggacttactttatgttttgtaacagcggtagtctcgatagccttttggttcgagaagaagagaactatagctctgggactggctgccagcggaactggattcggtacggcagtttattcccctctggctacctggcttctctttgagtacggctggagaggaacgctgttgattactgctggattttttgccaatatgtgtgtttgcggtgcgttaatgagagatccagactggataattgaagaagaaagggaagagaagaagctaaaaaaagagagaaggaaaaagtcgagtgcttcttcaattgatacagaatgtctcgaagaaatcaaacatgtccttgaagagggaggcgacacgcaatatttgcttcaagacgtcgacgccactttagatttaagcgataaggatagatttaattcagttgttgatttacctacgttcgttagagaaaacgaaaaagttccgttagaagtattaaaacatttaagcgaaaataaacaattatacagtattattgtagacaattacccaaatttattatcaggtcgcagttcgtcagacagagaattaaacatttcttacatggcaaatcgacatacgtctagagttcccgtaagactttccatgaaagtaaaaattcctgaagaacatgaccccaataaacctgaatcgaatacgcctcttttacagcgaccctcanaaaattnttccgaatactcaaaccctgcaagtgaagctgtncaatctactgatagtaaaacggaggttggaagaccttcaaaaaatttatctgaagtatccaagtctacagatactanaatggtgactgagaagaccgtcaaaaaatttatctg

SEQ ID NO: 18638 - DNA, 855 bp, Diabrotica virgifera
cgttgggctgtaaacctcatgaaaacgtctcgacaacttgaccttctgataagaaaagctgcagcctcagaactattccctggagagtcgagtggttacaatagttcagcaagttcagttactgaagatcaaagttcatcgtggggagatcctaaaaggttgtcgatagttaaagaagaaaaccaacatacagaagagaggttaaatcaaagaagttttaccaatagttggaatttaccagattgttaagaggaaccaactgaaaaaagtgtatacaaaccaaccatcatcaatgttactgaaagtggaactactatcaaaaataatggcatagaatacgtctcaaataagctagaacaaaacgcttcccatttggaagaccacaagatgccagagagaagagacagcaaagtagttgtagaagtgcatagaagcgacgaagatgacagtccctgtggagtgaacggactagctaaaagctcgtctagcagtagtctagcaagtaaggccagtttaacaagtgcagctagcagtagtttgtcatcggcaatatccatggagcttaagagaagatcggagaaaaaagcaacgaaaccaccagaagacacgtcaatcgatgaacagttacagaaaaaaaagttacttaggggacttagttctgaccaacagtttcagcacaccaaactcatgaacgaatttaagcaggctcatcaaaaaatgttcaaaacgtctagtctggattgtacaatatctaattccgccctagggaatgatactttagagaggcttgcccacaaggaactgtcccaaaaattgtcagatcgtttgctcaacttagccagtaatgaaaacaat

SEQ ID NO: 18639 - DNA, 718 bp, Diabrotica virgifera
  misc_feature (12)..(524): n is a, c, g, or t
  misc_feature (526)..(568): n is a, c, g, or t
  misc_feature (570)..(588): n is a, c, g, or t
  misc_feature (590)..(603): n is a, c, g, or t
  misc_feature (624)..(642): n is a, c, g, or t
  misc_feature (644)..(658): n is a, c, g, or t
  misc_feature (660)..(672): n is a, c, g, or t
gtttgtacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnntnnnnnnnnnnnnnnnnnnncnnnnnnnnnnnnnnattttttattgagagctcgtnnnnnnnnnnnnnnnnnnngnnnnnnnnnnnnnnncnnnnnnnnnnnnngattatttttaagtcaagaagcttagattttttgtaaagacgagac

SEQ ID NO: 18640 - DNA, 767 bp, Diabrotica virgifera
ctgaaaaggatctttcacgtttaaacgaacatagactttccaccttccagcagatttctaaaattcaacaagttttttggaaacgttggtcggttgattacttaaatcgccttcagaaccggcctaaatgggctgaagaatattctaacctgcaagtaaataaactagttttactcaaggaagataatgtacctccaatgatgtagccgttggcgcgtatcattgaagtatatcctggtaaggatggcaaagtccgtgtggttaagctccgtacggcttccggagagtttatccgatccatttcaaagctttctttattaccaaatcaaactcaaccttaaaacgaccaacatgtttatttctagttttgttacattcttcctaacactttgttttttctgttcctgttactgtgtaatttagttgaagcagggatgcttcaacgcgggggagaatgttgaaactttattatataatccaaattctaatctttgctttattacgcccctaaaattatgtcacatttaatacacgattttggccttcttaaaaaatctatctcaaaaaatgagtgacaattcctaaataaaatatttgtcaatgttacatatatttaaaaaacgatagctttttcaattataatagttcataattaagtccaaattaatatttgggacttttttgtacaatattaattctcgatgtgtctggcgtaaaagctaaacttagctttagtaagtgtagtctttttaaataaaccaattagg

SEQ ID NO: 18641 - DNA, 79 bp, Diabrotica virgifera
  misc_feature (10)..(70): n is a, c, g, or t
aaaataattnnnnnnnnnnnnnnnnnnnnnnnnnnnnnnnnnnnnnnnnnnnnnnnnnnnnnnnnnnnnntaaattacc

SEQ ID NO: 18642 - DNA, 858 bp, Diabrotica virgifera
  misc_feature (82)..(113): n is a, c, g, or t
  misc_feature (141)..(159): n is a, c, g, or t
  misc_feature (272)..(292): n is a, c, g, or t
cgttttatctgttggaagacaaggactatcttcagggaaatcaaaagaacaattgtttttagacccagaaactatgcccggnnnnnnnnnnnnnnnnnnnnnnnnnnnnnnnncatcttttttctacctggtacatcatgnnnnnnnnnnnnnnnnnnntatatatacttttggcacgagaagaagagaaatataactctgcttatgtgtgcaagagatactgtatacaaattctttagaaagacccggcacgctacctgagatatattcgnnnnnnnnnnnnnnnnnnnnntgttgattactgctggatattttgacaacaagagtgttagcatagcaattaataaaaaatccaaagtggataattgaaaaagaaaggtaatagaaaaagctatattaaatagagaaggaataagacaagtgattcttcaattgatacagaaagactcatagacatctaacatgatcatgatgagtcatgcgacactcaatatttgattcatgacgaccactccactttagattagagcggtcgagattgatccaattcaggagttgttttacctacgatcggtagagaagacgaagaagtcccgatagaagtattataatatacaagcgaaaataaacaatgatactgtataattgagacaacagtacccacagttatcatcagatggcccattggtctcggagagaattaaacaagccttacaaggaaatcccacatccgtctatagatcccgcgaaactttccatgaaagccagaattcactgagaacatgaacaccatataactgaatcgaatactccctcttttactgagaccctcaaaaatttttccaaatacccaaaccc

SEQ ID NO: 18643 - DNA, 752 bp, Diabrotica virgifera
  misc_feature (13)..(36): n is a, c, g, or t
  misc_feature (138)..(190): n is a, c, g, or t
  misc_feature (193)..(208): n is a, c, g, or t
  misc_feature (217)..(243): n is a, c, g, or t
  misc_feature (268)..(294): n is a, c, g, or t
  misc_feature (305)..(321): n is a, c, g, or t
  misc_feature (323)..(344): n is a, c, g, or t
  misc_feature (401)..(469): n is a, c, g, or t
  misc_feature (485)..(515): n is a, c, g, or t
  misc_feature (584)..(602): n is a, c, g, or t
  misc_feature (604)..(618): n is a, c, g, or t
  misc_feature (628)..(646): n is a, c, g, or t
  misc_feature (648)..(666): n is a, c, g, or t
cggtagcgagggnnnnnnnnnnnnnnnnnnnnnnnnataaaaggaaagataataatttagttaaaggtagttaagtagtattgggacagaatattccatttctacaaaagaagaatctattgtttggaccctgggtgnnnnnnnnnnnnnnnnnnnnnnnnnnnnnnnnnnnnnnnnnnnnnnnnnnnnnctnnnnnnnnnnnnnnnnctattgtannnnnnnnnnnnnnnnnnnnnnnnnnncaatgacacgttattcgcttttacnnnnnnnnnnnnnnnnnnnnnnnnnnngaactttatcnnnnnnnnnnnnnnnnncnnnnnnnnnnnnnnnnnnnnnnactattaaatattgctagggatgagcttaaaactaagattttattaaaatccaactnnnnnnnnnnnnnnnnnnnnnnnnnnnnnnnnnnnnnnnnnnnnnnnnnnnnnnnnnnnnnnnnnnnnncattcccaccccttannnnnnnnnnnnnnnnnnnnnnnnnnnnnnnattgaaatccagcaacgacgagactattagtatgaacaaattgtccatttagcaacaatatatacgggnnnnnnnnnnnnnnnnnnngnnnnnnnnnnnnnnnatattaaatnnnnnnnnnnnnnnnnnnngnnnnnnnnnnnnnnnnnnncctgattaattcgactggccgcggcactctgaccgcgctagggcagcccaaccattagtcttctcaattgaaagctggagtcgagg

SEQ ID NO: 18644 - DNA, 934 bp, Diabrotica virgifera
  misc_feature (63)..(84): n is a, c, g, or t
  misc_feature (637)..(651): n is a, c, g, or t
  misc_feature (796)..(796): n is a, c, g, or t
gaataataatgtcttcggtcgtgctgatagctattatagttgctgtagcttttgcgtggttannnnnnnnnnnnnnnnnnnnnngattattttggaaacatgtaatggccattcctgggccaaaaggtctgcctattataggcacagcctaccatttagattcatcagagcaaatttttcaaagggacagagccctaagtaagacttactttccaatatataagaaatacgcctttggtatggccatggtcaacttgatcgacccaggggatatacagcttgttttgtcgaactcaaaacataaccagaaaagtgtagtgtatcggctcttcgaggactggcttggaattggagttttgacaagtaatggtgatacatggcacagaagacgaaagttattgaactctgcctttcaatttaacatgttagaaaattttctatacatttttaataaagaaacgaaacagctggtccaatattttagagaaaactgtgataaaccatatatcgatgtagtggatgcaatcaccagattcactttatttccatcggagaaacagcatttggtcaggatttccaaggaaatcctaaacgcgaagactacgttcaagctgttcatgactatggggaggctttnnnnnnnnnnnnnnntcggccttggtttctgataccgtggttgtataaactaagtccttctggtaaaagacatcaaaacgttttaaaaactctacacgatttttcttcaagggtgatcagagaaagaagtaagtcgtttgattccaacccaaactcaganatgtataagtctaagaagatgagacttatagaattttgttgttgtctgctaaaataaagatgggagtgatcgatgataaagaattaaaaatgaagtgatacttttatttttgctggacatgataccactgctaactca

SEQ ID NO: 18645 - DNA, 425 bp, Diabrotica virgifera
  misc_feature (20)..(40): n is a, c, g, or t
  misc_feature (76)..(101): n is a, c, g, or t
  misc_feature (117)..(163): n is a, c, g, or t
  misc_feature (314)..(331): n is a, c, g, or t
  misc_feature (353)..(370): n is a, c, g, or t
acccgcgccgcgattccccnnnnnnnnnnnnnnnnnnnnngttaatgatgttcaaatccaagaaaccttttgaggnnnnnnnnnnnnnnnnnnnnnnnnnnggccggtaactagaannnnnnnnnnnnnnnnnnnnnnnnnnnnnnnnnnnnnnnnnnnnnnnccctcggggacccgggattattaagtaacaaccaccatattcttacttccggaataaaaagagcgcaaaaaatcatatatctttattgcggaagaaactattttaaataattttcttgtaaagaaacgccacccgcctttaaatatatccnnnnnnnnnnnnnnnnnncgacacttatacatcaaccggnnnnnnnnnnnnnnnnnncttcaccacattaataataaagactctcacgcgagaccccaaaaataaaacacta

SEQ ID NO: 18646 - DNA, 749 bp, Diabrotica virgifera
  misc_feature (94)..(109): n is a, c, g, or t
  misc_feature (112)..(127): n is a, c, g, or t
  misc_feature (181)..(202): n is a, c, g, or t
  misc_feature (205)..(218): n is a, c, g, or t
  misc_feature (273)..(290): n is a, c, g, or t
  misc_feature (399)..(432): n is a, c, g, or t
  misc_feature (456)..(478): n is a, c, g, or t
  misc_feature (522)..(547): n is a, c, g, or t
  misc_feature (589)..(614): n is a, c, g, or t
cgcctgcaggtaccgccccgcaattcccgccgcgccccacgcgcccgcgggcgcgagggtgcggaacatccctatccttctaaagaagtaaagnnnnnnnnnnnnnnnnggnnnnnnnnnnnnnnnnggacaaaatatttcatttctacatgacaagaattcactgtttggaccttgcggnnnnnnnnnnnnnnnnnnnnnnccnnnnnnnnnnnnnnctcgaatttaaaagagctaaacaattaaaattcttattgtaaaataactattttnnnnnnnnnnnnnnnnnngccacgatactcgtttttacacccatctaactttttaagaaataaatgcactttatttattaacagtatatttataacgaaatattctcatcacatctactatcaaacnnnnnnnnnnnnnnnnnnnnnnnnnnnnnnnnnntaacattcagcttttaagtacagnnnnnnnnnnnnnnnnnnnnnnngttaaaacatgaacattatttatttttatatcttattattctcnnnnnnnnnnnnnnnnnnnnnnnnnnatgaatttacctctattgacatcccagcgccgatgatactcnnnnnnnnnnnnnnnnnnnnnnnnnncccacagcatataggtgtaataaagcaattcggcaacatttttctcacctgtacaccagaaacctgtctttttgcattaaatacaaagtgtcgcctgcccaccgattaattcgaatggccgcgccatcccgaccg

SEQ ID NO: 18647 - DNA, 659 bp, Diabrotica virgifera
ggccctttcttattaagagatattagtatgttatagatttctatcaacctgggtctcaccggcatgagccctcactatgagattcttaagaggagaacaggctaagtataaattatgtttcaccatttttatcctgtaattgtgcgtcgagttaaccagcgttgttataaactagatccctcccctgaaatcaagatgttttccctaacccttcatatgctatatcatcgaaaaatttgttaactttaaaacacatgtataaacctagcattattgtctctataaacttttattgtacaggtccatacatttttagcattattaaaacagatttttaaaccagacgataaaaagagtaaacgtaataatcttctaaacaatacatttagtaatattacatagaactgagagttctaccaaacaacacatgacaagcaaaatatcgtattctcaaaaatatatatttcgaaaatttggtcactttttttcttgactaccccttagtaaactgccatatcaatactatgagaatccactcgctccacttcctcatttttagataataccggagtccttatgatgatacgttttccatgactttcttacctttagtatatgtatctgtattccctttccgaccccaaagaagcccgcctccg

SEQ ID NO: 18648 - DNA, 672 bp, Diabrotica virgifera
  misc_feature (363)..(392): n is a, c, g, or t
  misc_feature (413)..(439): n is a, c, g, or t
cttcttaatggcggtagaggctcgctttttgaacgaaaacttttcgtttataaattcgcaaaatctgtgtgttattgcgttgccgcttctgcaatacttggagcagatttatcgatggattcttatgtagttttgtcttctgaatcaaaatctgaaaacggcatttcgatatctctaatcgtttccgagataatcgacctcaaagtctaaaatgtgacgtcacaatccttttattttcttccgacacactaaccgtcagctgaaatcgctgctagtaagtaggctagttttttaaactgaatttttgttaagcaaagcataggttatttacatttgagtttgacacttcatgaatgtcaaacnnnnnnnnnnnnnnnnnnnnnnnnnnnnnncaatgatatttttgatagtgnnnnnnnnnnnnnnnnnnnnnnnnnnngatgttcaaaaatacaatttgagtatattttgaaagcaataatttatcaacaattttaaaaaggtttatacgagtatacggctttccctttaatgggagtaactaatgataaatggactgttccatttgttatgaaatgaaaattgtatattaatagtccgggtcactggaactcaggaaactactggactagtgaatttttaggtaatttttttgactcttgcccaatttgc

SEQ ID NO: 18649 - DNA, 972 bp, Diabrotica virgifera
atctgtttatatttatctgatttaaaacattgcatagtagctaattatttaaaaatgatggctggcagactgggaataacgaacccggctatccccgacaaccctcttagtctctcatggcatgattcggcctggattcccattctaaatacttccaatataatggaatacttttcccaaggatcaaaccctttttttgatagaacttgtaacaatgaaattgtcaaaatgcagcggctcagtactgaccaattgcaaaatatgactggtgtagagtatgttcttctacacgttcaagaaccgattttgtatgtaattcgaaagcagcacaggcaaagtcctcagcaggctattgctttagcagattactatattattgctggtattgtttaccaggctcctgatctagcaagtgttttgaactccagactgctatcagccgtacactatttgcaatcatcctttgaggaatcttcaggttttgccaagtatcatcccagtaagggctattcttgggatttcaaatctcagcgagcagctgaaaaggtaaaaaaagatgaaaaaccaagggaagaacctagttcgttgtttcaaagacaaagggttgatatgttactaggagaattaataagaaaattccctttgcctgctcctcctcagcctaaaataccaccagctccacaaattaaacaagaacctgacaatggagcccccgagaacaaggagatcaaaaaggagccaaagcaggggaaaatcaaaccacctccagagaagaaaccaagattacattgaatttttttatctatgtacttgagaatcatcagttttctcatcctgtgaccaagacacaattttattgtataaattgagtgaaatagtcaatttttctactaatttgttcagttttttgtattctagctatcgttcgctagcatcttcctttcactatcttttattttgcattcattttgc

SEQ ID NO: 18650 - DNA, 671 bp, Diabrotica virgifera
  misc_feature (627)..(642): n is a, c, g, or t
aggatgcggaaagtgccgaccctttaaaaaagagaaattataaatatgatataggagatttggtaataatgagaaaatataaaaatggacattattacaagaaacatatgtatggatgaggggagaggagattttgaattaatagtaatatttgtagtatattgggaatgagaatagttttactagtaagatgagaggggaaccataagtgtagtctatgattcgttggggcagacacgaaccgcggatctactcccctatatttatgggagaaaaaaatgcactgaagtaagtaaacgctaatttatgaagaaacaaactcatcagactatatgccgacattattcccgatgagatgacagtaaataatgaactaataaagaggtttccagtcaaggatttgaattaatactatcgtccggggaatattgaacatagagatatatatatctatacgcgctcacttatttgaatttgttggttaaatttgagagagccttattgaaagctaatcgcgaagagtctattagtatgaaaaaaactgccacgctccccacgagctctccggtgtaagaaagcagctaccgaaatgtctattcacacctgtaacaccagcaacccgccccnnnnnnnnnnnnnnnnaaatcttttgccccgcgaccccagaccct

SEQ ID NO: 18651 - DNA, 854 bp, Diabrotica virgifera
  misc_feature (719)..(719): n is a, c, g, or t
  misc_feature (759)..(759): n is a, c, g, or t
  misc_feature (763)..(763): n is a, c, g, or t
  misc_feature (788)..(789): n is a, c, g, or t
  misc_feature (803)..(803): n is a, c, g, or t
  misc_feature (840)..(840): n is a, c, g, or t
gaagtattagattgtcaaaatggttaacaagccaaggcattaaagtaggtgataacatttcaataaatagtgaaaatcgattagaattttgtatagttccagttggcactctattatctggagccacatttgctcctcttaatccagattatactccacttgaacttaaacatgtacttagtctctcgaaaccaaaattcatattctgctccaataaaactattgacaaaatggtatctgtgttgcccgagcatccatacattcaaaaattaatattatttggcaatgaagcgtgtaaataccaaaatgttacaagatatgccgatattgtaagaggagtagagtccgaagaattagatgacgattttcacagtgttcccttagatccagtagatagtgtggcaactattttgtgttcttctggtacaactggtttacctaaaggtgtcatgtgtacacatgacaatatgacggcttatgtagatatatctcgtgcaattatgggtgatatggttgaaaatgatgatccaagtgatgccatgatgggtcttattccatttttccattcgtttggatttatgctaatgtttctgaacctgttacggggtaaatgcatggtggttttaggcagatttaagccaaagatattcctagagtctgtagttaaatataaagtagctaggatgattgtaccaccacctgtgctactatttttttanaaagtcctatgactcacaattatgacctatcttgcataanaganatgcgtagcggagctgctcctatgnngtaagatatggaanaagaattaaagaaagatttatggtaaacatgtttctncagcgtatggaatg

SEQ ID NO: 18652 - DNA, 167 bp, Diabrotica virgifera
  misc_feature (24)..(58): n is a, c, g, or t
  misc_feature (65)..(65): n is a, c, g, or t
  misc_feature (119)..(149): n is a, c, g, or t
cttaaaagcttacatttttttacnnnnnnnnnnnnnnnnnnnnnnnnnnnnnnnnnnncaataangttttttagtattacatcatttatatcataatttatttactcgcggtgattacnnnnnnnnnnnnnnnnnnnnnnnnnnnnnnncactcataattttttgat

SEQ ID NO: 18653 - DNA, 690 bp, Diabrotica virgifera
  misc_feature (5)..(491): n is a, c, g, or t
  misc_feature (498)..(535): n is a, c, g, or t
  misc_feature (572)..(593): n is a, c, g, or t
  misc_feature (601)..(623): n is a, c, g, or t
  misc_feature (653)..(670): n is a, c, g, or t
  misc_feature (672)..(684): n is a, c, g, or t
aattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaaagtttataattggannnnnnnnnnnnnnnnnnnnnntgttcgannnnnnnnnnnnnnnnnnnnnnnagtttaaaccggtgtgagccaggttggttnnnnnnnnnnnnnnnnnncnnnnnnnnnnnnncaaagg

SEQ ID NO: 18654 - DNA, 719 bp, Diabrotica virgifera
  misc_feature (493)..(511): n is a, c, g, or t
ggctgaaacaggcaaaccgagcccagccactatcgctcttgtggaatggcacagttaattcacatgagaatttacaggtgatcatcggaagctactttgtggatccacagagtggttagtccgttttgaacctaagttgcctagctaagcctgtattttgataatactgggatcactataaaggcgataaagctcaacattatagtgtctacttcataatctgttttcctgcacaccttcatagatgtcttacgatttttcattcaaaacagcctaatcatttgtttatgtttctgatgcgtaagtgatgctgggcttgggagttctgtacagtaaaagctcctcaatcgtgttttcactattcagggattaaaaaaatgtgacccaattcctatattcgcggcccgagatttctttatttgcagatcgaattttataatatacctaaataaaaagcatttggtaccatctgtcaatgagtcagcaaatcgannnnnnnnnnnnnnnnnnngatcttattacaactacacctagattacatgagaatgtttaagtaaaataaactattactcaaaacatagagcattaagttctgccgcaatcacaggttccatgctttgacgagagctgcattttgtgtttattattttacttctctattcgttacaaaaattgtaattgacatgtctcttccgatatcttcctaatttataatgact

SEQ ID NO: 18655 - DNA, 932 bp, Diabrotica virgifera
  misc_feature (450)..(467): n is a, c, g, or t
  misc_feature (845)..(846): n is a, c, g, or t
  misc_feature (855)..(855): n is a, c, g, or t
atccaacgttcaggagacgtcgggtgttttctgcacttacttattcgaggtgtgcaaggtaaaggtcggcaggaggtgtccttgtccaagtcagttaaaatgtagtgcaatttaggtcgcgagtcaaatccgccatcaatgaaagatcgccatggttcatccattttttgaaacataatgttcggcaatttttttgctagattttaatgaatatttgattttaattaacgaattttgtttatatataaatcaaggataattttgtatgggtctagacataataatatgtttttttaattacgatggttatttctatttttaccgttttgttcgatttaacctgtaaatttctgaggcgctttcagtttttagcaatttttatacctagtttaacagtacacttccttgcgtttgtaaattttcgaccgcattatgcaatcaggcagatgnnnnnnnnnnnnnnnnnncaagtcacttaggttatattctgaatagagtaggaacctacttaaataagtatcaacaagccgtcatgcatcttagtttctgatgatttaatatcctccaagattattaacctatttggtaaaaatgaagtgtgtcggccgtacttctgtggtagagaattttatactattactttacaagaccaaagtcctaaaaactaacgtaatttgacgataaaatatctcgagctgagaagtcgagagggggacgtcgaggcaacccgtatttctattccccacttaggtgccaaatagcggttttctgaccgtcgtcgcaacgtcgcgtatttaacgttggggcatttaatccaacgttaagacataatatttacgtcattnngctttttgnggtgcttctcaccagacgaatttatagcgttttatgactctttcctcgtctgcaaaccctttttttccgggcaaagc

SEQ ID NO: 18656 - DNA, 974 bp, Diabrotica virgifera
  misc_feature (587)..(608): n is a, c, g, or t
  misc_feature (882)..(882): n is a, c, g, or t
aattattattgaaatacataaaatcaagtgtactcaaatggaagtaaagcaagaagttagcgaggaaacgtgtaaaatagaaatagagtatactgacttagatgattttaaatgtgaaattcaggagcaggagaaatctagtacgccccacagtacacaggacgctaatgactatttacacttaatggaatatcccataaatacgcaagtagtacatcatggaaataaacttatccaatttcaagaataccagaaaactgaaagaggttatcctcaagaggagagcaaattggaggttatggagacactactaatgaaacattcatctcatgaaggaagttatatgactcaacaagatgaaggaaaagcattaaatcaaaatgttatggaagttattgcgactggacaaaaaccttacaagtgcgaattttgttctaagcagtttagcaaatcaagtcaattgaaaatacattccaatgtacacactgaagacaagccttacaagtgtggaatttgttttaagcagttcaaccaatcaagtaatttgaaaacacatttgagagtacacactggagaaaagccttatnnnnnnnnnnnnnnnnnnnnnntattttctcacaccagtgctctgaaactacatatgagattgcacactggagaaaccccttacaagtggtgaggtttgttttcagcagttttctcgaacaggtcttctaaaaaagcattcgcaaatacacactggagacacactttacaagtgtgagatctgttttaaaccgttgagtggacctagtgctttgaaacacatttgagagtgcacagtggagaaaaccacacaggtgtgacacttgcttgaaacagttttatactaaatttgaattngaaagacatttgagaatgcacactggagaaaatcttcacaaagtgtgacgtttgtttttaaagagtttagtggaaccaagtacttttgaaaa

SEQ ID NO: 18657 - DNA, 67 bp, Diabrotica virgifera; identical to SEQ ID NO: 13337
  misc_feature (2)..(66): n is a, c, g, or t

SEQ ID NO: 18658 - DNA, 202 bp, Diabrotica virgifera; identical to SEQ ID NO: 11475
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18659 - DNA, 879 bp, Diabrotica virgifera
  misc_feature (98)..(110): n is a, c, g, or t
  misc_feature (112)..(124): n is a, c, g, or t
  misc_feature (206)..(224): n is a, c, g, or t
  misc_feature (483)..(501): n is a, c, g, or t
  misc_feature (767)..(767): n is a, c, g, or t
cccacgcgtccgatctgtattatattaaattgctattttatctcatatacatgcaatttaaatacaaaattaaaggacaatactctttaaaattaagnnnnnnnnnnnnncnnnnnnnnnnnnnggaacttaacctgtattgtaaaattccctcttctcatggtttaaagctatggctcttgtagcttatgactatggcagtagtnnnnnnnnnnnnnnnnnnnatagtcccagttctgtgattattcctaaagaaacagacacccaaaaaacaaatggacaacaaataagtgaacctaacagtacaaatattttagaagacaacatttctgatgatgaaatagatacagatgtaatcactacaaaaaatgaccaaacaggttcaaaaagcctattttcagtcctaccagaaactaaaactgtagctaaggaaattatagaagataaaatagaagattttatcccaaaaccatctattccacnnnnnnnnnnnnnnnnnnnggtcaaaatatcaattccctccttatctcagtttcaagacgatgatgaaccagaagtcaaaagaattaaaccttcaatgaaaggtagtggtttaatcggattactacctccagttaaaggcgctgttaaatcgaatatatctttcgtaccaaacgttattgctaacaaaaacaaacccgtagcaagtagtagtacaagtgctttaacgcctagtagtgtaaagaagaatgctgatctcaagaaagccgccgttttgaagaaacaanaagaaaaagccaagatagtattaagtgatgcagaaagtgatgacgatttagatgtaccagaaacatatgatgatgaaatgtgggaaaggtatgtggtagacctaaaacaaaa

SEQ ID NO: 18660 - DNA, 826 bp, Diabrotica virgifera
  misc_feature (2)..(332): n is a, c, g, or t
  misc_feature (341)..(388): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagatacnnnnnnnnnnnnnnnnnnnnnnnnnnnnnnnnnnnnnnnnnnnnnnnnatcatagttttagaacatgttattattaatgactacataggatgatctgaaaatactagaaagctgttgttacagtccatagtgagactatgtgagttaagaagtgatgcgagtatagagtaattacatctgatgagctgcacctgcaagatttgtctttgcgagtgacatggaagaattaggagaagatgcagcatatcgcatggtgctaaagtgtaaacagatgtgctataccagtgctcttgacaaacgaggtacgctgtgtttcttaagtagacttcgacagagaggtcagagccagcggatagaaatgttgatcgatgacgaaaacggcatttgaacataatgatgaaccttccgggggtttgtaatttatactatatcccgattaaatggaaagagtgaaacaaggacttggatccacaacggggaaaatgt

SEQ ID NO: 18661 - DNA, 1024 bp, Diabrotica virgifera
  misc_feature (50)..(69): n is a, c, g, or t
  misc_feature (391)..(415): n is a, c, g, or t
  misc_feature (854)..(876): n is a, c, g, or t
  misc_feature (951)..(975): n is a, c, g, or t
tagttattttatttaatgaaaatatgacaacagttaaagagaaaagtatnnnnnnnnnnnnnnnnnnnnttaaagttttcaataaatctaagaaaaagcaagagccagagtctgtaattataaagaaacttacagatcaatatgaaacgattgaatcttctgcaattacaaagtttggagattttccattatctgccaaaacccttaaaggtcttcgtgaatgtgggtatcataaaccaacagaaattcagagagatacaataggcttggcattgcaaggaaaagatatactcggtgctgctcagacaggatcaggaaaaactttagccttccttgttccaattttggaaatattgtttacaaaccaatggacatcattggatggtgtagnnnnnnnnnnnnnnnnnnnnnnnnnggaactagcttatcaaatttttgaaacattgagaaaagttggagagcaccatgacttctcagctgggttgattataggtggaaaagacttaaaatttgaaaggaacagaatggatacgtgtaatattattatttgtacaccaggcagacttctgcagcatatggacgaaaatccactttttgactgtgttaagatgaagattcttgtattggatgaagctgacaggtgccttgatatgggttttgagcaaactatgaacgctattattgccaatttaccacctaaaagacaaacgttattgttttctgctactcaaaactagatcagtaaaagatttagcaaggctcagcttacaagatcccttcatatgtaagtgtacatgaaaactctgaatacagcacacccaaagggagttattcttcaaatttatgttggcagnnnnnnnnnnnnnnnnnnnnnnntttctttggagtttttttaaaaaatcccccctaataagaaaaatatgggtattttttttcccgctggaagcaaannnnnnnnnnnnnnnnnnnnnnnnntttccaaattaaagccctggcaaccatattttttttgttcatttttggt

SEQ ID NO: 18662 - DNA, 103 bp, Diabrotica virgifera
ggcgggaagtgactggggggcccccttttttgctccggtttgataaaagccctgcatcccgacctccctttgtctaccttgcttaacggagacgttgtgatgg

SEQ ID NO: 18663 - DNA, 183 bp, Diabrotica virgifera
tccgcgcctgcttggatgaatcaggagaagggctggcttgactgagcattctcatcgctataattatatcgcctcagacctagatcgcacagacactagactcgggtggagctcgtgcacgaatataggacatctcctatcgcttgctgatatatggatacgtggtacaggtgtgcaccatcc

SEQ ID NO: 18664 - DNA, 101 bp, Diabrotica virgifera
tatggtggaagcgcctgacgtgcaaataatgaaattaaaaagcggtgatgagtctcagctaggtgaacacacccaatgctatgttagatatcataaacggg

SEQ ID NO: 18665 - DNA, 540 bp, Diabrotica virgifera
  misc_feature (213)..(237): n is a, c, g, or t
gaagaacatagtaaaagatccttcgttttcgcgccaaagcggaattaaattggaaatacctagcatacacactttaaaataattcgccgagtttaaatgaccggaaaaaatatggatatatctagtaaatgactttgctagttttttgtttagaaatatgacgtttttgtctttcggcttaaaaatggtaaggtatgttattaggaacttccnnnnnnnnnnnnnnnnnnnnnnnnncacttttcaaaggaaatatttagtaaaagcctttgttatatttttccttctgaaataagtagaaatgtatcgttcactgtataagttgctatgtttattctaaaaaaataacaagatgctaggtttttccaaccaaatttattgaaattaccattttgctaggattttccatctgaaataactttcttaaaaatgcaagtatttacaagttttaagtaccagtcgataaagagcttcatggggtttcacacaattgatactaagcataaaactagtaagtcactttactaggtttttcctttt

SEQ ID NO: 18666 - DNA, 319 bp, Diabrotica virgifera
atttttcggcaaataatttataacatcatcgcctcttgattaatttttcttttttattcctactattttggattttgttcacctaattaaatacgatactgttgctggatgcatatgaaacctgggtgaagctggacccagtagagatttttaaatattcacaagctcatttagaatatcatattgaacgaaaagattttccacctctaaaacccatcgacgataaggtctgtatcatgtactcatcggctatggaaaccatcatgagacgttcccagcttgcacgcataagcggagattcaagatcccaacaatcctc

SEQ ID NO: 18667 - DNA, 690 bp, Diabrotica virgifera
  misc_feature (9)..(10): n is a, c, g, or t
  misc_feature (13)..(13): n is a, c, g, or t
  misc_feature (15)..(15): n is a, c, g, or t
  misc_feature (17)..(17): n is a, c, g, or t
  misc_feature (74)..(95): n is a, c, g, or t
  misc_feature (130)..(130): n is a, c, g, or t
taaaggggnncgncngngcggaaacggcacaaagggcaccccttttagaagagaggagaaccgggagagcagcnnnnnnnnnnnnnnnnnnnnnnaggagcgggcaggagaacgaaccccaacagaaccnggccacagaaagcggaacgaaagaggcaaacgcaggacgcgacggaaacgggcgggctaaagcagaaaagcgcgaagcaacaaaagaagaacaagcaaacaaagcacagaggtacaaaaaacaagacaggcacacagccgcaagcggaacaaaacccgaaaccacaaacatatatttctctgttggagatattataattaggacgtgatggatataagatgttgtactgtgtgtgctatcgacaatggttgttgtaggatccacaatcgatttattgtatcagcactgatattcttatttgagttgtatttagattgagatacatatattatatgagattaataattcatgagagtgatgaagttgctccgcagaaactgttgtagatgaattagctgttaaaaatgtttattgagaactatcgggccaaattgtcttcatgcttctacatgctgttttattcacagagctagatgacaacaaactataaatagtagttatatttgaggttcagtcacacatttcttatagcctcttgattagggttctaaaaacgagaa

SEQ ID NO: 18668 - DNA, 604 bp, Diabrotica virgifera
  misc_feature (16)..(16): n is a, c, g, or t
cctcgcccgacgagancgagaacgcgagcaggacgccaacacccttttcatgccaatcctacggttatatcttcaacaataatgaactgatatctacaaaatgcatagcaccttcaggtgggtctcatatggtacggaggcatggatgatagagaacttgactctagctacgactgagtggagatagagcctattggagaaggagaaacagttttacaatatatatggaagataatagtctgcggctgtcgacattccaaaatatgtatagatactccgccacgtgtatgagcattaatattcctagtactgcctctgcgcaatcagtgtatccagatcgacatttacgaatataaattattgatcattaaacatccacgagacacaaactgactaaaaaatgcttccgagtgatacgagcagaactcaccaatatacgagtatagatctcatatacttatatgacgatacagagaatgcatagaaaataactgaacatcagattaaaacgccctaacgatgccactaggtatcttagaagagagacgcgttcaacatacatgatactgatgagctaacccagcaagatttctcatttgcgagt

SEQ ID NO: 18669 - DNA, 858 bp, Diabrotica virgifera
  misc_feature (694)..(715): n is a, c, g, or t
aaccacgaaatgaactatgacaaatcacaaacagtcttcgaactcatacggagccaccatccagagtagtaccttgcaggtggtgaagtatgtacctattgaaggaggaagcgaagagggtggtcaagcgtttaagcctgaacagactgagccgaagaagaaggatactttgtttctctacttcgtagtgttaacaggatgcatgcccataatagtaggcggcggatccttcgtatggacctcccctgcaatccccaagcttcagctgaacaacagcgaagagaatcccataggtagacccatcaccacatcagaagtatccatgatagcaggtctaccgccacttatgatgctgcttggatcccttctcttaggaagactctctcaattaataggtcctaagaagtctctgcaagttattgggctgggaatttttgtctccgcagttaccatagcatttagtacaaaagtaatattaattgtagtatttaggtgttttttgtatatgttttataacggtaccttgacggttttccccgtttatataactgaaatctgtgaagatcacaatcgagctaaatacggttgtctatcgatggtgtttttaccattagggaatttgtacagttatattttaggttcctttttttctttaaaatgttactcccttctattagcagctccagcagcttannnnnnnnnnnnnnnnnnnnnngttcccgaatcgccagtttattctttatcgagggggagaaggaaagaatgcgaagaaaccttaaaaaagtgcgaagcaataagactgaaaaagaaatagagaatgatattggaaaacttgaagatactctcccaagaaaaagc

SEQ ID NO: 18670 - DNA, 910 bp, Diabrotica virgifera
  misc_feature (444)..(462): n is a, c, g, or t
agaaagcctgttactctaccaacagaaccaaaaccgataagaactacgacagaaacgacttctacatatgctacatcttatggtacatctggttatactaatgattttgaaaatgtatcagctacttctccagcggccgaaattacaacagcaccgtctatagatattactaatcaccacaggcatggacataggtctcatgctattactttgaggccaacaatgacaactacaaccccgaatgtagtttcttcgactaggaacaggaagattcaaattcaaaagcctcacaaaccagatgacttaataccactccctagaagaagagtgaagccaaacctatgccactgcgaaataaaagatccttacgttccagatgaagaggatattgaaaaggagaagaaacgaagattgaaggaagagcgtctaaagaaaaaacttcgnnnnnnnnnnnnnnnnnnncaattacaaagggaatgtggttttgaaaaaatgaattgtttccatcatgataacgagcattggaaaacagctccgttttggaccagcggaccgttctgtttctgtatgaattctaataataatacctattcgtgtgttagaactattaactccacgcacaattttctgtattgtgagttcactactggatttattacttactacaatttacgtagagatcctttcgagcttcagaataatgcggattccctaaaaccagaagaactttcttacttacacgaccttctggcacgtcttatggcttgtaaaggtagatcttgtactgtctcacattatggaccaccgcacgtaaaacctagaagtagagcgaatagtttacccatgcactcaaatattcaacattcgtatagggaagaaaaagtttacagaggaggaaaacgggagcgag

SEQ ID NO: 18671 - DNA, 913 bp, Diabrotica virgifera
  misc_feature (13)..(13): n is a, c, g, or t
  misc_feature (106)..(130): n is a, c, g, or t
  misc_feature (193)..(214): n is a, c, g, or t
  misc_feature (449)..(467): n is a, c, g, or t
  misc_feature (621)..(642): n is a, c, g, or t
  misc_feature (854)..(854): n is a, c, g, or t
gaaaactcatttngggagtgcacaccgaaaaaccttacaagtgcgaaatttgttttaagaaatttagtcaagcagaacatttgagtgtgcacattgaagaaaagtnnnnnnnnnnnnnnnnnnnnnnnnngcaattgtgtgcagcaagtagtttgaaaacacatttggtaattcacactgaagataaccctcnnnnnnnnnnnnnnnnnnnnnnccggtttactacagcacctaatttgaaacgacatttgagagtgcacactggggaaaaaccttataagtgtgaaatttgtttgaaacagtttagccaatcaggtagtttgaaatatcatttgaggacacacactggagaaacaccttacaagtgtgaaacttgttttaagcaatttaaatgggccaagtctttgaaaatacatttaaaaacgcacactggagaaaagtctcacacnnnnnnnnnnnnnnnnnnncagtttagtcaagcatgtaatttaaaaacacatttgagagtacacactatggaaaaacctaacaagtgttaaattggttctaagcaatttaggcaaccagataatttgaaacatcatttgagaatgcacactggtgtaaaaccttacaagtgtnnnnnnnnnnnnnnnnnnnnnnatcggaaagatcgtttaaaaccgcattcggtgttacacacagggccgccagtcccagattaagaatcttgaggcccctaggtaactcatgctacgagacccttaaccctcgtgtagagaaatctctacactgctgacctaccgacaagtaacagaacaaacgtgtgcaacttttgatgatgacactgctgtactagcctctcaccatgatcncatcacagcattccgaacccttccaaaagaccttaataatatccaaagattgcttaaaa

SEQ ID NO: 18672 - DNA, 626 bp, Diabrotica virgifera
  misc_feature (8)..(40): n is a, c, g, or t
  misc_feature (67)..(86): n is a, c, g, or t
cttgtccnnnnnnnnnnnnnnnnnnnnnnnnnnnnnnnnncccttattatatgaatattaccatccnnnnnnnnnnnnnnnnnnnnacttcatggaattgaaaatttattattaatcttagaatcacgaaatttcatctttggtattgttctgaatgggataccattcgcgattgcatggcacttgacctgtaatagtcctacgttcactgagcctctgggaagtcggatcgtgaaacgccatgacacgctcaccgaatgttatacgtgacttaccacatgtcgttgttagtgtttggcatgagtctagactgaccattagggtagctgaggaagatgacacaggcaatactgcatgcacgagtgacgatttgcaagaaactccggactactgattatacgaagcccgtcttgacgacggcctagctcctaagcacccggaaaggatgcaggacccgcacagaagggactgcaccaagtatgcgcacctcaatcttagacgctgtcatgccagcagttatctgagatgccactgctccgcgctaaagactcatatgggagcagggaactgtattcgatcgccatgattacctcagaagtactgctgcgcatactttgccacaaact

SEQ ID NO: 18673 - DNA, 594 bp, Diabrotica virgifera
ccttttccgcgagaagaaatatgatacctccaatatcgtttctactatcggtgtgactaaacatcgagaatggtacaggaatcctcatttgaagagaaggaatatgaggaccgcgccaggtatggataagccagagagaatttactggcaggagtggtcattctgacagaaaaaccccttgcgccccgaccgaaatcgcacagaccttgacttgggttgtacaggtacaccaagatatgaaatcccgaatacctgctgctaaagcaccggcccaggaggcactcctgaatgtggaaatttaccttttccttatgaacatgagagtgaaggatcttctagggaacaactgatactctcactgatagtctgacccgtgctgaacatctaccttcgatacgtatcgctttccccattaagatctccgtggtccatacataatcacccaagctagtagtagaaagaccacccttatctagctcctcatgaagagataatacaacaggccccaatttggaaagagcctcaggacaaagtaggagaatagctccgatcttatggacaacaggcttggctcgctgcatacttgatccctac

SEQ ID NO: 18674 - DNA, 486 bp, Diabrotica virgifera
  misc_feature (15)..(36): n is a, c, g, or t
  misc_feature (272)..(319): n is a, c, g, or t
gggaaaaagggggcnnnnnnnnnnnnnnnnnnnnnnttttaacaaccggggaaacattaaaaaattggaattatttccaaaaaggggcccaaaaaggaacaaggggcaaacaaaggagggccctccccacctttatttaccggttccccttttttaaaacaacccgcccgggttccaaggaaaaaacctatttttcttggccgggggttaacaaaaatttcctccaaaaaatccccaatccatgggggcccccgaaaaataaaaaagggggnnnnnnnnnnnnnnnnnnnnnnnnnnnnnnnnnnnnnnnnnnnnnnnnttttggtttggcccaaaaatttatttggccggaattggttaaaataaaattggtttcccaaaaattaaatttggtttccttggttagggggcccccccacctgggcccccttcctgaaaccgaaaaaaggtccccttatttttaaaccgggggttcccaataaaacg

SEQ ID NO: 18675 - DNA, 204 bp, Diabrotica virgifera
  misc_feature (4)..(135): n is a, c, g, or t
  misc_feature (141)..(197): n is a, c, g, or t
ttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatnnnnnnnnnnnnnnnnnnnnnnnnnnnnnnnnnnnnnnnnnnnnnnnnnnnnnnnnncaatttt

SEQ ID NO: 18676 - DNA, 757 bp, Diabrotica virgifera
gggctgttcgtgcggctgccattgccatacagccagttgttcaatgaccctgaactggtggcgctggcggctgtggccggtggtggggtggcgcagctcgccggttatcaggcgcagcactggatcgcacaacagcgcctggttgtcttgctaccaggctatacggcgcaggcgcggggcagggggcattacatctgttatcgccagcgagacaaaacgccgctgagggtgaaattgtttgtggactacatggtgcaggcctttaaggcatgaccattgggtaaaggcttttgccagggtgcctaattgtcgcgggtggcgacggctgggcactatccgggtgatatttatcaccgggaaatcaatatgttaagcaaagctatcaaaacctggctggaatggctgtggctgctgccgttcgccgcggcgctgtactatccgtgggcgctggcgtggagtaaccaggcgcatgtggcaggcgccggcaccccggtcgccctggcgctgatcctgagtgcctatgccgtgccgctgttggcgtttgcctgtgtgtatgtcaccggtgttcaaccggtcatgagcgcacgcctggtcctcgcgcgccgcttgtcgtgcctggcggtggctgcgcctcctgcgtacacgctgatgggcgtcttgctgtacctgatgaaaatcgagggccacgacatcgcggtatggagcgggctgtggctggcgctggcgggcttttttgcatggtctcttcaacggggcc

SEQ ID NO: 18677 - DNA, 927 bp, Diabrotica virgifera
  misc_feature (317)..(341): n is a, c, g, or t
  misc_feature (826)..(826): n is a, c, g, or t
gtgacaagtgtattcaattggccagtacttttagtaatatgtgcttttttctttaatctttttttcaaatattgttgtatgagatgtaacagcaatgtgtgcttagtggggaagacggctgtagttacaggaggaagtttaggaattggacatgaaatagtactatccctactgtcaagaggttgtaaagttatagtagcagacaaaataataactgaaagtgttaaaaagtcaattatccagaaaacaaaaagctcaaattttgttcttgagcttgtagactttgcgtctttcgagtcggttaggaattttgttgnnnnnnnnnnnnnnnnnnnnnnnnnaatagatatattgataaataatgttgaaatagggagaggtgatgataaacctactgatgatggtttgaatgtactgatgcaaataaactactacagtccatttttgctgacacatttactcatcgatctgttgaaaaaatctgaagaacccaagattcttttcacagcatcaaatttatcgtttcttcgtgcgaattgtgtcaaaagcataacagatgataacatcattgtctcaaataatactacaacctatttggcatcaaaattttttacggttgtagcttcagatatttttgcgaaaaaactaaggaagcataacatcatgtgtaatagttaccatcctggggcagtcaagacaaatatttttaaggaatcacgaaagtatgctactttaaatataatggatattatatcattctttattcttgatgtagcacttttcttaggtggacagagtccaagagacgccagtcaaactgcagtanatgtagtagtttcagaagaatataaaaatgttactgggagagttttgtttggtgtgacaaagaattaagccttgggggttcacatgacggaagtacttttg

SEQ ID NO: 18678 - DNA, 376 bp, Diabrotica virgifera
  misc_feature (42)..(68): n is a, c, g, or t
cagattggtttattttttgttataatttgttaggtaagatcnnnnnnnnnnnnnnnnnnnnnnnnnnnttagatccaaagtgtgttccaaaattaagaattgtatttattcctttaggtaaactattatccctttagtatttaaagaaatatactactgaataaaatgtataaaatacataaaatccattgtttgtatgttattgtcttttaattgtaattttaacgattgcgttggattaaacaaataatttttgtactctgtttgtatacttttagattagcactgtaaaattattggaagcgatgttaagtcttgctatatatgatgttaccattatatgatgtataggtgtaaaatagagagattaatatgt

SEQ ID NO: 18679 - DNA, 144 bp, Diabrotica virgifera
cttttccgaatgcgtatagactctaatttttaaaaggtgaagcatccttcggtaaattgtaggtcaaagagattttcgcgattaattagataaactaaagaatatttcaataatggggatccaacgctgactgtatgagtccgt

SEQ ID NO: 18680 - DNA, 702 bp, Diabrotica virgifera
  misc_feature (592)..(592): n is a, c, g, or t
  misc_feature (670)..(670): n is a, c, g, or t
ttaatattcatgtgtttcctaagttttggttcctatttttgttatgatagccctgctgccttacaagataaaataaaagaaaacctagatttatctgaggtgcaatatacctctttatattcagtatattcttggcccaatgttgtattaaatattataggaggtttccttatagatcgagtgtttggtataagatggggaacaattgtctatatgagtttaactcttctcggacaattaatttttgctacagctgccacaactggtcaatattggatgatgcttattgggcgattcgttttcggaatcggagcagagtccttgacagttgctcaaaataattacgccgtgctgtggttcaaaggaaaagaactgaacatggttttcggacttcagctcagttttgctagggttggcagtacagtgaacttcttggtgatggaaagcttgtactcagctgtttccaaaataacttcagacggacactacattataggacttgtgctttatatcgctgcctgtacttgtatcgtatcaatgatatgtgctattgtgatggcaattttcgacaaacgttccgaaaccattttgngccgaaacaataatccatctggagaaaaccgtaaattgacagacgtcaaggacttctcgctggctttttggcttgttngcgtcatctgcgtaacgttttactgcgccatc

SEQ ID NO: 18681 - DNA, 460 bp, Diabrotica virgifera
tcgagcctgacgatctaaccctattaatctaccttttaaactaaatatagacatctaaaacttcattgatttatatttcaagatcttgatttgtggacaatttttattacatatatatatcgtggtcttgacacacggacatgctagtacatctactactagtgtacgacatttccctttggtgatgtaccttcagaaccacgaaccaatgtttccaacaatacgcctagacatgtataatgacttgtacgaatatgcctgggaactcgacaaacttatagcgcaactaagataatgttattaccagtgatattgcatattgggatatgatgtatataaatatgatgtatgcctgaatgaatcccctaggacacatagattttctaaaaatcatgattactagaacagcacaaatatactgtagctgaactcgtagttgcatctaggatacatctgctta

SEQ ID NO: 18682 - DNA, 675 bp, Diabrotica virgifera
  misc_feature (189)..(189): n is a, c, g, or t
  misc_feature (232)..(232): n is a, c, g, or t
  misc_feature (286)..(286): n is a, c, g, or t
  misc_feature (335)..(336): n is a, c, g, or t
  misc_feature (490)..(490): n is a, c, g, or t
  misc_feature (529)..(529): n is a, c, g, or t
  misc_feature (539)..(539): n is a, c, g, or t
  misc_feature (599)..(599): n is a, c, g, or t
  misc_feature (602)..(602): n is a, c, g, or t
  misc_feature (620)..(620): n is a, c, g, or t
tcttgtgcgacgagcacgagcagagaccacgcggcagaaacgaacttccacaggaggcaagaggaagccacgccgcaagaagaggaagagcgaaagaggacgcccagccgcaaacaccaaactaggagcacggagagagcaccacggccggacacgaggagcaaacaagaagaaccgagcaccgagganagaaaaaggaaagcccgcagggggcagcgaagggacagcgcgnaaaacacggaggaaggaggacgaggacaacgccaggaacaacgaagaggcacgnaccaaaacacaggaaaagaaagccagcgccgacaacgacgcaaccccanncagacaagggaacgaaagccacgacaggcaagccgaaggacgcaagaagggggcaaaaaagacagcggaagaagaagaaacgcgcaacaagaaacgcagcaaaaaagcacagaaaaaacacgaaacgaggcaaaaaacagcgaaaggagaaccngcacgagaagaacaaaacgcaacaggaagggcagcagcnggcagagcgncaaggccaggacaacgaggaagagccgacggacaccgaccagagggcaaagaacaggaangcnacatacgcaagagcaagncaaagaaagctaaagaaacgggcggagaggcgcaaacaacaaaagccaacactag

SEQ ID NO: 18683 - DNA, 347 bp, Diabrotica virgifera
cttttccgcatttttattatcacgctatcgcaaagtgtagggacactgacaaattgataagaaaacgagataagtgtttcctttagttatattcccaatacgaacggaacatatacaatgtgcgattagtgtcatgatatccatcgattgaagatggttttgaaaaatcaatcgggactctgtttgaataatgtcaaatttgctggattgatcatactttccacaaacagatagtgctattatcatgcgagttgcataccggagactattattgtcattgtcccgagagatgttaccgatactggtacccatatggaaaacagtaaactgatcagcttgattgcata

SEQ ID NO: 18684 - DNA, 1006 bp, Diabrotica virgifera
  misc_feature (386)..(416): n is a, c, g, or t
  misc_feature (814)..(836): n is a, c, g, or t
  misc_feature (992)..(1004): n is a, c, g, or t
agcgtaccttaacaggattattatgagagtcataaattgtaacacatgctgtttggagtagaacctcctttttgcctgagaatgtagagagagatgatgcttggtagacatcattagagtcagatttgtttgcctttcgtgagtttgcagaagagcatggagtttcgatttgagtatcgggatcacaagatgcattaccgtgagtacgagagtttggatgaacattgtgagactggcgagtattttgagagttatgatttccttgtgaatcttgagagtgacgagtattttgaaaatcagtgtttctgttagatagactacgagattcttgattatttcttgggataaaacgagaattatttgagttgcgagtagaaacgttagannnnnnnnnnnnnnnnnnnnnnnnnnnnnnncatttagcgcaatttgacgtagaggtacatgtacttaccgagtgaccactagccaagcagttgagacacgctttctttaccttgactgtttgataacgctcatcttcagccatatttaaaaattcctgacaagtgtatatcttgtgcgagttattttgacataaaacacatttaaagtactgattattgttactatacgcatattattgctaactgtgttgagggaagtaaaacgagaggattgtttttgcttaggagagtgaggacgctcaggaacgagattttcgagaactttacatttttctttcgataaattcgaggaattcagttaattttgggaagttttttgatatcacgctcgggtttcaaatgatctttttttggggtatagtctaaannnnnnnnnnnnnnnnnnnnnnngaggattaagtcagggagttggactttgaaacctccatatttgctaaaagaagcaaaaagctttttaatttgagttaaaaaatccccaaaaaaggggggggatttttggttttggcacaagaaggggccccttaataaagcctttttataaggggnnnnnnnnnnnnnaa

SEQ ID NO: 18685 - DNA, 941 bp, Diabrotica virgifera
  misc_feature (762)..(762): n is a, c, g, or t
acgtaacagatgggtttatgttgaatttaagtaatttgttgttaagtttgtgccaaccattttgttcgaagattaatgatgaaagaattttaaaagtcgaccccacgtattgtgctgttactaatgaagatatagtcgaaaaaggcattcatatgtctgatatgtctacagaaacttgctttttaccagtatcttctgatgataccttggaggaaaaacgattgactgccaaaagttacaattttgttaccgagtgttttttcatggctcacaagtctttagatttgggatatagggttggagtagataaactaatgcgacaaaatcatgaaatgggtagaatccaaagactctttaatgaagctgtacaacaagccggtgggaatgctgattttgtgggaactatcaaagatagaatgagcgatgagctcacaaagtatttatccttaaaatgcgccctctcggatcctgatgtaataagcaaaatgttcgatttaatatcagctacgtcttactggttatgccaggtttcaatgcaccaacataccccggaatcaactgccttcgcccctttgaaagaattgccagtcacatttccattagattgtaatgtacctgatactttaaaatgcattccagaatttatagttgaaaacattgtatcattcctaatatttgtgagaagatttacaccgaaagacttcgaggagcaaagctacgaaaaattgtgccctattcttacctttgtattactattcatgngttctagacgacacatgaagaatccccacgttagagctaggttagctgaggctttggaatctatgttaccttaccacaaacacgacactcaaagaagtaatataggaagtactcagaggctacggttggttagggaacattctcataaaggagagaatgtaaaaaatttgatgaacgtc

SEQ ID NO: 18686 - DNA, 862 bp, Diabrotica virgifera
ctttgcgcgggacttctatagaaggggaggttataaattaagcgttatatccggtgtttataaggacaagagtattcccgcctgatgtccaggacctagcagaagtaattgccgaaaaagttgctcgcgatgctgtctgtatgagtcgtgtcaacgtagaggaatgtgtaaaatgatgcaggttggatttggtctgagtgacaattttctgatgatggagctataatgccagaaacgaattaagctcattcaccgtgctgctaacatgttgatagaattatcttagggctctaaacattgtatcagtacagggaacgacgtcggctgttgttaattcgcgtgggctttgttggatgcggcagaagatgtattactaaaggggaattcaccagtacagaaaagatttgtaatctttccaaagagcagaccagttggcaattgatgttttgtgagatattttatactcttatataagttactcatagagacctggtttttaaaagggtattctcttctcttaagtctaagttggtctccctagtcaagctttttggatacacttgtctgtcgatgcaacttattaaaagtgactgaacccgttggagaaaaagaatgtcattttaccgatttctaatggatcaagcatcttttcagtaaattaaaaaataccgcttaccccaaagaatcttttctctaaccaacatctgccttcgccttggaacgaaaaaggtctaggaaaggaactatctgtttcattcatatttgtacttttccttttaaattattctttgtctctttattgcattctttttttatttctctgtttttctatgaatttctttttgcttaaaaagtttcttct

SEQ ID NO: 18687 - DNA, 149 bp, Diabrotica virgifera
  misc_feature (10)..(27): n is a, c, g, or t
ctccgctacnnnnnnnnnnnnnnnnnnatgtatttgttctcgcctcttcttcttgttatattttttttttgcttctttacctttctctgttgtgtatgtttattttgctatttctgacgctttgtcttgataccgcctggctgcgggtg

SEQ ID NO: 18688 - DNA, 166 bp, Diabrotica virgifera
  misc_feature (67)..(92): n is a, c, g, or t
  misc_feature (108)..(108): n is a, c, g, or t
  misc_feature (121)..(122): n is a, c, g, or t
  misc_feature (138)..(161): n is a, c, g, or t
ggacctcgcgcctggtgttacatcccaagtagtgttccttttattctaagtttaatttcgaacagtnnnnnnnnnnnnnnnnnnnnnnnnnnaaaatgggtaaagaanagattcatattanncatcgtgtcattggannnnnnnnnnnnnnnnnnnnnnnnactac

SEQ ID NO: 18689 - DNA, 760 bp, Diabrotica virgifera
  misc_feature (472)..(489): n is a, c, g, or t
gggcccccccccttttcccggttcgttaaataagtaatatgatatgactaaaatcacttctgtattacattgttatatacgtccttgaatttccactgatgtgatattattgtgatataaccacgtgcctaaaagaatgccctcgttgaccgcttctgtatatgtaggaatggatcattatagctgcgacatcgtttacagctctagagtttgagttaggtcggataatgatttccacaagatattgctatgataataagtagcaatataatgtccatgacatatagcatgatttatagcgaattaaaatttgatatttggaattgccacccttcctaagtatcataacgtgacaagatctccttagctcatcctgaagagtcttgagcatctgattatcaaatacatttctcgaattagaaaatataagtacttactgaagaaactattatctgtgatcaacacgtgatcnnnnnnnnnnnnnnnnnnctttaatttcgcgagatttaaatgatgttagatgttcaaatgatatattgtattacgatgaagatacatgctttcgggatcgattacatagcgatgggatgtgatacgacataaaaaaaatcttttacgactgaagatgattaatgtactcctaggtaaacttattgacacgctgtgcactaggcttcgtttcaggttacaggatacctccatcatagtgactcaaagagcgaatactctcaggcacagaggctgaggaccatttgcgccc

SEQ ID NO: 18690 - DNA, 883 bp, Diabrotica virgifera
  misc_feature (840)..(840): n is a, c, g, or t
ttcgtccggaaaaaacacaaaaacggacaaaaatgagcgagacaagtgtagaaactttgagaaatatcgctgttaaaattagaataagtagcgtagaaactacagctgcagcaaaatctggacaccctacaacctgttcgtcgtgtgcggaaatcctgtctgttctattcttcagaacaatgcgctataaagcttgcgcacctagagaaccttgcaatgaccgttttgttatgtctaaaggacacgctgcccctgctctatacgctgtttgggcacaaattgggcttataccagaagaagagctcctaaatctcagaaaaatagacagtgatcttgaaggccatccaacgcctcgtttgagttttattgatgtaggcactgggtcgcttggacaagggctggctgtagccaacggtatggcgtatattggtaaatatatagaggaagctagttatagagtctactgccttcttggagatggagaatgtgcagaaggttccatttgggaatccattaattttgcaagtttttacaaactagacaacttatgcgcaatcgtcgatgttaatcgactgggacaagccggaccaacgatgtttggtcacgaagtggaagaacaccaaaagagatttgatgcctttggatttcatactattgttgtcaatggccattcagttgaggagttaataagtgcgtttgaacgtgctgaaaaagtaaaagacaaaccaactgccatcatagctaaaacaataaagggcaaagattttccaggcattgaaaatgaaaataactggcatggaaaccccttggagataaaacgaggctgtattacacactttngaatcatgctccctccaacataacacatttgattttactatat

SEQ ID NO: 18691 - DNA, 456 bp, Diabrotica virgifera
aataaaaggaaaggctgggtacgccctgcaggtaccgggatccggcaattgcccggcgccgcaccccctttttctcgcacgaagtctgttccagcaactcactcggtgtaaccttcatcatgagccagatgccataccatcctactcacctaacatcaacatgttggagttgagtgacaaaaactattatttctcgtgggattttaccggtagattcagacaatgtaggattttattgatgaatgctccatatgagtcttgtaactattgaatccgattaagaagacaatatgtatagagaaatatgtcggagatgactatcttgtatccagatgtggcagagatcgcgcctaaactctagatattaaatatgtgattttgtctcatgcgacctaccattcgaatacgaataacgtagagatcatttatgtaacaatgaagatcgcgggtcattaa

SEQ ID NO: 18692 - DNA, 849 bp, Diabrotica virgifera
  misc_feature (44)..(83): n is a, c, g, or t
  misc_feature (444)..(466): n is a, c, g, or t
  misc_feature (680)..(705): n is a, c, g, or t
  misc_feature (753)..(774): n is a, c, g, or t
  misc_feature (813)..(834): n is a, c, g, or t
aaaaaaaaaaaaggatttatttaccggcccagttacaaaaaagnnnnnnnnnnnnnnnnnnnnnnnnnnnnnnnnnnnnnnnnggggtaaaaaaatttaaaaggcggggggggagttacaaccccgggcgcatattatttaaaaacgggaaaaagggaaacccaggacaaacaaaatgaaaaaaagcttattagggatgaattgattaaaaagcttaaaaacacttgggggggaaaattccgggggcggattcgccgaatttttggtgggaaaaccacatctgggggaagggggagaggggggccaaaagggatcccccgatccaaagggagtatttccttttggggggagggaagattttgattttgaggggggagggagaaaggggggggatttccttttggattctggcggcaaaaccgggggacagggggggacccccgnnnnnnnnnnnnnnnnnnnnnnngtccttacggaaatcaacggcgcacttcatgagggagttgtaaacggtttcggggataccgcaaaattccatacccaaaaaggaaggggggaagaggggttctgggaaaaggaatctttcgatacaaggggggagatttggccctcaggaaaattctaatttttttcaagggggggggaaagcaggggggggggcatttcctggtcgaaagggnnnnnnnnnnnnnnnnnnnnnnnnnngaggaaagggaaaaattcccttctcgggggggggggggaagggaaacnnnnnnnnnnnnnnnnnnnnnnggggggagcggggcaaggcccaaccgggcaagcaaaaannnnnnnnnnnnnnnnnnnnnnggaaaccccctcaaa

SEQ ID NO: 18693 - DNA, 421 bp, Diabrotica virgifera
  misc_feature (238)..(255): n is a, c, g, or t
atcgtaaggaacggtcaaaatatgaaagtccttatagtatttgctctcgtgtgtgtttcctttgtaatttgtgacgtcaccaaagagaattgcaaatgttttgaagaattctaccctgaagaagaatttggagaggtaaactgtagaggcgagaaaaataatagattatttgaatgcggtgaagaaaagcctccagcatgtaagtgttatgtgaaaggagcagaagttatactggacnnnnnnnnnnnnnnnnnngttgatggcatacacacctacgattctgaaaattgtgatccagccagcgaatggacggcttacttccaaagacatcctggaagagtgcaactttattctgttttaccaccaaaagttcagcataaaagaaaagagaaagttactttataagttgtaggtatataat

SEQ ID NO: 18694 - DNA, 939 bp, Diabrotica virgifera
  misc_feature (3)..(33): n is a, c, g, or t
  misc_feature (35)..(73): n is a, c, g, or t
  misc_feature (77)..(252): n is a, c, g, or t
  misc_feature (257)..(311): n is a, c, g, or t
  misc_feature (313)..(313): n is a, c, g, or t
  misc_feature (359)..(359): n is a, c, g, or t
  misc_feature (375)..(462): n is a, c, g, or t
  misc_feature (495)..(513): n is a, c, g, or t
  misc_feature (516)..(622): n is a, c, g, or t
  misc_feature (638)..(638): n is a, c, g, or t
  misc_feature (641)..(680): n is a, c, g, or t
  misc_feature (732)..(793): n is a, c, g, or t
  misc_feature (813)..(849): n is a, c, g, or t
cannnnnnnnnnnnnnnnnnnnnnnnnnnnnnngnnnnnnnnnnnnnnnnnnnnnnnnnnnnnnnnnnnnnnnacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggnnnnnnnnnnnnnnnnnnnnnnnnnnnnnnnnnnnnnnnnnnnnnnnnnnnnnnncncgcggcgtcctcctcttccccctgcggagagggggggggtgggggnatactaatcacacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggagaaaacaaccccccccccccttccttcnnnnnnnnnnnnnnnnnnngtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggggcgggcgcacnccnnnnnnnnnnnnnnnnnnnnnnnnnnnnnnnnnnnnnnnncttaacaaccaaaaataaacagcataacactcacaagtagactaccaagcgnnnnnnnnnnnnnnnnnnnnnnnnnnnnnnnnnnnnnnnnnnnnnnnnnnnnnnnnnnnnnntcaccccccgccccttctcnnnnnnnnnnnnnnnnnnnnnnnnnnnnnnnnnnnnnctaattccaccaaaaaaaacagggaggagcggggaaaaggcacgcccacccccacaccacccaaccccccccccaccacccccccccacc

SEQ ID NO: 18695 - DNA, 413 bp, Diabrotica virgifera
acccttattgttcccacttggcactcttgatagccgcggcaggtatcctggtcagaacgcgggagccgcccacgacacgccacgagccgaaaccgggaaggccgccacgccggccaggaggacggaacccagcagagaagcagagcccccgagcgcgggggggaaacagcgcgagcaacggccgggcagagccgcaccggagcgaggcagcaacccagacagcaccacacacaccgagcaaggcggcagcgtccagcggagagcggggccggcagcaggagcgagccgacaggcggcaggagccgcgagcgccccgccaggtgacgcagcgggaacacgggccgggcagcagggcagacgcaccgaacgacggacggagaccgccgggcagcgcaaaggaagaggcggcgagg

SEQ ID NO: 18696 - DNA, 910 bp, Diabrotica virgifera
  misc_feature (27)..(40): n is a, c, g, or t
  misc_feature (43)..(67): n is a, c, g, or t
  misc_feature (537)..(551): n is a, c, g, or t
ctaaaattaaggttattatttgttacnnnnnnnnnnnnnntcnnnnnnnnnnnnnnnnnnnnnnnnngttataaactgagtctgttttcataaagtattttatcatagatattttattttacaaaaatctttatttctttgagatcagcgtattatggaaccagataaaatcaaagttgaacaaatagaggtaaagcaagaagttagtgaagagacgtttaaagaagaaatagataatgtttatgagatgggagatgatctttttgatacattcaaaattgaaattaaggaagagctgaagagagaaataactacaaatgatgattcatttgaatgttcacttttaaacgagaatgatataaagactgaaataaaacaagatgaagaaaaacacacaaatgaaaaaagttttccctatggagatatacaaactgatacaaacaaggtatttaaagaacatggaatagctaacagtaatttggaagaatatgtaactgcacataaaccaattacttgtgaaatttgttgcaaaatgtnnnnnnnnnnnnnnnatttaaaagaacatatgaagatccacactgaagataaattgtttttatgtgaaatatgctctaaaacgttttccagaagacgctatttaaaggaacacatgagaatacatactgaagaataaccttttacatgtgaaatttgctcttacagattttctcgaaaatccagtttaaaaacacatatgagaatacacactgaggaaatacacaccggaaaatcgtttacatgtaaaatttgtactaaagagtttccacaccattcagttttaagagttcatatgaaatccataccgtacgacataaaccttttgcatgtgaagttttgtcccaattgtttgccaataagtcgagtttaaaaa

SEQ ID NO: 18697 - DNA, 874 bp, Diabrotica virgifera
  misc_feature (83)..(109): n is a, c, g, or t
  misc_feature (840)..(840): n is a, c, g, or t
agaagaagaagtaggaactagtaagaagtcatcaaggtgttaggttatataatatttatgtttaactacaaatctataactannnnnnnnnnnnnnnnnnnnnnnnnnngatttgtgctataatcggttatagttgtaattttgctctaaaattgatcgtaatgagatttattaatgactattggaagcttctagcatgatgttaataatgaatttgttaattagatattgcaatggagaaacctatcaataatttacatttaaaacgcagaaaacagagaagtttcaaaacacacaagatgccagaagatgaagagatggatgaagaggatgtgatattagatacctgcgttttacttaatagtggacagatctcaaagactgaagtcagtattgaacaaaaggagccagtatgggtgactgctgtacaaatgttcgtcccattcattgtggctgggtttggaatggttgcagcaagtttgttattagataaggtacagcattggccagtatataaagatgttagcgaggtgtatatcctagtacctgcacttctgggtctcaaaggaaacttggaaatgacattagcgtctcgactgtcaacacatgcgaatttgggacatctcgatacacaccatcagaaaatcgctttgatcggaggaaatcttgccttaatattgtgccaagccattgtagtaggattcttagcctcagtagcagcggtgatattcggttgggttctaagtggggacatcaatctcaaacatgctcttttgttgtgtgccagcagtatcgtcactgcttttggggccagtttttattttaggttttggtaatggngtgttgtaatttattgtttctaggcattttcaca

SEQ ID NO: 18698 - DNA, 508 bp, Diabrotica virgifera
cttcgtccggcaccgttcacaataattattccttcttggttttcagaaagtgcatttctgaaaattctttcggactaaatgttgaaaagcaggggcgacaagaggcattcttgcagtactcctctattgtgtgagtccacgtcagcatcgtgcggttgggtgtggtttaaatagcttatagtgcctggtgtcgaggagtttgggaaggtaactgaacaagaaattagtaggtactgtgttgaagtctatcgggaaatagctataatgtgcatttaagcatcatattggcaattatatactaggaaccagtgtatatatatgtaaaagatctaggaagataccttctgtccatggactaccagcaaatagcaggagagaacttccacgcactactgtcttaagtttgaaggctgatgaaaagctaacagacagcagatatactccataacatagtgtgaaacctccacacatacgaccctggatgtaaagaggaaagccctactctgct

SEQ ID NO: 18699 - DNA, 1017 bp, Diabrotica virgifera
  misc_feature (63)..(80): n is a, c, g, or t
  misc_feature (416)..(432): n is a, c, g, or t
  misc_feature (712)..(769): n is a, c, g, or t
ctattttatttatggattaattagaaatacaacgatacccatgacagatgaaattagcggctnnnnnnnnnnnnnnnnnnagataggaaaaagctggcagagtatggacaagttcttggcatgatttgaacttatatataatagagagacaggacaggagagtaactaagtaaggcggcaagttatcattgtgcatgagcttataggaaagcgtcggggggaggatactctcatgcaaaataatcttcttgctgctggagatcacgatgggaagagaatctgaagtagatagtttggctagagaatttgtgattattattgtaggcaagcgaacactacggtgaaaacgtcaaagaacttcatgacactatgaagaggatcactggtttcatcgcggatcaatgttgaggaacatnnnnnnnnnnnnnnnnngagtgtaggtagttcatcgaattatacacagagcactccatgaattttgcacaggaggagaggtgtacgaacatgatgcgcattcagaatcggtgtttcagggagagttcagagatttattcatgagtgtaacggtgcttattatggaaggtgttggtggcggctctggtggtgtgagaggagtggcaaaagctctagaagagcctcgtaggacttgtacttgaagaaggtaaaagatttcaagattgatgaacttgagtcatgatgtggtagggtttcnnnnnnnnnnnnnnnnnnnnnnnnnnnnnnnnnnnnnnnnnnnnnnnnnnnnnnnnnntcttctttaaaggaaagaatttcgtataagttttccgatttgggaagctaaaaaagaaaaccaatttgagatagattggaaccaagaaccgaaaaaacaaagccaacaatttgctttaagggaaagcctgcggttctttaaaggaatatggctgaaaatcctttaagagaaatctgggcgaaaaaaggtttttataaaggaaattctgatctccaaaacatggaaaagtgtatttttggaaaaacttt

SEQ ID NO: 18700 - DNA, 921 bp, Diabrotica virgifera
  misc_feature (4)..(130): n is a, c, g, or t
  misc_feature (136)..(159): n is a, c, g, or t
  misc_feature (163)..(204): n is a, c, g, or t
  misc_feature (210)..(254): n is a, c, g, or t
  misc_feature (263)..(289): n is a, c, g, or t
  misc_feature (507)..(525): n is a, c, g, or t
  misc_feature (527)..(541): n is a, c, g, or t
  misc_feature (653)..(673): n is a, c, g, or t
  misc_feature (701)..(727): n is a, c, g, or t
  misc_feature (813)..(835): n is a, c, g, or t
  misc_feature (892)..(919): n is a, c, g, or t
actnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagnnnnnnnnnnnnnnnnnnnnnnnngggnnnnnnnnnnnnnnnnnnnnnnnnnnnnnnnnnnnnnnnnnncccccnnnnnnnnnnnnnnnnnnnnnnnnnnnnnnnnnnnnnnnnnnnnnggggggggnnnnnnnnnnnnnnnnnnnnnnnnnnnttttttgggaatttttggggattttccgggggggggatttttgaagggaaagcttttggggaaccccaagggaaagggttggcctgggggagggaaaaaaaaaacgccaaggggggggaaattttggaaaggtttcaaccccagggggttgggggggaacaaggggaaaagggggggaaccccaaaattggggggtttgggatttttttaggggggcnnnnnnnnnnnnnnnnnnncnnnnnnnnnnnnnnncaaaaattttgaggaaaaggggagtggggggacaaacaaaaaaggggaaaatccctttggaaatttaaccaggggggtaaaaaaaatggattggggagggaaagcgaaaacnnnnnnnnnnnnnnnnnnnnngggggccccccaaataaaaaaccgaacnnnnnnnnnnnnnnnnnnnnnnnnnnngggggaaaacaaaaattggccccaggactggtttccgggggggttttggaggggtttttaaggaattttttttggaggcgaaattnnnnnnnnnnnnnnnnnnnnnnnaacggggtttaaaaaccccgtttaaaaacaaccaaggggagagggtcaaaaaccccnnnnnnnnnnnnnnnnnnnnnnnnnnnnaa

SEQ ID NO: 18701 - DNA, 476 bp, Diabrotica virgifera
  misc_feature (94)..(113): n is a, c, g, or t
  misc_feature (156)..(175): n is a, c, g, or t
  misc_feature (283)..(300): n is a, c, g, or t
tcacgatactggtacttgcgacatatatcttaaaattctaaaatttttaatctttctacagaagtatcttataattagaaattgtttataatannnnnnnnnnnnnnnnnnnnctttactctagattatttaataaaacaattctagtttaattgnnnnnnnnnnnnnnnnnnnncaataaaaccaagtttaagaatattctcatgtataataaatgaacttcaaaaacgacagacactatcttgacacatcttgtaaataatcacatgtgttaaatttttgnnnnnnnnnnnnnnnnnngtataatgtttacttttatttaatacgtttgtttaattgttgggacatttgtaatactgtagcaaaaaccgaaaatattatttatttgcgattgcaatgacatgatgttatttcatttaaatgtaagattatgtgtgatctttagcgtaacatgaaataaagttttataatattgg

SEQ ID NO: 18702 - DNA, 697 bp, Diabrotica virgifera
  misc_feature (638)..(658): n is a, c, g, or t
gatagaatagtggtcagtcatctttagtagtaaccttaatttattatgtacttttcacttatatgttaataattaaataactgttgtatcgaccattttatacaggtacttgaaaatgtctaacaaagttcaaaatcggcgatcaaaatggaatcttgattccgtcagaataactcgtgtatccaccgaaccgttagcttcacctccaggctacagctcatctaccatcggttctaacagtgaagtgtcgaaaaagactgatgtgtctagattaataacaaagaaatcatgggacttagctctagcccccatgaaacaagtacctatgaacctttttataatgtacatggccgggaattccatatcaatcttcccaatcatgatggtcggaatgttgttgatgagacctttacaagcaatttggtctactaaggctacttttaagatgatggaaacatctaacgccattctacaaatgattgtgtatgtgttaggtaacttcgtaaacataggtttagctctgtataaatgtcacagtatggggctgttgcccacttatgccagcgattggttggcttttgtagagcccccaatccgacttgaatatttgggtggaggaatacaactatattaattgnnnnnnnnnnnnnnnnnnnnnggtgtagttcttaaaattaataaaaacatgtaattaagc

SEQ ID NO: 18703 - DNA, 653 bp, Diabrotica virgifera
gctgtgtgctggacgtggtgcgctatccggaatacttgcggctgtcgcgcgagggcgcgggtttcgaggacagtccgctgggcacgctgtggcgctacgagatcgacctggacgagggcggcgtcacggagcgcgcgctggacgatgccggcatcgagctgccgcgcatcaacgaggcccggaccggccgcgcctaccgctactgctatgcggtggagcagcccaacaaccgcgagatgcgcggcgtggtgcgctacgacctggagacgggcgcgcgccagcagtatgcggtgccgcctggcgaccagaacagcgaaccggtgttcgtgccccggccgggggcgcgcgacgaggacgacggctgggtgctggtgtgcgtgtaccgccagaccagcgataccagcgacgtggtggtgctggacgcgcgcgacctgacggccgggccgctggcgacggtgcgtctgccccgccgcattccggcgggttttcacggcgcctggctgccgcgcgaggcgggcgggaagtagaccgcgacagtgtcagagccgcgggcaggacgtcgcgcctgtcaccggcggcccgggttcagcggctcttggcgcgcgtacctttcctggcggcggcgcgcgccgtttcctttggccggcgggcgc

SEQ ID NO: 18704 - DNA, 228 bp, Diabrotica virgifera
  misc_feature (10)..(60): n is a, c, g, or t
  misc_feature (151)..(171): n is a, c, g, or t
tagttctagnnnnnnnnnnnnnnnnnnnnnnnnnnnnnnnnnnnnnnnnnnnnnnnnnnnatgtcataactttattgagtatgttttacttttcctgtacaatctgattctgtgcaaacagaataattataaccatagatgataagcaagnnnnnnnnnnnnnnnnnnnnntattcaattataatacaaagataaacggacatcctcacgagaattatcccttagttt

SEQ ID NO: 18705 - DNA, 560 bp, Diabrotica virgifera
gacatggactacacgtttagaaaactaaagaaagaatatgaaaaatggggcctcaaaatgaatatgtcaaagacagagtatctcataaaatagaggatggtgaagaagatccagagttagaaattgttagaaaaacatgtaaagaatataaatatctcgaatctataatatctaaagaagccagtaccaaatgagacatcgaaaacagaatgcagcatggaaaaaagcggtaaattataattttctaagctctctattgtggtctaaagatagacaaacaacgaaattggtaatcttggtagagcctattgtgtcttatagagcagaagcttggcaggtcacgaaaaaatatataaagataatagaagtagtagaaatgggttatggaaggagagcgtgtggtgtatccaaaaaagatcacatcaggcatgaagatactagaagatggacaaatactatataatattctagtttagatagaattgaaacgagacaactagtgtggcatggtcacgtgaaacgaatgaatgaagataaatggctaaagaaagcttttaatt

SEQ ID NO: 18706 - DNA, 913 bp, Diabrotica virgifera
  misc_feature (86)..(116): n is a, c, g, or t
  misc_feature (138)..(163): n is a, c, g, or t
  misc_feature (170)..(190): n is a, c, g, or t
  misc_feature (263)..(287): n is a, c, g, or t
  misc_feature (289)..(328): n is a, c, g, or t
  misc_feature (361)..(398): n is a, c, g, or t
  misc_feature (432)..(476): n is a, c, g, or t
  misc_feature (487)..(538): n is a, c, g, or t
  misc_feature (540)..(555): n is a, c, g, or t
  misc_feature (557)..(569): n is a, c, g, or t
  misc_feature (577)..(633): n is a, c, g, or t
  misc_feature (718)..(747): n is a, c, g, or t
  misc_feature (870)..(905): n is a, c, g, or t
actccccgcccggccccccccgcgcgccccgggagcgggcgctcgcgatcgagaactacgtattgtgagataatagtttatatagnnnnnnnnnnnnnnnnnnnnnnnnnnnnnnncgtatccgggatctatctaacnnnnnnnnnnnnnnnnnnnnnnnnnncagtttnnnnnnnnnnnnnnnnnnnnngttttattgtaagataaatatattatataattcttttgaaatgaaatgttattcgtgtttaccacatatccannnnnnnnnnnnnnnnnnnnnnnnngnnnnnnnnnnnnnnnnnnnnnnnnnnnnnnnnnnnnnnnnggaatattaactatttttagggaggagcttagnnnnnnnnnnnnnnnnnnnnnnnnnnnnnnnnnnnnnnttacgattacaaattttcgtattctacaatatgnnnnnnnnnnnnnnnnnnnnnnnnnnnnnnnnnnnnnnnnnnnnnttttatctacnnnnnnnnnnnnnnnnnnnnnnnnnnnnnnnnnnnnnnnnnnnnnnnnnnnncnnnnnnnnnnnnnnnngnnnnnnnnnnnnngttaatgnnnnnnnnnnnnnnnnnnnnnnnnnnnnnnnnnnnnnnnnnnnnnnnnnnnnnnnnncgtataaaggcccgcccgccccctgattaatttcgaatggccgctgggactttttgacgcgcgctaaggtttcataatcattagnnnnnnnnnnnnnnnnnnnnnnnnnnnnnngccggatgcaaaaataacctgcctccatttatttaatcagaattctatttttaaggtaaatacccttaatttttctaaaagacgaaagacccctaagcggtttaacaatgcattccaaggccnnnnnnnnnnnnnnnnnnnnnnnnnnnnnnnnnnnncccggggg

SEQ ID NO: 18707 - DNA, 235 bp, Diabrotica virgifera
  misc_feature (2)..(22): n is a, c, g, or t
  misc_feature (115)..(137): n is a, c, g, or t
  misc_feature (146)..(167): n is a, c, g, or t
  misc_feature (199)..(226): n is a, c, g, or t
tnnnnnnnnnnnnnnnnnnnnnataattaccttagggataacagcgtaattttattggagagtcaaatcgataataagattgcgacctcgatgttggataaaagttataattggnnnnnnnnnnnnnnnnnnnnnnnttgtcgacnnnnnnnnnnnnnnnnnnnnnnagttaaacccgtgggagcccagtgggtttcannnnnnnnnnnnnnnnnnnnnnnnnnnnccaaagaac

SEQ ID NO: 18708 - DNA, 750 bp, Diabrotica virgifera
ctaaaccgctttatgcccttgactatttagtagattctcccccttaaagctcttagctagcaaatgacagattattatacagacaatcactcgatctctatctgcgttagacatccaaccggatgttacccgtcttctctacgtgaaggtgcaaatctgtatttttccttcagcgaaattaaaacctttcgggatttcctagactgttccgagctttaaaagccaattatggttcgtacagtataaataccggtgcacgtcatagcaagtgacgacaatgacaccaacgcaacatatttaagacgcagggctgtttctttttataatcgatccgttagacatatcttattttatatgccacgaaataacatgggaaaatctcaagaaatgtgacctattacgaaagaatacaccatcatttccgacatgtaagtagtataactcgcctaaatagcgttgtaatgtaccggacttacctgtggtacagtatagcaatcagcgaacgaagtcgacgacatcgtataaagtgacacacggaacgatatcccccacgccagtataagttgggactaagacagctcgcgacttgtgcgactaccacaagaagaaccatagtgatagagtgtaatatttccataacaacggtgaaaggtaatttgaccgagtcatcagataaaaactatgctatgattacctctactagaaacaggaagtggtccaagccgctgctacgaccactttcgataagag

SEQ ID NO: 18709 - DNA, 670 bp, Diabrotica virgifera
ctcatgcgaaagagatcagaaactatcagaattagatgatacattctgatgctttacaacaaggtgcttcacaatttgaacagcaagcgggaaaactaaagagaaaattttggttacagaatttaaagatgatgataataatgggtgttattggtcttgtaatcttaataatcatagtcagaaacttttttgtatacctcagattgtggagaagatggatatctgttcaacagcagcagtagcagtagtgacagtgaagatgacgaggttgaatgtacatgtgatgcagaaaccgaacctccacctgataagaagcagaaattgactgaatctggcgaaacagaggcagcggtagaattaaagcctaaaaataagacaatgctgtatggcttacttgaagttgatgtgaaaacagaaccagaacctaagaagaagcaaaaggcatatgaatttgttgaactagatgtaccaacgccaacggataggaagcaggatggatttgttgaaatagaggtgcctattttaaatgagtatgattttaagaatagtttcagggtgaataagacaacatatgccaaggtgctagaaatgctttatcccagctttagtgcggaccacaagggtggaagggagaggataactgcagaaaaggcaacatatatatttctct

SEQ ID NO: 18710 - DNA, 541 bp, Diabrotica virgifera
ccgcccttttaagggcggcccccgagccgacagccccacacgcggccccttttagagggcgacccggagtggagacgccacagacgccgggcacaaggaagagcgccgccacgaacaagagccgtctcttccaggcaactaaacgacctgcacatcacggaaagatgatgagacgcgcgggaaagagagggaaacggaccaggatccaacagcaatcaacaaaagattgcaaaggctctatataatgtacaaactcggcccaaggtagtcgtgggcgaagtggtaatcatcgaatgtgatcctgggtttatggaatcggccgcaggccgggctgagcaccgctctgaagatggccgcaggttcttttacttcatcagatactacagcgccaggaaagtacttaccccagcggccaaaaagtgacgcgacaggtcgcgaacgcagaccgtctcaacggacataaagcagaacgttaaatactcgagaggtgtcatgattctcgtcgcatactccgaggtaatggatcaaacaacgtgaaaag

SEQ ID NO: 18711 - DNA, 787 bp, Diabrotica virgifera
agtattcctaaatcgtatatgtccgctctaatatctccactttctggtatcctacgctaggtacgccataactctactatcatgacgactatattctctacctctggacgacaaaacccttcaataggagtgttgaaaactgggtgtatcgcatactactctgcatgcaatacatccccctttctacatatggaaagacaaaaagtagatccgagcgaagcacccttcgcaacttatgcatcaaccttgtgagggaagagactggaccagatccgatctctcaattccgaagaacgggaagatgcgtaacctatagaccaagtgctcttacaccatcacatagctccctgtacgacatctcgttgcacatctatttcgatgcgatcagggagcttccgcggaacctttctggatggtggatggcctacacgaaatccacttgttgatgaaattttacacaattatcgaatacgtgatttaaaagcagatgacaggaatgattctacttcatatatgacggacccatattctacagaccctaaaaggcctatagtattgaaaccatcctgtgtcaaaccgttcaatgctgcattaccgtcagagctgctagtgtaaagctttttaacaccatatgcactattctacgataggaatcatttacctgttccagaacataatcctgatagttacgaattgaaaatatacattgaaagaataataaggtaatcgtttttacgttgtagcgagtgacaaaaatgcgcaagtataccattactgctactatcat

SEQ ID NO: 18712 - DNA, 831 bp, Diabrotica virgifera
tgtcgtccggtaacaattacataagtttttatttgtgatgttgatgaagccgaaaaatacgaaaccgaacacacatactgtgtacgacgcttacgcacaaagttgggtttttgacgccgaaaacgcaggctgttctaacggaactactggaactaaaggtccgtatttcgaggtactacaaaatgggacgccgcaaaaaccgtcgaatggtgccgttactagcatgcagaacggcatggtgaaagaaaatggccatatcatagataaccccgtagttcacatagaagaagcttcagacgacagcacaagtaacagcgaccgaaagttatgctacatgaaaagtttctcgcgctcacactcaccagtagttttatcagctagctcatcccaacttagtctcaattcaaaccaaaacaagaaccctctcatttacgaatgtctagagaaactcacagaaccaactatataccgctcaagactaaacactgctgtaagtaacaaagaagaagacgatcaacaataccaagcaccgcaagctgtgatcatgagaagaccggagtccgtcagtccccgagccgaaaccgttcaatatgcttctttgatgaaggagttgcagaagaagatcgttaagaaagaatctccgaacgttacatcacctcaaagcaacacaagtgaaagtgccaccacttctgagaaaactcaaaactcgaaaagtagtagtcgatcagaaggaaaaagcagcgacgcagatttctccaaagaactagaagcagctctttcattaattcaggaattagaaagtcccaatactattgaaaactccctccgatg

SEQ ID NO: 18713 - DNA, 944 bp, Diabrotica virgifera
  misc_feature (388)..(406): n is a, c, g, or t
gtttatcactttttatgttcctatcttctggaatgtgtggagttacaattgttattactaagtttgtagtttatgtccaacaactaaacgcagcagctgcaggttttctaaatgataccataatagagaaacctctaccttatattatctggcgtccagttgacgaaacgaagcattatattattgccttcactctcgatactttttctgcaacgattggatgttcctttaattctgtaactcagattatatttatttcgctaatgacatacatctctgggcaacttataatcttacagaataactttaaagagtacgggccaaaatgctcgaatctaaaaaattacgaagagaaatacgcttatttaagacagttaatattggaacnnnnnnnnnnnnnnnnnnntgtagaagaattggatgataatatgaagtatcttatgctcatggaatttacaattaactcatttcagattacagccatattttatgagttattaacatttgaacgcgatgcagttatagtttttcggctgacgtatctatgtgtaatgattatgcaaatatttttacttgcatggcatgcaaatgaaattagtctcaacagtattgacgtatcacaagcaatttatgaatgcgaatggtacgatttaccatatatgataaagcagtacctacttataattatggttcgagctcaaaaaccactaagtatatctgttggcccgttctttaatttaacaaattctacagcagttacatcgatgaaagcagcgtactcatacttagctctttttacaaacagcaaaaaacgtcaaagatcataagaaatgatgctagttcaacatttatttttcacacaacagttaatcaacaatttgggtgatgcagtgtacctgcatccaaatttttgaaaaagcgtgaaatatactaaatatttatat

SEQ ID NO: 18714 - DNA, 525 bp, Diabrotica virgifera
gtgacagatattatttccgaactacaagagggaattaacgaaaatcttgtagaaacagtctcaaagtttgaagaaaaactttctaagcttcaaagtgctgaaggtggcaaccaactgatagcgacgataaaagaagagcttggtgaactacacgatggtgttgacgtggcctacttattggctgaaatgacttcccccctacagcttcgattgctgtaaaagatgatcccaatcccatacctggtccacctgttgtcgtggaatcaggaagaaactgggtatgcctatcgtgggacaaaccacgtccagacgaccaggattgcccgtgcgtgcttaccggcgtaggatgtgagacctagaagagcagagggagctcagaggcgctgaaggtggagtcacacctgtaacatcttttgatagtcttctatttgaaagaagaaatctgagcaggaatattgaggtaacaaccgggaacaagatttgggatggcaggggagaagtggtaccaaaaatgaagtcacctca

SEQ ID NO: 18715 - DNA, 119 bp, Diabrotica virgifera
  misc_feature (8)..(10): n is a, c, g, or t
  misc_feature (25)..(25): n is a, c, g, or t
  misc_feature (30)..(31): n is a, c, g, or t
  misc_feature (41)..(41): n is a, c, g, or t
  misc_feature (90)..(112): n is a, c, g, or t
  misc_feature (114)..(114): n is a, c, g, or t
acctttannngatacagcgtaattntattnnggagagtcanatcgataataaagattgcgacctcgatgttggattaaagttataatggnnnnnnnnnnnnnnnnnnnnnnntngtcga

SEQ ID NO: 18716 - DNA, 974 bp, Diabrotica virgifera
  misc_feature (137)..(156): n is a, c, g, or t
  misc_feature (224)..(241): n is a, c, g, or t
  misc_feature (397)..(415): n is a, c, g, or t
  misc_feature (884)..(884): n is a, c, g, or t
tttaaagcaaaattattaataattacgggtctaaatctttccaaattttaagtaagccatgactgaataattgtgtaaaacttacaatttacgtatactgattataatctgtactaaaagttggctacaatttttgnnnnnnnnnnnnnnnnnnnnctacatattacttataacggatctacaaagctttaccccactgaccaatcacactgtatggataaatnnnnnnnnnnnnnnnnnncaaactattttaaaaatgtgactaatgcactgatattttaaagtacgtacgttaataaatcgatatctacaaattgatggtgtctcagtggcattagactgcagatcgagaggtccccagttggaacccggctgttgcgtatcgttttttaattgnnnnnnnnnnnnnnnnnnngtttatatactttaacttatatataccattttaaacaaccgtggcattataaaaaatactattttatactagtgtaatttttggaatcataattataaataacagttaatagttctactaaaaattcatattttatgttaattattctttccaaacatcttgtgtcctgtatgtacaataacaaaaccgtgatattataaaaagtacttttttattagagtgtaatttttggaattttaagcatctaatcgttaaatcctttatcgttaaattattttatattctttcctataaataataaaaaggttttactataaaaaagttcttttttataaaagtgtaattattagtattttttttcaaattccatgttattcctacatttttaaaagttagctctcgaagtttatttacgaatgtatgcaaatcagtattactatatagctcattaatatctgcgtactctctncattcactgtacaactaataattacctttatagggacaaaagacacactttttatcggagttcctatgctttcttacctgcatcatataa

SEQ ID NO: 18717 - DNA, 788 bp, Diabrotica virgifera
  misc_feature (525)..(543): n is a, c, g, or t
  misc_feature (558)..(575): n is a, c, g, or t
aacaattataaagccattttataaatgtaaggttagattgctctggttatcctactcataccgctagatggcgctatttttttgcttcctcaaagttaatgggaaatgtcaagagttgtgtgtgttacagtctatagtatttggtgatagtacggactatgtcataattataatttatgaggccaatcctcgccaatgaagaagtacttcgctgaatgaccggcaaaaggcgttaaaattctgtaaaatgtacaactgacaattatagttcagcgcaaatttaagtacatgcagcatagctgcatgctgcatgattcgcgaggttagtgtgtagagatccagacagcagctgtagattaaaagaaattattatcatgatgcgataggatgcgatggaaaagcttatgggtaaactatgagttaacaaaaatcctcaaatcgatacaagggtttgcaaaagatagttgtaatacgatctaagcaaatcgtacaatagggatgtagtatagtattaatacagtacgnnnnnnnnnnnnnnnnnnncggtttaaaatttannnnnnnnnnnnnnnnnngtcgcgttttagggttttctattatagaaactaccgtttctcaaatatcaataaattttattcaacggtcttccaatgactccatcccgttttctttggtgttcgtctgaaagtgttgcaaatgtctctgttatagccgcaatggcttcttgtttggacgacaagcactgataagaaaaactgacttaaattttaaaaaacagatgaaattct

SEQ ID NO: 18718 - DNA, 662 bp, Diabrotica virgifera
  misc_feature (574)..(574): n is a, c, g, or t
  misc_feature (631)..(631): n is a, c, g, or t
aaaattattaaattcagtagaaaagccacctcttctgccccactaatctcaatcaacaacaaccccgtacctgtagtggataattgtagaattctgggaatgatttttgattctcgactaaactggaaacatcacataaatactactaaaggctactgccttaagcaactgaatctaataaaaactctttcacacttttgttggggtgctcatgagaatgtacttcttacagtatacagatctctgatacgttccaaaatagattacggctgctttatctacatgtctgcttccaaaaatgacctaaagctattagattctgttcataatactgctcttcgtctatgcctcggagcttttcgctctagcccgcaggatagtctttattgcgaaagtaacgagccccctctctcccttcgaagacaacatctacttctatcatatgtttccactacgtcaagtaatcctactaaccctatttaccatcttaccacctctatacctgactactccattagcaacccctctcaaagagtcatagagccttttccaatatcactaggccgtctattanagaacacagacctatctctcaccctgcccatcccttctccagtcactcctccctggnacaaacacctcccctttatttacacatccct

SEQ ID NO: 18719 - DNA, 523 bp, Diabrotica virgifera
  misc_feature (9)..(155): n is a, c, g, or t
tttcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagttttgagatattaggtatgagaagagatcagatttggatcgacattgaacaaggaaaatgtaggaatggctgtatattttttataatttccgactatggtaaaagagggagtagtggggtgagatgaaaatgcacgtgggtttataaatttatataagagaaagggatgaggatttcttggaataatgcggcggatgaatagacatgaattgggaacgcaggatgatgagaatagttatctatggtttcaaaaaatggttagaagagtatgtactgtaggtaatatataccaatttaaagaagagaggtagaaacagaaatgctatcttattttttggtacatacttggatgcattggtagaa

SEQ ID NO: 18720 - DNA, 665 bp, Diabrotica virgifera
  misc_feature (627)..(628): n is a, c, g, or t
gtcactcacatgaaataaaatttacatgaatagatgcgtcctgaaatttcaataatttgataccattgcgccaactctgaattttgcttaattagtgcgttaattgtaattaaagtttatcgaaatcgcattttgaagtccataaaaatccatagattgtactaattggcaactgtatactgaattggtctatatatctctcgttaattttgcattccaagaaaatattattcaaatctctaatagagacattatcacaaatcgaactggtgaattcactactatatagatcatcttagattcgattataattgaggctttctgtgaattcaaacttacacactatctattgggaatgactttaaattcaataaaagtttcaaacttaaattgctgctgaaaagaaaagtgtatataatttctgaaacacagaatgtaagggatgtcattcacctgccgaagttacttttttaatttttttacttcggtgcatatttgagaggtagatgtagatattacatactaatttattacatgtaacaagtttagcaaacactccttatattcgtaaacgatggctgatagagttcagaacagaatttatttacacattttttattgttttanncagttctttttgtgtttgatggtagcaactctgtaat

SEQ ID NO: 18721 - DNA, 725 bp, Diabrotica virgifera
ctaagtccggtgtttcgcaattatattcatacaaaataaatcccaactttacagatttagtaattaggtaggtatacaatatgtattgataactaccgattaaacatcaaaaccggccatcatgcaaaagtcatctgtcattactgtcatacgaattttttatttcgtctataattaaaaaaaaatcctcaaagttgtaagtaagtgttaatgttttttatgattgacgatacaattttgtacgcaccacctcaatactctttatcgaacgcgtctgttcctctgctcgtaatgtcagactcgttcgataaagagtcactttactgactgactttactgaaattggttaaacaatttttcgaccgcggtaccgcgtgacaccctgtgtatttgttataaggattgttatacggatgtatttctttgagtaagtttgtgcaaaaaatcgaatcggagtggtttgcctaacgggggcgacgctacagactacactaataagtagttgaaacggtcaaaacaaagaaacgcacactcatcaaaaatgcacttgagattctcgtataatcaacatttactgaatcgatcccggcagagtcaactccaactagtaaaagttgatttaaatttttaaaatcaacttttactgctcgtttcagttggagttgactctgccgggatagattcagtttatgttgatttttccgagaatattgaggtgggttttt

SEQ ID NO: 18722 - DNA, 730 bp, Diabrotica virgifera
  misc_feature (162)..(179): n is a, c, g, or t
  misc_feature (513)..(531): n is a, c, g, or t
aaaccaaccaatggagaaccagtgacatcagttctcagtccattcattagcaaattaaaaagtgttgaaagcttatggaagcatactaaaatatcaaaatgaaatggttgtatttgtgttgtttgctactgattcttcaagtctgcactgcacctccagtgnnnnnnnnnnnnnnnnnncctgaggattcagaagtaaatggtttagaagattatatggaatatcacagatatctaaaggaggttgtgcacgccttggaatcagacccggatttcagagcaaaactagaaaaggccgaagaatctgacatcaaatctggaaaaatagcggaagaattagaattcgtctcgcatcacgtcagaaaccgtctagacgagatcaaaagagtggagttggaaagactgaggcatttagtagaacaaaagaggaaattggaagacaccaatgccatagacaccgaagaccccacacacaatcatctggaccactcgaatccacatacgttcgaaatcnnnnnnnnnnnnnnnnnnnttgctaaaactgcacaggatctggatgaggctgataagaaaagaaaggagcaatttaaacagtatgaattggaaaaagagtataagaagatggataagttgaatcatactaatggagacgaaaggcagaaattagaaaaagaatatgaagaaatggaaaacaaacataagcgtcatgaaaaaactccacgaacccggac

SEQ ID NO: 18723 - DNA, 1166 bp, Diabrotica virgifera
  misc_feature (59)..(705): n is a, c, g, or t
  misc_feature (808)..(829): n is a, c, g, or t
  misc_feature (831)..(847): n is a, c, g, or t
  misc_feature (1004)..(1016): n is a, c, g, or t
  misc_feature (1019)..(1037): n is a, c, g, or t
agacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccgcacaaaaaaaaaagtgtcttaattcaactaagtagggattgtaaatggtggaataaaaaggtaaaatttattttggaatggaagatgaccgcactgnnnnnnnnnnnnnnnnnnnnnngnnnnnnnnnnnnnnnnnccctaatccaacaaaataattggattggggcggaccaaaattaagtcccccttcttgaaattctatcaaaaaaaaccccccctttttcaataaaaattcctttccaccaaaaaaaaaagaccacccaaggggaaaaaaacccggattgtaaatctgnnnnnnnnnnnnncgnnnnnnnnnnnnnnnnnnnccccccacccccaaaaagattcaacaccctcctcgggggggaaacaaattatcttttttttgttctttggcttttcgactccttaccaaaaaaatatattcgtacacacccaccgacagataaccaccc

SEQ ID NO: 18724 - DNA, 949 bp, Diabrotica virgifera
  misc_feature (846)..(870): n is a, c, g, or t
  misc_feature (891)..(916): n is a, c, g, or t
ctagatccggcttgagtttagcacacgttttgtttaaatatcttttgaaaaccaaatttattaaaaatgacggatgttgcaccaaaaacccctaataagaggaaaagtttaggtgttaaaaataactctaccaaaaaagttaaattggaaaatggacagacacctaaacagcctggatctgcaattaaacaaaaaggacagccatctcctaagcaacaaacaaagctagacactcctaaacagaataaacaaacacctaaaaaaaataaaacaccaaaaccccaactcaaaactcctaaacaagaagtatctgttaaaaaggagcagaaacaacagacacctaagcaacaagtggtaacttcaaataacccaagtaaaaaagctaaaaaggtacctaagggtactgcccaagtggaacaaaaagtaaagaaggaaaaaactccacagtcctctgatcaacaaaaaaagagtccgaatgataaaaaaaagaagagacggccatatttcttacttaaatccctagcaaaatcaacagataatgccgagaaagctaaagccataaaagatatagacgaaaaaattaagcttatagaaagtagaccagagttaacgaagacagctaaccgtaaactgcacttgttaaaaaagtttaaaagaatagctcaaggcctccctccaccagcaccaccagttaaatctgagtctgcccaaggcaaagctaaaaagaaggaagctgcagcaggaaagcagaataaacagcaaaagggtaaagttcagaaagtagtgaaaaaagaaccagaaccagaagaagatgatagtgacgatgaagaaggtaaacaagctgcnnnnnnnnnnnnnnnnnnnnnnnnnccagtgatcgaacccgaaccnnnnnnnnnnnnnnnnnnnnnnnnnntagaggttgacgaagaagaggagatgatgagga

SEQ ID NO: 18725 - DNA, 575 bp, Diabrotica virgifera
cccacaggagaccccacagacccggcgataggaaagggctgcgcgcagatgagccgtctcttcagaccacgtgaggcacggacaggatgaaggctggaaagaccacggggcaagagagggagacagacagggatcgaagatgaacaaggaagagaatgaagaggctgtaacaattgtataaactcgcccatggtactcggcggtggtgtgggctagccgaaactgctcaagggttgacgggtgtggccgcggagcgggcggaggatctctctgaagagtgccgcagacgctattacatgaactggtacaagagcatgaggacggcatttaccacaggttccaagataaggagtgacaaggcgggcacgaaggccatcgaaacggacttgaagaagattgctaaatactgcaaaggcgacatagtcatagcgcatacgcagatggaatggttgaaagcacgtcaaaagaaagcacacatcatggaaattcaattgaaaggcgctgccggagctgacacagcagctagagctaaggaacatcttgaatggactacccctattgcacacgcttgtgct

SEQ ID NO: 18726 - DNA, 757 bp, Diabrotica virgifera
  misc_feature (24)..(93): n is a, c, g, or t
  misc_feature (95)..(143): n is a, c, g, or t
  misc_feature (183)..(195): n is a, c, g, or t
  misc_feature (197)..(215): n is a, c, g, or t
  misc_feature (217)..(235): n is a, c, g, or t
  misc_feature (243)..(260): n is a, c, g, or t
  misc_feature (262)..(274): n is a, c, g, or t
  misc_feature (306)..(326): n is a, c, g, or t
  misc_feature (385)..(405): n is a, c, g, or t
  misc_feature (421)..(456): n is a, c, g, or t
  misc_feature (458)..(482): n is a, c, g, or t
  misc_feature (496)..(518): n is a, c, g, or t
  misc_feature (520)..(535): n is a, c, g, or t
  misc_feature (571)..(592): n is a, c, g, or t
  misc_feature (606)..(635): n is a, c, g, or t
  misc_feature (645)..(677): n is a, c, g, or t
  misc_feature (707)..(732): n is a, c, g, or t
ctaattttttaagaagtagattannnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnncgattaaaaactttcatacttgtaaaatatgatattatgnnnnnnnnnnnnncnnnnnnnnnnnnnnnnnnnannnnnnnnnnnnnnnnnnngatttacnnnnnnnnnnnnnnnnnncnnnnnnnnnnnnntgattacaaaattgtatatttagcacaaatgnnnnnnnnnnnnnnnnnnnnntgcaacattttcttcgcctgtgtattatacacatgtcgttttgtattacatatgaagcnnnnnnnnnnnnnnnnnnnnnatgaatggccgcgcgnnnnnnnnnnnnnnnnnnnnnnnnnnnnnnnnnnnngnnnnnnnnnnnnnnnnnnnnnnnnnatggatgatacacnnnnnnnnnnnnnnnnnnnnnnngnnnnnnnnnnnnnnnngtcaccaagcttagatttttttagaagacgagaacnnnnnnnnnnnnnnnnnnnnnngatcaataagcacnnnnnnnnnnnnnnnnnnnnnnnnnnnnnngttatttacnnnnnnnnnnnnnnnnnnnnnnnnnnnnnnnnnctatattatgatattaattagtaatttgcnnnnnnnnnnnnnnnnnnnnnnnnnntacattaccttatggatcacagcgt

SEQ ID NO: 18727 - DNA, 139 bp, Diabrotica virgifera
  misc_feature (2)..(130): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttttt

SEQ ID NO: 18728 - DNA, 684 bp, Diabrotica virgifera
  misc_feature (591)..(624): n is a, c, g, or t
ctcctgaggggcaatctgtggaatggtggtgctggaaaacgccctctatagggtaaggaaaacaaaaaggcacaaaagtgtaaagtgatatggtgaggatgaagtaggaatttttatattcttgacagcagtgtatgattttctagaaggggaagaaggagttgacaaggagaaagattaggatattgaataaagtgtcgttggaggtaaatctgaatttgggatgatagaaggattatatgtagaggaaaggaaagattagctgggtggtgttgaggtatccattgttatagattaagagtaggaagaaacagccgagattgagatttgggagaggtgctagttgatttttggtgtgaaatgggggggaaggagtggagaggttggatatgggttaggattcgagaaagggctacaacggatacagatagtagtaaatgcgtctaggagattacatgtgaaagtggggtgatgctgggattgggggtacgaatgtataagaagagataagaagagttgagagtggcgtgcatgagggtgttggaacacaaggtagaggtcacgataggagagcgaggagagaactaaggnnnnnnnnnnnnnnnnnnnnnnnnnnnnnnnnnnatgatgaaatgtcggcagggggttttaaagataagactaatgaggtgatggggatgttga

SEQ ID NO: 18729 - DNA, 369 bp, Diabrotica virgifera
  misc_feature (14)..(14): n is a, c, g, or t
ctaaaggggggaangataaccacaacgaaacagggcgccctttaataaccagagaccaggaggagccgaacagaggacgacacccaacgagcgagcgccgaggagggcgaaccttgcccaacccaccggaaaggagaagactgccataagctgggacaccaagaagcgaggaagatccaattccaggaaaagggcaaaacaatcacagagctgtactatgccgtattattacctcgattcaagatgatcggacgttgggtaacggatataaacgctggtctcataggccagtatacgcgggatcgaaccctgtctcagattatccattttcgtttccagtgactcagccagcgcgactcaccgtgactc

SEQ ID NO: 18730 - DNA, 942 bp, Diabrotica virgifera
  misc_feature (839)..(839): n is a, c, g, or t
ctgcagtgcacatacatagagattatgtcgctaccgtgaataaacgcgccaaagacgcgaattaaatgaaaggtgcattatttttataagtggcgaactttccggtaaatgctgtcgtcgcatgatggggtagcaaaatgcgggggcaaatttgctattttggttctgactggttggtgttgtttttgttctttgtgaattttaatgaagtgttgtgcctggatacaaaggagtttcaaaagactttaccagctcgtcttgtttggggcgtacctggaaaagacgtggaattaccttgtgatataactccagcccttcccaatgataacgttacaatgcttttttggtttaaggataatttaggaatgcctttgtatagtttggatgcaagggatggtcccattgataaagcgtctcatttggctatgagtgatgacttgggttcacgaagttattttataactgaagatgaaccctcaaaagctagacttaggatacaaaatgtaaatatgcacgaccaaggagtctttagatgccgggtagactttgtcaattctccgacaagaaattaccaggttaatttaacattagtagctcaaccgtcagctcctagagtatttgacgcagaaggccgggaaattaaagtcggccatcccgcaggaccttttttggaaggacgtgaattgtttttatcctgtcaagttacaggcggtcgcccaaaacccactttaaacttggtggtacaatggtacaattttggacagtgtgatagactcaagtcgtgagtcgtttacgactgtcaatcaacttgtgatagcctctactccgaggtaccttanaggagctcactttgagtgtcgagcttcttcttcagagactgcttggatatattttcagggaaataccgataacagtatttttgaaacccaataaagtaaaaat

SEQ ID NO: 18731 - DNA, 606 bp, Diabrotica virgifera
  misc_feature (8)..(118): n is a, c, g, or t
  misc_feature (572)..(602): n is a, c, g, or t
ttcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatttggtcctttggcacgacagtaaattaataaattaaagataaaaaactctccgggtaacaccggtttaaatttcgccatcatgtaaaattttaaaagaggaacgcacttaataatactatctggtacaccaattataaagtttgatcgcaacgtgcaagggcgcagtctttattatcgatttgaactccccagtaaagctacggtgttttccgtacagggtatttatgcttataatccaaaagattggacctaaaaatttttaattcatattataacatctaaaaagcgttaaaatttctttttagtacccccaattcgggaaattccttttatggataaatttttaacgatataaagttatttatacacctaataaaactttattggggtctttgcgtccctttaaaaaaatttttagctttttaaattataaatataactctttttannnnnnnnnnnnnnnnnnnnnnnnnnnnnnncatc

SEQ ID NO: 18732 - DNA, 761 bp, Diabrotica virgifera
  misc_feature (113)..(133): n is a, c, g, or t
  misc_feature (639)..(658): n is a, c, g, or t
  misc_feature (683)..(700): n is a, c, g, or t
  misc_feature (706)..(706): n is a, c, g, or t
  misc_feature (713)..(713): n is a, c, g, or t
gactaaattcttttttttttttcgcccctctgacttattaaaataatcattatagaagttctcagggaatttttgaccctcgataatactgtaatatttcattctgcgtttannnnnnnnnnnnnnnnnnnnngttttttcaggattcgaaaaaaaattaatacatttcaaaataattctaccgaaattttgcgcctacgatctcaaaaaggattaaagtattatacatttttgtaatcagtctttcaaaagcttttaaatgagttgtcccatgatgtactttcaatcccatttaaaaaataatcaaagttatcactgtcacctgaagaggaactgcgtaaagttcgaaacattgatgcaatactatactatgattattttaaaaatcgacctgtccgagcgttttgctaaaaataaataagttagtaaggggtggtaacacttattccagcgcactgtatactaaaatgcaaaaataccagaaggttccagaaaaacggatccgcccatccctattttattagtattcggaatgaacttctagctacttcaatagctacattccaagacgttcgagttggaaccgttatacggggggaggtctgaaataacctttttgttacactatactgttatctnnnnnnnnnnnnnnnnnnnncttgatgcaattttttaaatgtgcnnnnnnnnnnnnnnnnnntaattntattatntcatattcaaaatgtcgatagtttgtcgcatgtcactaatgcgtttac

SEQ ID NO: 18733 - DNA, 875 bp, Diabrotica virgifera
  misc_feature (854)..(854): n is a, c, g, or t
attccccagacaacaacttggttttcaatgcaaacaacttttgagaaggattttgttggtaaacaataaacagctgagattaaagaaatatctgaaattgacagaaatattttggataaagaaattcaaattttttgtgaaacgttttcttaaattgttaaagagaattggtgctatgagtgaaaataaagatattccaaaaggcaacaatgatgaacaaggctcatctagaattagaaccaccagtgagtgctcttatacaagtgatgatggatcttctggatttacagggagacgtcagcgcaccacttctcatcagttcatggttgctagtggattgactgctgcatctccaccaaagtttgtttcactggaagagatcatgcaagcagctaatggtatgagagatatggctttggtgcatcaaatagtggttgacaaggattttaggttaaaaagggcagaaccagaacctaatagtgtccagggaataatcaagaacacaatgcacaaagcattttgggatattttaaaacaacagttaaatgaaaaccctccagtttacactcaggcgttgaatcttctagaagaaattaaagaaggattatttgctgtattattaccacaacatacaaggatcaagcagcaaatttcggaagttttggattctgatttgatcaaacaacaagcggagaagggtactttggattttaagaactatgctcaatatgtggtctctgtaatgtcaaaattgtgtgcacctgtacgtgataataaaatacttttgagtatcatgacagtggatgtcatagagactttcaaaggtatactcgagacgttagaccttatgcagntggatatggctaattttaccc

SEQ ID NO: 18734 - DNA, 535 bp, Diabrotica virgifera
  misc_feature (196)..(214): n is a, c, g, or t
tttcgtccggtaccgggcctacgagtgttttattttgacagatttcatttgaaggttggtaccttcaaaagtcatagtggtattagtggcaccatcttgaagtcaggaccgggattaatatactgttgtagtatgtacatagtattaactgttattaggtagtaggaaccctacctccatttatgaaaacttctgnnnnnnnnnnnnnnnnnnncatcaagtttttttatctcttaatattactgtattcttactcttattatttatattattccgaatgtgtttattttgtacatatctcctgggaaaatactatacaaattgaatattagttttgtcattctttttgtctttcactatgctatatcttatttttactggtgaattcaattgacgtgtatcacacagtatgagctataaaatttagaataaacagattttttttgcacagctaattttggaattattgagattatgatagtatgtatttaaacttttctcctctatgtttttgcgtactggatatttaggctaa

SEQ ID NO: 18735 - DNA, 803 bp, Diabrotica virgifera
  misc_feature (624)..(624): n is a, c, g, or t
ggcagacagaaaagcggaattagaacgtaagaaagccaaactacaagcactgagggaggaaaaagatcgaagacgtcgggagaaggaactgaaagaggtcgaggaggctgctaacagaactcttctgggaggtggtggcgataggaaagaattagacgatttgctaagggaagttggtgtagcgcctgtttctgaagtgttttctagtatatccagtgcaaattcactcacgccagagcctagtcgaaaccacacaccagacacttcactacaaccgcatattttaaccaacaatgtaacagctgtaaaaaagaagcttccccaacttacagttgttccagtacaaactacaaacattccccccaaggaagttgttgtctacacgaagcagacccagacaacaactactggacatgatgtcagagacggctacatggaggactggtggaggcccaggaaagacgaatacaatcttaaccctggtttagaaatgggaggatgagtttacaggagaggatgaggagggcagtttaccgccacatctcggaggatatggtgggagcaagctaccgcccgggatcctaccgcacggtcttcccaagtcaaggaggtccagccagcggntacggctttgggacaggaacagaagaaggaggaggtcaaagaattagggaactgagcgaggaggagaagcagatgatcatactttcagaggaattccaacacttcatagatagggccggaagagtaatggagagggctttatgcgaaagtgtccacatttatatggattatacaggcag

SEQ ID NO: 18736 - DNA, 355 bp, Diabrotica virgifera
ttcgtccgggagaactttgacgagaggagttgttccatacttcattatgtcgccatcttccgctggataatgaagcgataattctgctattctgacactgattgcccaattcgaggaccgaacaatttgctatgtccggacaggactttctcaccattcgataccgatgatgatggttcgattacgactattagcagagcggcagcaatggtaccgctcggaccacctccgtatagaggctcagttccaggcgcatgtacatggaagtcgatggcgacgcgcacggaaagaacgatttccctcaatttgtaattggcggattcactatcattcgatccatgatgattcggacgac

SEQ ID NO: 18737 - DNA, 458 bp, Diabrotica virgifera
cccgacttttttgtgcgagagaacaacgacccttgagactacattgagcttttttacacgtatctggagacctagagtgtaatccactacactgtgcaggttccggccatcccactacatcctcctcttttgtcgagattgtctcagtccacttcttcagaaccatgagctacaaagattcaggtcccagagacccatgctgcgaccgcttcgctctttccaaaggtcacgctgctccagttcttatacggagcatctgtcgagaacggcgttgtagccgctgcctgacgcagtgaagctgagaccattgggatgtgaactcgaaggacatcctactcctacattcgaacgtccatcgaagtgcggtattggatcgctaggacaaggtcgttgctgcatatgctggttagtggatagatattggcatgtactatcgaggatacccctgaactggcttt

SEQ ID NO: 18738 - DNA, 558 bp, Diabrotica virgifera
  misc_feature (9)..(26): n is a, c, g, or t
ttcgaccgnnnnnnnnnnnnnnnnnntggacggtcgcgctctttttataaacctgacgaatggacggatccgcggtagcatacctatgtaaaggtgcaggggaactttagagtgtcttttatcttatagtgatctacaattaaaagagagagatgatattattatttcgcaccaaacgtgaagaagaacccgacgaaagctggagaaatacgagaaggacagtgacagtttacaaatgcatacaataacatgttgatatgatgaatagaaatagagcgcagggtacaaaacgtctaaacatcttagagaagaaatactgtcctgtgataaggaaatggatgaatgtgtacgagatgaatgtgtctcacatattagagctaagtgaagagacacatgcatgataacgccggaaggcaagggccggatgattactacaagtcgagaagttgcgatcacgctgatgatctaatttactagaagatccgtccagactagcgggaatgtgcctacggaccacaagagaaggtcaagctccatgaataggataggctaaaatct

SEQ ID NO: 18739 - DNA, 779 bp, Diabrotica virgifera
  misc_feature (201)..(222): n is a, c, g, or t
  misc_feature (371)..(389): n is a, c, g, or t
  misc_feature (442)..(454): n is a, c, g, or t
  misc_feature (457)..(475): n is a, c, g, or t
cctacacattttttacccactacctgggtagtttttaatcaatgaaattgggcccaatggaaaagggccccgccacaaacactgacacggggcccctgtggggctaggctacgacactgtgtataggcgtgaaaagatgtaacaatagaacaattggcgtatgagattttttttcggagattatgtaaattatttagcaannnnnnnnnnnnnnnnnnnnnnggaacgggcccctccggggcccgggcccctgggcgcccgccccaagcgcccagtggataaaccggcactgtgctacctagtagattccaattaggcattactgtacaaaaaagcgacttataagaggtaaaggaggaaaaatttaatcnnnnnnnnnnnnnnnnnnnttacgacgtcgtaatttttatacctttaaatactcatgtaatgtctagacagnnnnnnnnnnnnnctnnnnnnnnnnnnnnnnnnnctaatatgtttaaccttggagtatctattggactaaaaagcatgtaactgattgtcactatttgacgagaatgaacaaaattatttactccacataagcaagaaatcaggaaattactaaacctaacttatgcatgcttaaattaaattcattgcttttcacgcacttacaaattgtatatgagactcttggattaaagattgaaattgcttatctaatttaatgttgatatagaaaatatgtaagcataatatcatgattgaagacaaaaacatttctgactacataaacttaaaaaattgaa

SEQ ID NO: 18740 - DNA, 766 bp, Diabrotica virgifera
agagtttagaacacataattaatcgaacaaaactctttaaaaagatcacttgatatccaatctgtctggctacttagtgcaagtcttcctggaggtgcgtgcacctttcaactccttatatttgattctgggaaacacaaaaaaatgatacaagcagtactacatctggtgagaaagtacagaactgatagttcacaataaagatgggaaatttgaactgtacctcaccttccttgtcgcacacctcccacttctccactataataaaacataagtgagataccaattaaattaattgataatgtatttttttgtattctgagaaaatagttttccactccgatattcaagaatagggtcaagtgcagtggtagtacaatttttcatttgataacaaaaactgagttatactaaatggtgctactatttgctgaagtattttttagaaaaatagtgagctcaaagaagccacacaagctttagaaccagtctattgtagctcaaataatgaataaattagtattagtggtaaacctatttagtgtaattcaggattgagtctaaaagcaacatacttctactgcttggaaagttttaagtgcttactcgtaaatccattctttatgtcattaaatgtattagttcttaaatgtttttatagattttaccatttagttcataggagtaaataatgtcctatttttatacaattaacttcaaaatttttgtgtggaactaaaatattttccgtaaaatacataactac

SEQ ID NO: 18741 - DNA, 394 bp, Diabrotica virgifera
ggtgtccacaaataatgtttgaaaaggaatactgtactatttcgagtaccaatatcttcaagaatagaatttggtacattaattaagtgaagtggaaaagatatttttgtggacacgtcgtataaattgatccaacgtattatttattttgttaaacttgtatataggtattttgaatcaaaccattcctgttatcctattttgagtgaaatttttatttcttgtcaattatcgtttgtaagtaattatggtagatggtatactacagaaagaactgattaaactaaacgttgcttaggttaattacacagatcctgttacaataatattgatattccgtcagattgcagtttttatacagtacaattaagaaataaaaattcagttcaatatt

SEQ ID NO: 18742 - DNA, 883 bp, Diabrotica virgifera
  misc_feature (212)..(229): n is a, c, g, or t
ctactgaataccgaaaccccgaaagatttcaagcagttcatgaccgtggctgtagatttggtcatcagaggcatacaggaaccggtgagatttttaatcgagactcctgtccgcgtgtattcccaaagtgagaggactttttggtatttccaaaggaaaagtctgatccagcagtttttcttaaacttaaaagaggttgtctccgaactcannnnnnnnnnnnnnnnnntgctaaacatggaaacttcgggtgaattggatcgaaatcttctgaatctgaacttgaacctctccagtttgatacattctccaagtataacgtcgatagatactcttacgcccaaagaagagtatttttcagatggtgatgagcctctattaagcggaactggttccgtgtccaaggattgttctgtcgacgtattagaatcctgggcggacattctacaaaaatggaaatcgacaaatttcaaacaaagaccaaaacagttgtcggcgctagtaaaattaggtgttcccgaggctctaaggggagaggtatggcagagacttgctggaatcgatgaaaactcgaccatgatggagaactatcgattgcttataacaaaggaatccagttgtgaaaatgtgatccagcgagacatagctcgaactttgccagctcacgagttcttcaaagaggccggtggattgggacaagattctttgtatagggtgagcaaagcatacgccatctatgactcagaagtgggatattgccaaggactaagttatctggctgcgactctaatcctacacatgccagaagaacaagccttttgtatattggtgaaactcatgtacgactaccatttgagagacttgtacaaacacggtttttgac

SEQ ID NO: 18743 - DNA, 824 bp, Diabrotica virgifera
  misc_feature (180)..(198): n is a, c, g, or t
  misc_feature (709)..(709): n is a, c, g, or t
  misc_feature (746)..(770): n is a, c, g, or t
ttttataaacaaatagaataacttttaaactattgctcgtacctaaaatattttttcatattcgaaaagctaataatttgtacacaaagttattttggattttgggacgattagataaataggaatttttttaattcccaactaacttgtttataataattaaaaaagtgattagtttcnnnnnnnnnnnnnnnnnnnacattagaagatttactaaaatagtataaaaacagcttaacaaccatcaaataacaaaatccgttgttcgtacgccaatcagttgattgtaataaattatgttaattattatcattatgataattaacataatttattgattaataacataattgatattaattaacataacgatttttaacataattgattaactaatcaattaatctcatgattgtaataaattatgttttgaactgtcaatgtcaagttgacattgacagtaattaaatatttgataatgatcagttcattccatttttgattagcgttcgaacaaccggcctttagactttcatttgatatgcgtataattacggtatcttcattattttctgactaatgtcattgcaaaaaaggtctctagaataaacaaatagaatagattttaaactaattgatggattgtttcgaaatttggagggtttgttaagtaccccaatacccatctttgggtgaaatgccaattaangttaaaaatcggcattttgaagctttttcaatggtcnnnnnnnnnnnnnnnnnnnnnnnnntgtcgactatttagcttttaatgaggtgcaaaatatcgcaaaatcgcgtttttt

SEQ ID NO: 18744 - DNA, 798 bp, Diabrotica virgifera
  misc_feature (733)..(733): n is a, c, g, or t
  misc_feature (754)..(754): n is a, c, g, or t
  misc_feature (779)..(780): n is a, c, g, or t
gtcaagattactcgaactccattgccgttcaaaatacacaaattttccaaaaatatggcagtggaaattcaaaaccttgtaaggaatgcagatgcattttgttttgacgtagattctacagttatccaagaagaaggaatagacgagttagcaaaattttgcaataagggtgaagaggtatccaacttgactgccaaagctatgggtggtgcaatgacatttcaagaatccttaaagttacgtttagatataataaaaccaagtatatatcaggttagagattttctaaatttgaaacctccaagattgtctcctggaatcaggaaattagtggatctgcacaaaagacatattcctgtatttttaatttctggtggtttcaaatgtataataacacctgttgccggtcagctgcaaattccccttgatcatgtttttgcaaatagactgaaattctattttacaggtgagtttgccggatttgacgaaaatgagccaacgtccagaagtggtggtaaagctgtggtcataaatcatataaaatctgtttataacttcaaaaatgtcgtattgattggggatggcgccactgatcttgaagcagctccaccagcagatgcttttataggatatggaggtaacgttattcgacaagcagtaaaatcaaaagctaaatggttcattactgattttaatgaaataatcgaggtactaaatcaatgatattatatantctgtagttttattttaatancatagtggtttttattgacaaatannaaaattgtttttttatat

SEQ ID NO: 18745 - DNA, 841 bp, Diabrotica virgifera
  misc_feature (15)..(32): n is a, c, g, or t
  misc_feature (36)..(56): n is a, c, g, or t
tacttttccgtccgnnnnnnnnnnnnnnnnnnggannnnnnnnnnnnnnnnnnnnntctatcgaagacaggcagcccctaggctatgaatgaaccagccggtatggagcctgatggcattattgaatcctcctgggaagacgtgatccgataatttcgaccacatgaacatcaaacaggaacttttatgagggttccatgcccatgtgcttgagaaaccttctgctatccagaagacagccagtccttccttgcgtaaagggacactatgttatggctcaggctcaagcgggtaccgccagcactgccactgtctccatctctattttacaacaaattgactcgatagctgaggcattgtaacgctcttatattggcgccaactcgcgaattgactcagcagatccaaaaagtagtaattgccctaggagatgtcatgtacacgcaatgtcatgcatgtattggcgatacaaacgtactgcaagacagtagaaaaattgaaactggcatacatggagatgatcggagcactggaagagattacgatctgatacagctgcgagccctaaggccgactcataataaaatgattgtttcgcctgaccgcgatgaaaacgatgtcaagaggatacatggaataaacttcacgagctgcataaaaagttgaatcctgacgtataggtaaattttactttcgcgtaacatcgccaaactatgtggctagacgtgaacgaaagtccttttatgagagattcttgattcgcatacttgtatgaataaagagagaacctaacccttagaaagggtatttaagcaatttttatgcataatgaaagaaagaa

SEQ ID NO: 18746 - DNA, 873 bp, Diabrotica virgifera
  misc_feature (823)..(851): n is a, c, g, or t
cttaaattttttattcttcgaaactaataaaatgtttaaaatttccatacccaaaaatttgcatttttgagttatcgacttattcacagatggtacacaccgtgaataagtggataagtcaaatcttaaattttttattcttcaaaactaataaaatgtttaaaatggccataccgaaaagtttgcatttttgagttatcgacttattcacagatggtacagaattgtgctctaactgcttctattttccccccataactcggaagatatcgaccgcacgaaaattataataaacgaaatgatagaaaatcgcattttcaacaatttcagtttctacactttttgtcgaaaagttgaaaatggcggagatattgagtaggggcggttctcgtttaaaatcaggatggcggctgacgcaacggtcaaattcagtcgagattttagatttatactgctattgaccctccctaaagattggaagaatgaaagtttggggcagctcgtaatgcaaggtcaaatgctatcccgactgggctatctgtgattaccgcaccccagatatttaaactcttactactttcgaagttgcggggcattaataggtaatgtctgcctaactcttgatcttgaatttttgattacaagcatggatttcgtcttctattcttttattcgaaaaccccagactacctgtttccctcctttgagttgtgaaaacccctctctcacccctggggtggattaccactttaaaaccctggaccagtcggaaaacgtgttgaaagggtttattttccacaaagaatggggtttaaacaccgannnnnnnnnnnnnnnnnnnnnnnnnnnnnttttcccggggtttaatttatt

SEQ ID NO: 18747 - DNA, 365 bp, Diabrotica virgifera
  misc_feature (40)..(40): n is a, c, g, or t
cccccctctttttcgcgcccacgcgcccggcaaggaagcngaagccgctcttttgagcggcgaaaacagcggagacgagaccgcagcgagaccaggaccaagacagagggcacaagcaaccgctatttccgctgcccaatctgcccataatacaatggcagctgccatagtggtaataactacctcaggaaaatcggctcatctgataggcaagttctagcccagatgccctatcatagatgaaacgcaaaacccacaaactgcacgtcaaagccaaatagcccgatgcatacggcctccgatccaacaagcatgcgaagaaaataatggtgtctaaaaacgaaactacaacatactccttgtaa

SEQ ID NO: 18748 - DNA, 665 bp, Diabrotica virgifera
  misc_feature (9)..(31): n is a, c, g, or t
ttcacaaannnnnnnnnnnnnnnnnnnnnnnttgttgggggttgcttcctaaagggtatggagatttaaaaggcatgaaagtgtgtattgttatggtgtggatgaagtatgttttttatttcttttaagaagggagtattattttgtagaaggttattaggtatgagagagggagaaagattgggatatagaataatgtgtagatggagatatatataaattttatatgtaataaggattatatttagagaaagatttataggagttaggtgaggtagaggagtagaattcaatggagataaagagtgtgagtaatgaagaggatatggtttttgtatagaggatcttggtttttttgttgttttggtgaaaaagaaagttgtgtgtgagagagatgtaactaattgtgactgagatgaagtggtagagagatggagttgggaatataggcgcgaataagtaggattttgtgatggatgcgttctgatgagaagattttgatgtggggtgctatgtgtccaatgaggtaaagaaactagctgaggatatcttgatggatgatgaccagataaaggattgtgatttaggagtatctggcaataagaaaatacttatgtacatatacgtttgtatggagatatgataaggattgaaggtgtaatagt

SEQ ID NO: 18749 - DNA, 545 bp, Diabrotica virgifera
  misc_feature (22)..(44): n is a, c, g, or t
attgccatttaataataacagnnnnnnnnnnnnnnnnnnnnnnncttctttcttcttagatgttccgcgtagcaccatctcctcttggttgtctccttggtcggttcttgatcctggttgtgggtggcgtcctcgtcttcttctgtaggcacttttttccggctaagtgcctacttccctggttcgtcctattctaatggttgatcgcccagtcgattagtcggtgcttttctcgaaacatcctctgggcctggttgtctgcgaggatgtttctggttttcctgagccttcttgtagccgtgttgaagaagtgcctggtcctgttcacggcaacttctctcaatggggtgtactgtagtcggtccttgattgtttcgttgctgatccggtcctgccatgttgatccctcgatgagtcggtagcatgatgtctctgtcctttccagtcttctccagttggtttcggctgtggaactccagattggtgcggcgtacagcatcactggtcgtacgtacgcctggtatagttgtattgtcttcttcctg

SEQ ID NO: 18750 - DNA, 472 bp, Diabrotica virgifera
  misc_feature (64)..(79): n is a, c, g, or t
ctcctgcgcccaccctcccgaaaagggcaggagcaaaaccccttttaatcaatacagagctcannnnnnnnnnnnnnnnttcttacgatgacgattatgaagtcgatcattttgtactctcgagaactctgggacatcttataagatgcccatcaacacattagacagaattgggctaaggtctaaaggagccatggcgcaggtgctaaatcagaaaactcatatgaagaagccgacaccctaggcaaaagagcaatcctgctcgttgaagacgccgatataccgaggcttcctcccacactggcatgaaatgtaagaaatcttgaataacaagttctacaatgtactcctaggagctacagaagagcgcccactactccgcgctgaaactccactccaccccaacgcgaacagagagaagaagagccagaaccaggctagaagccctccacacggccgaaaagcatggagg

SEQ ID NO: 18751 - DNA, 574 bp, Diabrotica virgifera
cccccccccccgcccggctaggaacgtgagataaaacttaaatgttttctaaatagagttcctatgcacgcaccaggaaaaggtattgcccagacggcattgccatacagaaggagtggaccaacatgtttgaaagtcacacctaaagaattacaagaccatatttttaaacttggcaggaaaggcttgactccatcacaaattggtgtcatcctccggcattcatatggagttgccctagtacagtttgtttctgtaaacaaaatcttgcggatcatgaaagatatgggtcttgctccctgatctaccaaaataattatactactttatctagaaggtggaaactatctgctagcatttagaacggaacacaatagacaaggacagcaaattccgttggattgtgaaacaatcacttatctcactcgtttgagctaggtactacaaaaccaacagcgaattggcaccctagctggaagtaggaatcaattactgcatctgctttgctcacttcaattcgcgcttttatgctaagcttatctactcaaaaattttctacccaaaagtaagaaaa

SEQ ID NO: 18752 - DNA, 499 bp, Diabrotica virgifera
gtatccagtaagtacccataggtgaaatagaggatttatttcaaacggcgtccctttttgttaaatagtagaaagatcctctagtcagagtcagttcatgggtacgttccctctgaaccaagacaacacatccaatttagtctcaaatccatttaacaataacgacttgacaagtgacatcaattggcccaacctaaatccaccgttgcaacaaaaactagttaatccatttagagatataatgaaaacaaatggctacatgcaggatttccatccagtaggtgcctttccgcctcaagctgtgccttttgccgttaacggaaccaacggatggacccaaaatccttttaaggtcgggggaacaaacggtatgaactcgaatgatccatttttatgaggagaagtttttaatttgacgcagttggacgctagaaaaatatcggagataggttagcgtgcagtaactttattatgagtatgacattattgtcttaaaaag

SEQ ID NO: 18753 - DNA, 904 bp, Diabrotica virgifera
  misc_feature (817)..(817): n is a, c, g, or t
gacaggttaatcatgctagaaatctatgggacagagccacagttcttttgccacgagttaatcagttttggtacaaatatacttatatggaagaaatgttagaaaatgtaccaggtgccagagcagtttttgaacgatggatggactggcaacctgacgaacaagcctggcaaacctatattaactttgaactccgctataaagagattgatagagccagacaaatatatgaaagatttgtcataacacatcccgaagtaaaacactggataaaatacgcccgttttgaggaaaatcatggctttatacactcttctagacagatatatgagagagcagtacaattctatggtgacgatcatttagatgagaaactgtacattgcatttgcgaagtttgaggaaaaccaaaaggagcatgatagggcgagagttatttacaagtatgctctcgatcacatacctaaagatgaaactaaggaactctacaaggcgtatacaatacacgagaagaaatatggcgacagaagtggtatcgaagaagttattatgtcaaaacgaaaacttcaatatgagcaagaaatactgcaaaatccaaccaactatgacgcatggtttgattatcttcgactagtggaaggagaaaatgatctcgatattacacgagaaacctatgaaagagctattgctaatattcctccaacaaaaaacaaacagttttggagaagatatatttatttatggattaattatgcgatatttgaagaacttgaggctaaagattatgaaagaactcgtcaggtttataaggcttgttnagaaatactacctcacaagatatttactttttccaaaatatggttgctgtttgcacaatttgaaattcgtcagaagaacttaactgc

SEQ ID NO: 18754 - DNA, 684 bp, Diabrotica virgifera
tttcgtccgcatgagtaaaattccaagtggttattagtcggcgtttagtaaaaatgtgcaagaacaattcaaaaaattgtaactacagttttttccgatttcccaaggatgctgatagagcacgaaattgggcaatgttgtgccagagagaagatttgataaacaagaaaacaaacttaaatttgaacagattatgcagtgtgcattttgaaaatactatgttttcaaatgaaactcggaacaggttatgtaaaaacgcagtaccaagtttatttccttcaatagaagacagtccaaaccaacattcgaatgttgatcaagttattaactgtaaaaagcgatggaagaacatcaaagacacccatgacagaaggaacaaaaggaacacgaaaattattaggactagttcggatgcaccactttacaaaaaaggaaagaagaaatggctattacaagaaaagttgtcattcctcaggacaccgaattattctcgaagggatttctgcaacgtcgacgagaacgttggtcatgataacatcgaaatcgatgggcaatcgaccagtaaggattctgagatggaacaggaactaacagccaaggaatcaccaccccagagagccccaccagcatggaaaatatgaattatagagaaaacctgacttcagacattgaagaaatatcaaa

SEQ ID NO: 18755 - DNA, 863 bp, Diabrotica virgifera
gatgagggcgggagctactgtttctttttatagaataagagaggaggtggaaatgcaccgatcgcccattccggaggggagacagtgagatagtcctaggaagtgacgggttcgaatatgtcacttccagcggattttggggatcggatcagacccgatgaagtcaatttcgttctccatcaggatgctatgaaccatgatcgatcctatggcgatagtgacaaagctggacatctgactatgctgagtcatggggtaccggacgaggtggtgctcgtattccccgtgtaagaggagacggtacccgccgtactggtctgggagttttcagggagcatgtaggggagagtgggcgcatgtttgcaccatccaagccatgacgtcgctggcacagacgtgtagaggtcattccacgtcggtatgctttggcagccgctgtaggtgctagtggtgtgccagcgttaagtatgagcaaaggagatggcagcaaccgaatgcgtgaattgtcattggctgtcagagacagggcatgagagatgagcccatctagacgggatgtccagttcttgaggagaatcgaggcatggggtgacattcgaaaggtgtacaagacgttctcgtttccgtgctggtaatggaaaaatgcgtgataggataggcataccaacgtacaggacggttggctgcttacctactggatgcaggcctctcgtcgggcctgtccgttagctcacaggactgtgacctcattagcggtacagtaaggtaaatttgaagaatcttgcttctgtggggtctcgtgggtccgttttgttatttggactgattaagtttgcaaagttggtataattgttcggaaatga

SEQ ID NO: 18756 - DNA, 201 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (116)..(116): n is a, c, g, or t
  misc_feature (134)..(134): n is a, c, g, or t
  misc_feature (168)..(168): n is a, c, g, or t
  misc_feature (170)..(194): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgacttttanaattttacatgatctgangttaaaccggtgtgagcccaggttggtttctatncnnnnnnnnnnnnnnnnnnnnnnnnngaaagga

SEQ ID NO: 18757 - DNA, 374 bp, Diabrotica virgifera
  misc_feature (360)..(372): n is a, c, g, or t
aaaatgtacaaattggtggtgttgttcgccgttttggctgccgtctctgccagacccagtcatcttcttacaccagctggtccacagcgcagcagtgatcggttcagtaccaaccagcattagtgaacacagcacctcgatcgtccataatcatgctttggtccatgctgccccagttgtacactctgctccactgatccacaccgttcacgctgctccagttttccaagcttactcttctccagttgttgttgcttctccctacttatctgctggacatttatgggagacaccaagcggctctgtagcctagaggctgtgttaatataagatgtattttcatgaggtcaataattagcnnnnnnnnnnnnncc

SEQ ID NO: 18758 - DNA, 928 bp, Diabrotica virgifera
  misc_feature (701)..(701): n is a, c, g, or t
  misc_feature (722)..(722): n is a, c, g, or t
  misc_feature (748)..(748): n is a, c, g, or t
  misc_feature (750)..(773): n is a, c, g, or t
  misc_feature (907)..(907): n is a, c, g, or t
cctctgtcattgaattatatatcaacataacagaagcagaccaggacacaattggtgttaaaagaaaacacaaagagatttaagaaaattaaccatattaattatggtttattacacagtacaccaatcaaataagaactatgtatgtgatttgtatatgtgtatatgacagacataattagaatggataaggcatactgagcaaaataccgtaacgcgcgaacagtcgatcggtggtctatttatctctttttaccaagcgatcccgctcatgtgacagacaagaatagctagaccactcaaagtgaatattggccaatgacgtccttgatattggcgttactcctcgacccacagacgggcccataccttaccttgtctattcttattacctatgtccacgttaactgacaaagcaacgcaaaagaccaaaaacataatacctacgttctgaaataaaaagagatgaaactggtggaggtgtagaattgtcgatgggaacctataaatttacattacattacatagtttctcacctttagacgcaattttataaaattctcctgtcacagcacagtgacagttgtcatactccgatatgtctaaaggtgggaaattatgtaacgtaatgtaaatgttattcgctccgagcgttaacaaaatgtcaaagcaaggtttttaggttttagagacgtgagtanaagcaataaggcagaatatanttttggtgttgtaaagaacagattanannnnnnnnnnnnnnnnnnnnnnnnggtagggcaaactggggcgatcttatggcggcgttgctgtgatgtgtggtgattgaatggtctcccagcaaagttaaaactattgcatcacaagctttatttactcactattatgcgcatataatgaatttagntctgcatgatacgtgtaaaaa

SEQ ID NO: 18759 - DNA, 234 bp, Diabrotica virgifera
tgatggggaataggttcagcaccggatgaaggcaattgagttctccgaggggatgcgatgaatacatgactgatgttaggggattgtgagatagagcacattgccgctggaagcgggcggggacaggcggaggtggagctcgtattgcagcgtacgcagaggagagcgactggcagggaaggcattggagacgggagtcgcccgcaagaagacgtcgaagacagacggcagagg

SEQ ID NO: 18760 - DNA, 758 bp, Diabrotica virgifera
tatcttaatgtatgcatagctatgtatgaacaatagtgacatagagacatatccgtatatactcttgaaagaatccctgtgcaggagaaaagttgtcatggcattatacgtcgtatatatgcatgtcctatcacctcacctactcgcaggatatctacccagaaggaaatctcatgtatatctcatgtgttcacgacactagacgtattgtaagttgtgagctgatttcttcatggagcagcttctgtaattcatagaacatgatcccggcagagtctttgctagcttgtcgcctaccgtggtactgacattcatatttactagacatctacaatgttccgaatgtttcatgctgtatcgcaaacaagtgccatggaggaatacaatatcaaaaaagactatagacaccatctattgcatatcagctctaaaagaaaactatagaaaaaatagattttgctaggtatgcgtcaatcctatttactatttttgttgggaataagccacgattttacattaaaattaacgtttcgatttccgaagagaaaatcgaagcgtcgagtatgcttatattaaagtatgattgggacttattgcgaacgataataataaattacaggtagacaatacatatagccatatgatctatctctatcgatcaacgaggatcctacagcctctgccgcttctctaatttcgaccgccatgcgatctctgcgcatccatgcctcttcttcgatgtatctatctttcatgat

SEQ ID NO: 18761 - DNA, 492 bp, Diabrotica virgifera
  misc_feature (16)..(118): n is a, c, g, or t
  misc_feature (129)..(491): n is a, c, g, or t
ggaccttggggatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 18762 - DNA, 727 bp, Diabrotica virgifera
  misc_feature (9)..(43): n is a, c, g, or t
  misc_feature (46)..(645): n is a, c, g, or t
  misc_feature (665)..(702): n is a, c, g, or t
cttagagcnnnnnnnnnnnnnnnnnnnnnnnnnnnnnnnnnnnctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacctttagggataacagnnnnnnnnnnnnnnnnnnnnnnnnnnnnnnnnnnnnnntgcgacctcaatgttggattaaagt

SEQ ID NO: 18763 - DNA, 822 bp, Diabrotica virgifera
  misc_feature (550)..(567): n is a, c, g, or t
  misc_feature (760)..(793): n is a, c, g, or t
attatattacgaatgtgtgtgccgggtgtctcgagaaaatattcaaaattacagccgcaatcttggaacgcgttttcgctgcctgttgatcgctactgtttactcttctcgctatatattttgatatataaattttaattcatgaaaggtgtaaattgtaagacaaaatatatctgacttaggatacaagctaggaaataaaaacataatatgccatacagtgggtcaaaccaatacaatccatggcatgtaatatgtaaaatagtggacacgttgtcggaatgcacgacatgatgacagattgacaaattcagcaaaacaacgtcaaaatggagaaaatgtggctaatgcaagaggatcctggggcgagaaggcaaattatgatttgaaacatactcgtggaaaatctttcagacatgagaaaacgaaaaagaagcggggatcctaccgcggaggcaccatcgatacttctattaattccattaagtttgactagattactctcaaattgtttctttatcatatttactgtaatttatatacctatagnnnnnnnnnnnnnnnnnnggtatctttaaactctttaattgagcggagaacacacatatactaaactgattgagaacagatttgttgaggtttggtttaaatatttctttgccatcgttgtgtcaattaaataactgctttgtcggtaacactcaaaagatatttcagatgtaatcgagatagaaatgttcattttgaaaatttaaattgnnnnnnnnnnnnnnnnnnnnnnnnnnnnnnnnnnccggcctcaatattttatgattatcctaa

SEQ ID NO: 18764 - DNA, 887 bp, Diabrotica virgifera
  misc_feature (380)..(397): n is a, c, g, or t
  misc_feature (782)..(805): n is a, c, g, or t
gattataacagaaacggatgtagatacatttaatgaattatgcagaaactatttaataaaactacaaaatgcaaatgagacagagtttttcgattatctgagagtattacttaaaggatctaaagagaataaaaatgtgggcccattgttacagaagaaattccggaattaacaccaacatggcaatagaatcattgaacaacctactgaagacaaactacctaaagaggaatggaagagtgggaatcgagaagttattggatacgattgatgagctagtggagacaaaaatgtggaagagaattgtggacatgaaacgaccaaatgcgaataattatcaggataggactataatgaaatcacacagaggggcagaacgnnnnnnnnnnnnnnnnnnggttactaagaatgtggcagtatatggtcaatatcaggtaacatcccttaaggatcctagtctattacaaaatgtaactttaagtcaagtgtgtgaaagtgagtgtaagctgttgttttgtagagtttgtaaaatttgtatgcaccgttatcagtgtgactgtacagtatatgaggtgaagaataccttgtgtcagcatgtgcacttggtaagaatgtatgaggagagtgtgggtactaactctgttttagatgatgctgcaaggtgtttgggagaaagttcaattatcaaatcaaaccatgaggaggaaattaatgaatttatcagagagaaactagaacagacaaatgagacccaggaaaaaaccaaaggaagtcttgaattnnnnnnnnnnnnnnnnnnnnnnnnggaagccttaaaaaatgaaatggaagcccttaaaaaatgaaatggaagatttagatgacacaagtttaacaaattacgtgac

SEQ ID NO: 18765 - DNA, 362 bp, Diabrotica virgifera
tcttcctccggccggggctcacttcaatcttcacggtagagaccatggtggaccatacgtttctcatcgtcatgctatagatcatgtccacgttggaggtgatgattgaggggactccataattaaatgctcatacataatatatccttggaggaaaaaacgatatcgacctgcgtgccggcagaattccatgcagaaactgatgatcaggaaaccgctggtgtcaggttgtctgaaaccttggtgagaggcatctgcacacagaatggacatcgcggaagttagtgaattgtgctggatatttactatctatggagggtactattggtctagtgatagtaaactgaacagagggtgttaaa

SEQ ID NO: 18766 - DNA, 917 bp, Diabrotica virgifera
  misc_feature (69)..(892): n is a, c, g, or t
ggcaaaaggtgacgataacatcgtcgtcatacactacacctaaccttcaaaatatcagattgggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttactatggagttccagttactc

SEQ ID NO: 18767 - DNA, 248 bp, Diabrotica virgifera
  misc_feature (192)..(213): n is a, c, g, or t
ctatgagtttcgacggtagcgctctttcgcggtttgaaacttgtatttttctgataaaattggtgtttgtgaaatatacaaaacgagaaaaatagatatttatctaaaaaaaacatggattatgaactgaaatatttttgtaacctgattactgaacgaatacgcgtaattaataggaaaagtaatgtatgnnnnnnnnnnnnnnnnnnnnnngattcaatatttaatagataaagatcctgcgactc

SEQ ID NO: 18768 - DNA, 505 bp, Diabrotica virgifera
tcccgatttcccccgctcgcccgctcgaaggtgtgatagctaggagatgattattcgatttggaatttctgacattgtggcaccctttgctgttccagaatggactgatatgcataatgaaggggtatgttcatcctgtatgcagtttacatcgcggctgaaatccatcgagaactaccaagaaaataacgcggtccatgatgaggatgacagcaggcacatacgccacggctgacatgcaactgtgatctgtgcgccccatcggggataggagctagacaggattatgacaaaggtgaaattctgcccttatctgatgtgcctcagaagtgaccaattgctataacttcttactgaggtctatgtggtgctgttcacaccagcgtctctcatcacattcgtacataattattcgaagatgatcaaaacattcaagtggcatgtgtcggaaatagatctcgttgaatcttgcaacgaatctatggaaaaaacattatgctcgcct

SEQ ID NO: 18769 - DNA, 838 bp, Diabrotica virgifera
  misc_feature (315)..(335): n is a, c, g, or t
  misc_feature (359)..(381): n is a, c, g, or t
tttcgtccgccaaaatgaaagcggcttgtattattacactattactacctgttgtattaagttacaaagctaacttaaatcctctttcaaatgagtttataaactatatcaatagcaagcaaaacacatgggttgctggaaagaactttgatgagaaactttccagcaacccttgtattattacactattactacctgttgtattaagttacaaagctaacttaaatcctctttcaaatgagtttataaactatatcaatagcaagcaaaacacatgggttgctggaaagaactttgatgagaaactttcaatcnnnnnnnnnnnnnnnnnnnnnggagcgagaaaaaggagtttaggnnnnnnnnnnnnnnnnnnnnnnngtgaagatattcaagttccagattctttcgatgcaagggaaaactggaaagactgttcagatgttatcagcactattgtagaccaatctgcttgtggatcttgctgggcaatgtctgcagcatctgcaatgagtgacagacgatgcatagtcacccagggaaagcttaaagtgcctgtttctgctgaaaatttattgtcttgttgcgatgactgtggatttggatgcgccggaggatatatagatgatgcatggtcgttttggcaagagaatggaattactacaggaggtctttacggcagcaaccagggttgtcaatcatattcgcttcaaccttgtgaacatcatacaaatggtactaaagtgcaatgcagtactttgaaactacggaacccttcttgcagaagcgatcaatgtgacgataccgcactaaattataagtcccaagtaactttatg

SEQ ID NO: 18770 - DNA, 123 bp, Diabrotica virgifera
ggcgggccccccctttttccggggattggaagaaaaataaagtaaaaaggcggttgcgttttgacaaaaaattgatttagggaaaggatatcagggatatcagtgtaaggcgatgttatggaa

SEQ ID NO: 18771 - DNA, 716 bp, Diabrotica virgifera
  misc_feature (6)..(28): n is a, c, g, or t
  misc_feature (218)..(268): n is a, c, g, or t
  misc_feature (271)..(291): n is a, c, g, or t
  misc_feature (296)..(361): n is a, c, g, or t
  misc_feature (379)..(396): n is a, c, g, or t
  misc_feature (406)..(420): n is a, c, g, or t
  misc_feature (422)..(438): n is a, c, g, or t
  misc_feature (441)..(459): n is a, c, g, or t
  misc_feature (474)..(494): n is a, c, g, or t
  misc_feature (634)..(666): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaattacgctgttatccctaaggaaatttattcttatnnnnnnnnnnnnnnnnnnnnnnnnnnnnnnnnnnnnnnnnnnnnnnnnnnngannnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnngctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtgaaataccgcgtgcattcaataaatcagtgggaaggcgagactttatatttaatacaaaaagacatgtttttaataaacaggtgaaaaaaaatgttgtcgaaatgcctttattgaaaccnnnnnnnnnnnnnnnnnnnnnnnnnnnnnnnnngctaatattatcgtctttactaaatttaaatagatttaattttatagttt

SEQ ID NO: 18772 - DNA, 822 bp, Diabrotica virgifera
  misc_feature (2)..(117): n is a, c, g, or t
  misc_feature (125)..(228): n is a, c, g, or t
  misc_feature (230)..(281): n is a, c, g, or t
  misc_feature (283)..(390): n is a, c, g, or t
  misc_feature (409)..(423): n is a, c, g, or t
  misc_feature (425)..(446): n is a, c, g, or t
  misc_feature (593)..(612): n is a, c, g, or t
  misc_feature (622)..(649): n is a, c, g, or t
  misc_feature (660)..(687): n is a, c, g, or t
  misc_feature (699)..(723): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgaggagaatattannnnnnnnnnnnnnngnnnnnnnnnnnnnnnnnnnnnngttaaaaaaggaagacggcgacaatttttttctccctgtgttttaaaaaacatgtgctttttgtgttaaaaataaagacccgcccgccccccgataaaattttaaaggggcgcgggatttgacccccggcgaaaggagaaaaaaacnnnnnnnnnnnnnnnnnnnngggggagaannnnnnnnnnnnnnnnnnnnnnnnnnnncgtttttcttnnnnnnnnnnnnnnnnnnnnnnnnnnnngtaaaacgctannnnnnnnnnnnnnnnnnnnnnnnncccctcaacacggttttaaaaaaacatataaaaagcttttttcgggttaaccattttttatctaaaaaactatttatttcctgggggggggtagaaaaa

SEQ ID NO: 18773 - DNA, 1248 bp, Diabrotica virgifera
  misc_feature (652)..(673): n is a, c, g, or t
  misc_feature (1039)..(1073): n is a, c, g, or t
  misc_feature (1139)..(1160): n is a, c, g, or t
  misc_feature (1224)..(1247): n is a, c, g, or t
aatctttattattatgcaaattacaccgtaatcttttccaggatatacgaaatccttcgattagaggtaggtagatcaaacccacggggtaaaccgtatactataatacaatggtaccaaactattgttataaacggtttaaacatgcttattaataactcttacttatttgccttgacacctcgcatttctccaatagaatagctttcactactttttataaaagttgccaccatgaagacatcaacggtaggtaagttgtcagacttatcctcgtccgtcgtattatgcgttttaaactctttacaaagtagcactcatctttatcaatttcagtttaaaactaagctgattggggaactacttattacaatatataagatgaacataaataatacctaggatttttccattaaggacgattaaaatgtaatatacccgtaatacctaccctaatcgcgttgtttccaactgctagccccattgaccgtggcccgtgacgtcggaccaatagaaggacgttcaagagcctcctaagatatttgaattttatagcattttcaaagcgtcgtaattagcgtacgggttaaaaatatttgtttttttcgcatgcaagcgttttaagatcatgttaccttatgttaccttatcnnnnnnnnnnnnnnnnnnnnnngcaagttccctattattgcacaaacacaggataatcagaatttgatgtatcatagggcataaaaaaacatccatcctcatatatttccagccaaagttgttgcctacaaccctaataagcaaagtacattcaaatccaatatttgtcgacttataacataacctcaataacaacagttgggcggttatgcacacattctccataaatcataattttttttggtaccgattttccagagtaggatttcgaaacgtcaaatttggagacccgcgcgagcacagtcgtaaagggaaaatcacaaaaaacgattggggaagaactcctttgggggttaccttttttcttaccaagtgggttggaaaacannnnnnnnnnnnnnnnnnnnnnnnnnnnnnnnnnnttaacaatttttaaagggttagtttggcattttaaaaagaattctacctttttttgtaaacgaacnnnnnnnnnnnnnnnnnnnnnngaaatttttccttttaccctttttttttggtgggggggtggggggggatgagcgaaaacaatgnnnnnnnnnnnnnnnnnnnnnnnnt

SEQ ID NO: 18774 - DNA, 560 bp, Diabrotica virgifera
  misc_feature (241)..(255): n is a, c, g, or t
  misc_feature (502)..(558): n is a, c, g, or t
aacaaacttgagaaaacttggattttgtttataagttagtttaagaaatattaaaattgcaatagtgaataatgggcagtacagccaaagccataatgactggttttatatgtagactctgttcagagcagaaaaaagttgtagtccatttatacactaaaagggccagagagttagatttgataaagaaaatggaatctttaccaattacactcaaaaaatacgacaatttaccaaaaannnnnnnnnnnnnnngcatcctaaggttagaagttcaatataatcttatactcaaaattagatcttcaagggcagtaatcaaaagtcatagaatgtaccatagtaatggcagatgtccagtggaatgtccccctacattggtgtaccagattcaactttggtcctcctcgccccccgaagaagcagagggagttagtaattcctaaatgtgatacaccttaataacaactatcctctattttaattccggcatattttgacnnnnnnnnnnnnnnnnnnnnnnnnnnnnnnnnnnnnnnnnnnnnnnnnnnnnnnnnntg

SEQ ID NO: 18775 - DNA, 867 bp, Diabrotica virgifera
  misc_feature (75)..(98): n is a, c, g, or t
  misc_feature (415)..(442): n is a, c, g, or t
  misc_feature (496)..(517): n is a, c, g, or t
  misc_feature (724)..(751): n is a, c, g, or t
gaatgagtgtatgagaatttgagaattgtattgaatagtattgaaaattgaaataagtaaaatcaagtgtaatcnnnnnnnnnnnnnnnnnnnnnnnngcgaggaaacgtgtaaagtaaaaatagagtataatgaggttgatgatgctcctttggatggcttcatagatagggaggcggatggctttaaatgtgaaattaaagaggattctgataggcaaagttcacatgatacatatgattatttcgatttaaaggaatatcccataaagactgaaatagaacaagatggaaataaactgtgcccatctgaagaaaaccaaaatattgaaaaagggtccccatatgattatttggatttaaaggaatttcccataaatactgaaatagaacaagatggaaataaacttggtctnnnnnnnnnnnnnnnnnnnnnnnnnnnngggtccccatatgattatttggatttaaaggaatatcccataaatactgaaatnnnnnnnnnnnnnnnnnnnnnnggtctcccttgggaatacattcacactgatgcaagcaaagaatttaacgatcatattagaaataacagcaattttagtcaatattcaactgctgctgtatatacgaacactaaggaaaaaccttttttatgtgaaatttgcaacaaacagttttcacaaatatcccatttaaaggaacatcaaatagtgcacactgggaagaacgtnnnnnnnnnnnnnnnnnnnnnnnnnnnngtttattacatcaatgagtttgaacaaacatatgcgattacacactggagaaaaacatacaagtgtaaaatttgttttaagccgttttctcaggcaggtaatttgaaaaacatatt

SEQ ID NO: 18776 - DNA, 733 bp, Diabrotica virgifera
accgtgagtgaatggacaagtgtcaaaatatggaaaactgccaatatcgcatttttgtaagcataacctctgacgattttaattacaaaattccattacacatttctataacatacctttgatattttagtccacacagacgtaccctttttgtgaagaatttacgcaactattggtgcaatatgtgcttctggaatgtaaagtactgtacaagagggaaaactattcaaagaccacggaaaatttgacggccctcagaataataagactgctgctcaacctctacgatgaatattttacaactaaacagtttccaaaaagcaaagttttaggacattcggtcgaagccatcatcaggatcttcgtgacgatcaagtgtcaatatagcgcaaattatccaattttagaaactatgacagtgaaccttttgaaaaagagtggccgctatgaaacagtcactaaacttcaagaacaatacgcctcaagttacgtacatacatattcagacatagatccctcactacgaggtttatgtaggaatgcaagtagtgactatggaaccgatgacggaaactccaatgaacctgttgttattgatgatagtgacgaagaattacaaacaatagacgaagaagctccagaggaagacgatctagaaatcaaagtagaagcagtcgcccagtcggaatatgaagttaaacaatcaaaaagtaaaaatctgggttatacaatt

SEQ ID NO: 18777 - DNA, 144 bp, Diabrotica virgifera
tttcgtccgagcttattagctgtgtttttctgtctagggacgattgatcaaccacaaaaaactacatgtgtgaagacaatgtaggcattttcggtgatgacgatggatccgaaaagactccgtttgagacaagccgtacaatac

SEQ ID NO: 18778 - DNA, 374 bp, Diabrotica virgifera
gaggttacaagcggagaggatggattttgcgcattctgatgaggtagtagaagacagctatgattactggatggataaacgtaaccgaaaaccatgaaaatgctcttcttttggaactcacgaactaaggaccaattaacgataacatcgacgctagccaaaaatctttcacgttttattcacatgcagcctattacaaacaaaattgcagaagcaaagaagaagagttggaccattcttctttaactgttgcatacaagacaatcaacgtgctgaataactattggataatcataaaacagctggtctacttattggggaaatgacggatacttcttgatgtcttccacaacaaccactgtgtagtcatgaca

SEQ ID NO: 18779 - DNA, 137 bp, Diabrotica virgifera
tttcgtgcgagctcgagtaagttaagaatggccaagcagacccggtgataaaaaggaaaatctgccatagatgaagtagtagctacagaagatacagtgaatcttcacaagaggttgcttgcgattacgttcacaca

SEQ ID NO: 18780 - DNA, 1043 bp, Diabrotica virgifera
  misc_feature (293)..(311): n is a, c, g, or t
  misc_feature (615)..(632): n is a, c, g, or t
  misc_feature (838)..(855): n is a, c, g, or t
  misc_feature (862)..(879): n is a, c, g, or t
  misc_feature (922)..(944): n is a, c, g, or t
  misc_feature (950)..(988): n is a, c, g, or t
tctttcgtccgaaattactaaatatttaattctcatgctgtgttctgttcgaatacgaaacagcacaattcgggatctaataaattcaaaaataagttataatgaaaattactatacctgacgatttgaaaccttccatcaaaagttatctagaagaacttgaatgctgtaaaaaatgtgtttttagatatttaggatacacattgtatgatgcaggtgctagagaagtgtatgctggagaacaaaatgttaaaactgaaatcactgacgattccgagtctcaaccctcagcnnnnnnnnnnnnnnnnnnnccatgtagggtctgtttggatactttgtgtacagaatcaatggaaaattatttaaccacatttcctcctgactttgaagactataaaattccaaatgtcctaacattcgtaacgtttcccacttcgatgacactcagggaacacagtatgctggttgctttaagaaacaaatttccgaatatatatgcagatataaatctatgtaatttggaagatctaaagagaatttttaaagcagcatcgtcaacactgataagtaaaaaaattaacaaagttcaccatcatgatgcagattttgaagtgnnnnnnnnnnnnnnnnnngaagatgacaataaggaggcagcagaattcaataaagcatatcctaaagcatctttccgataaaattgggaggctggcttagaacaatggaaagacgacaagtttcaagatgtttttcccgggggcccccgaaaattccaaacagaatccccttttcgggcgaaattaaattataacgacaaaagccagaatatttaagaagggannnnnnnnnnnnnnnnnngccgggnnnnnnnnnnnnnnnnnngtttttttgtgaatggagtgacttatatggggttttccaagcnnnnnnnnnnnnnnnnnnnnnnncctctnnnnnnnnnnnnnnnnnnnnnnnnnnnnnnnnnnnnnnnctaaaatggggcttttttccccgggggcggggagagaacattgctcccatggggg

SEQ ID NO: 18781 - DNA, 107 bp, Diabrotica virgifera
cgagaacacaacaaaacgccgcaaaaaaccggccaagacacaacaagaacaaggaaacccaaccaaaaaacagaaacacgcacaacaagaacaaaggccgggacgcc

SEQ ID NO: 18782 - DNA, 103 bp, Diabrotica virgifera
  misc_feature (14)..(15): n is a, c, g, or t
  misc_feature (29)..(29): n is a, c, g, or t
  misc_feature (31)..(89): n is a, c, g, or t
aattaattatttannattagtatgatgantnnnnnnnnnnnnnnnnnnnnnnnnnnnnnnnnnnnnnnnnnnnnnnnnnnnnnnnnnnnttcgcacatttttt

SEQ ID NO: 18783 - DNA, 784 bp, Diabrotica virgifera
  misc_feature (201)..(220): n is a, c, g, or t
  misc_feature (463)..(486): n is a, c, g, or t
ggtgtcccaattccaatggtaaaatagtataaacatttcatatactcttttaccgtagtatgaccaatgggaatttttatctcccccgacggtatatacgtataaagtcttttatatactctttgggtatactggaaaaatggtaaaacagtatatgtcatttttcaagcacatttgaaaaaactatacatatttgctgtnnnnnnnnnnnnnnnnnnnncatgctttttttatattccaaatttcacttgtctaactttataaatgacaaaacggcataacaaaagaacaaaaagtcatttatctcaaaactcacttttttcacatatactgttttacctttgcagggtgcacactggagaatgatctgagaagcaatgttggcaaaaaccaaggttttttttccaaaaaaaccaggtttatttgatacaaagtataataagtctaaatactttaaaaatgnnnnnnnnnnnnnnnnnnnnnnnngtaataaacactgaaaataatttttaggacaacttttatttttatttacacacacaaaaagttaacataaccaaaaaaaaacatcttcaaacatattaatattcaaaatcactgagttcgaaagtaaaaaaatagaatttatttatcttaattttcttcatttgtggcagctgtattaaaaactttaaataaaaacaccagtttggaagctcaataaaaacacaggtcttaaaaaatcagtcggtaaaatccttggtttaaacctacccacccctgcttaaaaatggtgaaagttttg

SEQ ID NO: 18784 - DNA, 702 bp, Diabrotica virgifera
  misc_feature (538)..(557): n is a, c, g, or t
  misc_feature (677)..(677): n is a, c, g, or t
aaaaaaaggacgccgttcgaaataaatcctctggttcacatatgggtgcttactggacatattccgtacttacggatgccagatggggggacattcatctttgattcctctttagggttaaactggacaatcatttttattattctatggttctatggcttctatgccatatttcttttcttctactctaaaacttacacagttgcattagacatctggttaataattttccaaaggttacagaaagaaaaggtacattttcaaaaacgtttatttaaaacttcaaactttgtttttactataaaaaaatactttcttcaatatgaagttattacaactactaatttacaaaactttgactttgatattacaaaggttttaacctggtttagacttaaaatactctcaaatattaattattatttcacatgattttacattacaaaagaactttttggacagtgtatgtcaacataagatttgacgtagctgtcaaatgtcaaagtcactgtcatttaccattatgaaagcaaaagcnnnnnnnnnnnnnnnnnnnnctctttaccagcaaactttatatccatttggaatccttacaaaattaaaaaacgtctcatacctttttaaatcactcttccaaacacaaacatcctgtcatcacgctttcgaaactacancgaggcgggcgggggaaacttcatc

SEQ ID NO: 18785 - DNA, 847 bp, Diabrotica virgifera
  misc_feature (14)..(841): n is a, c, g, or t
cgatctagactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagac

SEQ ID NO: 18786 - DNA, 351 bp, Diabrotica virgifera
  misc_feature (110)..(140): n is a, c, g, or t
ttgcgggcggaagaagttcccgattttgaaaccttgaccaatcttccgcaagatatcgatttaacagggaacgtaatagttttgtttaatgatagacaattagcattgannnnnnnnnnnnnnnnnnnnnnnnnnnnnnngttattttctgtaccatgtgtatcacggattattaactaataattatctatttattattctcgaattctgcagagctaaaaaataagaatcattattgtcaaataaatatgttacataaatttgttgaattgagatgttattcgtggtaacttatagccaagtttctacgacatagattctatttatttattaaccatatatctataatcg

SEQ ID NO: 18787 - DNA, 1174 bp, Diabrotica virgifera
  misc_feature (846)..(865): n is a, c, g, or t
  misc_feature (875)..(916): n is a, c, g, or t
  misc_feature (934)..(977): n is a, c, g, or t
  misc_feature (1056)..(1085): n is a, c, g, or t
  misc_feature (1138)..(1170): n is a, c, g, or t
cttacatttgcattttacccacaacaatgtttttgtataattgctacaaattataattaatgtatatagagaattaatctacaacagcattccatagcagtcatgcctaaaaagttaaaaatcgcatttattcatccagatcttggaataggaggagccgaaagactggttttggatcttgctggagccctaactctttcaggacatgaagtaaggttcctcacaaatcattttgatcccacccatgcatttgatgaattaaaaaatggagattatcctgtagaagtgtatggagactggttaccaaaaagtgttttcggaagatttcaagccctgtgtgcttatgtccggatggtatatatgtctatagtttatttattattctttaaaaataaggacaaaccggatctttacattacagacttaataccagtagcaaacgtatttttaaaaattgctggcgagaaagttatctattattgtcatcatcctgatttacttgctagtactcctggaggcgaactaaaaaaattctacagaaaaccaatagattgggtagaaatgaagacaacaggaaaagcagatgttattttagttaatagtgaatatactgcttccatatttactaaaaaattcttacaaaaaaccaatagattgggtaaaaatgaagaaaacaggaaaagcaaatgtttttttaagtaaaaagggaataaactggttccaaattttgaaaaacctttttcaggctacataaaaaaattccaaatttttattccaaaaacccccccttcgtcccaaaaaacggaaaaaacttttaaaaatttaaccccaaacaaaaataggggnnnnnnnnnnnnnnnnnnnnggcccaaaannnnnnnnnnnnnnnnnnnnnnnnnnnnnnnnnnnnnnnnnnttgtttttttacattgtnnnnnnnnnnnnnnnnnnnnnnnnnnnnnnnnnnnnnnnnnnnnctctttttataaggggggggtttttcccccctttttgtgggggagaaaaacaccccaccaaaatatttttttctcccannnnnnnnnnnnnnnnnnnnnnnnnnnnnncgcttctttttctctcccccccccacaaactttatatagggggggggctatcnnnnnnnnnnnnnnnnnnnnnnnnnnnnnnnnnccac

SEQ ID NO: 18788 - DNA, 963 bp, Diabrotica virgifera
  misc_feature (793)..(811): n is a, c, g, or t
  misc_feature (813)..(813): n is a, c, g, or t
  misc_feature (846)..(846): n is a, c, g, or t
  misc_feature (876)..(876): n is a, c, g, or t
gaagttagatcgtggtgcgccgtgtgcgagccgtttgtgtgccacttgaaaacacatactaatctaacaaatatgctgcgcgcgagcggctcgcacaccgagcagagcgcatattatgtatacccgcctttaggtgctttagaatagttcttagttttgcagaaaatttttttatcgtgaagtactattttcggtctcacggaaagggttgcgaaaacggtccaagcttatcaacaatggtttcagcaggacggggcaacctgtcacacggtcatttagtctctttacacttgattctaaatcctgacccactactttgtgccgtgtggtttgggttggctatatgaacttgaatcggcgaagtgggcatataggtggtaaagttttgctgtatattggccactttaaaaattcacatcaaatatgtagtacctaccttttttgtagatgtgtttaaacatgcaactgaaaagttattactattaagagtgatctgtaggtattacctttaactgtggggatttattcgtgacttaaatgaaacaattagatatagaaaatcacaaattttagtaaatttgggaaagcatcataaatacaaaaataccgatgttgaaacgtatttaaataccttaaattcttactaaaaatgtacccaagtttttgggtaaatttttatctattaatcattcatgctttttgtacatttctacatttcatatttttgacttggtatcggagctgatggggcgtatttcgggatttaaagacttatttgtaggtgtttaaatannnnnnnnnnnnnnnnnnnanatgccaagtacttatttataattctagagtatntaagtacttggcgtttaaatacttactctncagtccagaagtttagatacatactacagaaagggatttaagttttgaaatgctgcccatcagctctgataccaagttaaaatttaa

SEQ ID NO: 18789 - DNA, 68 bp, Diabrotica virgifera
  misc_feature (12)..(13): n is a, c, g, or t
  misc_feature (24)..(24): n is a, c, g, or t
  misc_feature (54)..(54): n is a, c, g, or t
ccgcgaatcttnnctcttacgtgncatctccgcgtcgaaggtggcaatcatcgntgctattctaactt

SEQ ID NO: 18790 - DNA, 592 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (524)..(567): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaatacnnnnnnnnnnnnnnnnnnnnnnnnnnnnnnnnnnnnnnnnnnnntaatacaaaaagacatgtttttaat

SEQ ID NO: 18791 - DNA, 610 bp, Diabrotica virgifera
agggagaccaccagtctagagctataggaagacttgctggaaaaggaggaagaactaaattcacaatagaaaatgttacaaaaactagaaatatctggggtttccttacatgccctaatttctacgtttctggtttttaaattaaatcggatttggagttgcaagtgctcaactacaggtgtgaatatttttaaccaattttcttttaatggtgagtatctatgtgaaggtacagctatttttctcatgtcatctttggtttcggaaaatgatttggatcttgcctttttcgttcttggtgctctaactttgttattggttcctttgaaattaaggatgtcaaaacattaaagggagaccaccagtctagagctataggaagacttgctggaaaaggaggaagaactaaattcacaatagaaaatgttacaaaaactagaatagtattagcagacagcaaaattcacattttaggtagctttcaaaatatagccctggcaagaagggcagtatgtaatctaattttaggttcacctccttctaaagtttatggacaattaagaaatgttgcatctagggtatctgaaagaatgtgaataaattatttatt

SEQ ID NO: 18792 - DNA, 404 bp, Diabrotica virgifera
  misc_feature (2)..(205): n is a, c, g, or t
  misc_feature (212)..(249): n is a, c, g, or t
  misc_feature (269)..(282): n is a, c, g, or t
  misc_feature (285)..(307): n is a, c, g, or t
  misc_feature (315)..(337): n is a, c, g, or t
  misc_feature (367)..(398): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 18793 - DNA, 861 bp, Diabrotica virgifera
  misc_feature (809)..(830): n is a, c, g, or t
atttaatttaaggtgtcatcatggctttttcagagagctgtattaagttttttgtatctggtgccaattttacctttgcactcggtggtcttgctttaatcgtcgtaggagtactatacaaactaaacataaatgattttactgaagctataccagaagaatacagctcaataggcgtagctcccatactgaccattgtagtaggctcaataatatttgtcatcgcattctttggatgctgtggagccattagagaaagcccatgtttgcttacaacgtacggtgtaatattgttggtaatatttttgcttcaaatcgccgttggagtctttgcttttatagaaataaaggataaagataatttcaaaacccaagtgaacaagcaactggatactttgtttaatagagctaaggaccagaataaacacgaattaacagatttaattcaaaaagaatttgaatgctgtggtcctgacggtccatcattttggggagctagtataccaaaatcatgtttggattcaaataacaaacaatatacggatggatgcaaaacagagttttacgattttcttaataaagccatgaacgttattggaataactcttctggcactgtcagccctcgaggttattggttgtgtattttcactctgcttgtccagcagtataaagaacagggaaagaagattcaggtactgaggtttctcaaagaaatattcagccttaaggaaaaataaagtcttacttatttaagtgaactaattagtatgttaacatgtttctctaataaacatcttccttttttcnnnnnnnnnnnnnnnnnnnnnnccgggcgcttctaaaggaacccaacgcttac

SEQ ID NO: 18794 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18795 - DNA, 119 bp, Diabrotica virgifera
  misc_feature (17)..(54): n is a, c, g, or t
  misc_feature (90)..(112): n is a, c, g, or t
accctagggataacagnnnnnnnnnnnnnnnnnnnnnnnnnnnnnnnnnnnnnntgcgacctcgatgttgaataaaagtttataaatggnnnnnnnnnnnnnnnnnnnnnnntgttcga

SEQ ID NO: 18796 - DNA, 1002 bp, Diabrotica virgifera
  misc_feature (789)..(789): n is a, c, g, or t
  misc_feature (802)..(802): n is a, c, g, or t
  misc_feature (809)..(809): n is a, c, g, or t
acaactacgtgctcaagcatcgagattgataaagctcctgttatttacaatatagtacacagtactactatagtaattttagttggctagggttggaccagttctagataaaggtataaaacaatagaaaaatatctataaagtaccataactacttcaagaatctaatattgtaaaaggaatcgatagaattttaataaaataaactgttcactacatcttatactattgatcaatatactgaaggtacgtagttggtgctactattgtcgttggtgctccgtgtagctcctcaaatggatacggcatgcgctcccctacatataaaccgcaaaccggttgaatcgaagaggatgagcggcgagcaacaacgtatccactatgtggggctgctacaggagcaccaacgtatggatacgtaccttaatggcctttaattaagcccttcccatctgtaaaataaactaaaactaagtgtgtgtcagatttcatcgaaatttttattcgtttgagaggcctctcgacgccattatgtatggaatttaccatcgatcaaatgtccttcacggcttggcttggatcaaatgtggtcaaatcatacgatcttggtgaacaattcacatcacctccacgtgaggtgaccatgccctaaaatagttcatgcagattctaatctggcatatgtgtagcatatagcgccgtcttgttaaaaccacaactagtcgttggtgtccatatcaaattcagaccagaagaagttggtaattaacgacctatagcgctcgccgntgacggtgatggnctgactnaacgttatcataggttttgtctagcaaacagtcaaactagttagcaaccgtaagcaaacagttgggtcagtgagaaaacataatacagtcaccagtgctatcccgtctactcgcgctggtccactatcgctgatggttttaaccgtttgaactgatgctagaaaacctattgaaataaggaccggtgacgatg

SEQ ID NO: 18797 - DNA, 900 bp, Diabrotica virgifera
  misc_feature (95)..(127): n is a, c, g, or t
  misc_feature (137)..(210): n is a, c, g, or t
  misc_feature (216)..(238): n is a, c, g, or t
  misc_feature (429)..(502): n is a, c, g, or t
  misc_feature (507)..(572): n is a, c, g, or t
  misc_feature (590)..(608): n is a, c, g, or t
  misc_feature (617)..(631): n is a, c, g, or t
  misc_feature (633)..(650): n is a, c, g, or t
  misc_feature (653)..(671): n is a, c, g, or t
  misc_feature (686)..(706): n is a, c, g, or t
  misc_feature (845)..(890): n is a, c, g, or t
aggaaaagttcctaaaattaacgtttgtgaagatattaaagaggtttataaatgtttaaaggctttaaaacattaaaatagctctaaatagtctnnnnnnnnnnnnnnnnnnnnnnnnnnnnnnnnngttaaaaaannnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnnngannnnnnnnnnnnnnnnnnncccttcattccagcnnnnnnnnnnnnnnnnnnnnnttatgctactttagcacggtcaaaataccgcggccattcaaataatcagtgggcaggcgagactttatatttaatacaaaaagacatgtttttaataaacaggtgaaaaaaatgttgccgaattccctttattaaaacnnnnnnnnnnnnnnnnnnnnnnnnnnnnnnnnnnnnnnnnnnnnnncctcattaac

SEQ ID NO: 18798 - DNA, 596 bp, Diabrotica virgifera
ccccttttcgcccaccatgccccatgccccgaatggggctgaaccgcatacgtcgctctaaaaatcgtagtatgtatgtatatattttcaacctaactcaatacatatgcgctatgtttttaacaatgctcaactgcgccaactttactgttgatcttgctgagctgtccgccaaaattgccatggagctaaagacatatctaaaggcgtcggattagatggagtagatgggggcttacgcaaggactacggtattctgatcgagggtaatgagtactaacatttgacgccggcgcgtttgcagcccagagctatggctacagctcctgaccgctatacatgtcccctgcgcaaaggctatgtcgaagctgacgagttgcggatagtccgagaaagagcctaccacaatacgcgcaacaaaaagatctggctcgaaccaagtttctcattcccgaaatgttagtgaaggacctgagcgggaaagatactgacagtgtcgttacggaaagacatatggaacttaccgaaacgaatatggtgtcggaagcagaactctatggagtgagagttctgttcgaagcgatgaaacccccaag

SEQ ID NO: 18799 - DNA, 754 bp, Diabrotica virgifera
  misc_feature (159)..(179): n is a, c, g, or t
  misc_feature (306)..(330): n is a, c, g, or t
ctccctttatttatgtaactaaccaacaaaatttattaaaactaaaactaacaagtaggtacaatatatatgccaactgtcaaatataagtcaaattattaatgtaaacattagcagatttacaacatgtgattcttgaatgccctattaatactgtgnnnnnnnnnnnnnnnnnnnnngaattagctaaaaatgggtgcccaacacctatatcccttacaacccttctttataaaccgcagttggttcttattaaacttttaatacattttttgaatatacacaaaattaagttatgaggaaagnnnnnnnnnnnnnnnnnnnnnnnnncataaatgaatatattataaataatttgaaaaatatgtcaaaagtacacgtgaaaatataattcgtatatccgaataatataatcttttgtttctatataaacattctgtaatcacctgggtctttcactatacctatctgaggcaacaacatgggattgtgtaatggtcaggtgttgccctgtataagacaagtttgtgcctttgttgtatttattccatgccaactcaaaattgcctctttactttcctcaaatgtgtataacttggtcccaagactggttctgacacctctataacagaaatgcatcccggaactgtaaattcggactgccctggatccaaatcgataacccttacttttggaaacatactcaacagcctgttaatggaatacctcatcaacgtacttttacctaccccag

SEQ ID NO: 18800 - DNA, 1082 bp, Diabrotica virgifera
  misc_feature (11)..(439): n is a, c, g, or t
  misc_feature (446)..(483): n is a, c, g, or t
  misc_feature (503)..(516): n is a, c, g, or t
  misc_feature (519)..(541): n is a, c, g, or t
  misc_feature (549)..(571): n is a, c, g, or t
  misc_feature (602)..(633): n is a, c, g, or t
  misc_feature (640)..(673): n is a, c, g, or t
  misc_feature (832)..(853): n is a, c, g, or t
  misc_feature (900)..(919): n is a, c, g, or t
  misc_feature (964)..(983): n is a, c, g, or t
  misc_feature (1008)..(1026): n is a, c, g, or t
ttttcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggagtgagcccagggtgggtnnnnnnnnnnnnnnnnnnnnnnnnnnnnnnnncaaaggnnnnnnnnnnnnnnnnnnnnnnnnnnnnnnnnnntatattcgcttgaaaaactcccacaacgaagtaaatgaaataattaaatggagaaaaatcagaatacgggtggcccgttcgcgatctaaaactaattcctggcgcgtgggggggggcacatgggtttttttccaattttttaataaaactaacttttcnnnnnnnnnnnnnnnnnnnnnntttttaccgggttaaaagttttccaaaaaacaaaaattggaccgggnnnnnnnnnnnnnnnnnnnncattccccaattccctattttggggaaaagggcacccccaagggnnnnnnnnnnnnnnnnnnnnccactcttcccccaaacaaacttgnnnnnnnnnnnnnnnnnnncaaccccccccctcttaaaaaaattatatcagacaaaaaaccttttttcccccggc

SEQ ID NO: 18801 - DNA, 480 bp, Diabrotica virgifera
ggcgggattggcggggcccccccctctcgccgggtcccctaattgaatcctattaactgggttgtgatttgaattcgaattaaataactagtcttcagaaccatacgaaaaataaatactcacaatggctgtacacgtgcttaaaggaccgggttttacccagaagtgaaaagagtgagccagcgactattctgagttggcatacgctggtgtgagaaacataatagcatgggaggaatgtgcgcagtccgagcaaactgcctagggtccatatggtatgaagaacgtgcgcattaatcacaattgagaaagagtttgtcgcaagtgatgcagatagaattatgcgagggctagataaagaacacccagaaggcacggtcttgataagatcgagtgttatgcgagattctgaggtggatgatgcagcagactctgctaattatgcttgatgaagcacttctggagcatgttgaagaacta

SEQ ID NO: 18802 - DNA, 334 bp, Diabrotica virgifera
ctaccatattcttttcgataaagtattataatattttgaacagaagtgaatctcgtctgtatccctttaccgatatgatgatatttcatcgcgagaggaatttcctactttagtacaaaaacatgtgtacctcctgtcgaacgtgtatctcggatttgtaattactacatcattcttaatatgatttctgaggttaggcgtaactaggatatgatagactgctatcgacatatcactattgtacaggatagttcttgaatacgagacggtattcaccgttaacttctatctatgtttctaagacctagccctgtatttcttcattaacgacata

SEQ ID NO: 18803 - DNA, 275 bp, Diabrotica virgifera
  misc_feature (245)..(245): n is a, c, g, or t
catccttacggccgcagaacagaaaagcggagagggagggagacaaattttgcgcaaacaggccacgcaacgagggaaaaaacaaaacgcacgccagaaaagaagaaggacgcacgccccccacttacaacaaagccacaaaagcggctgaggcggcagggaagccagacgacaagcccagcagaggagaaaaagggaataacaacagaagagggggagaaacgaacaacacacagacaaagacnacggatagcacgacaggcgaaacaaacgcg

SEQ ID NO: 18804 - DNA, 642 bp, Diabrotica virgifera
tttcgtccgcagaaggcttatataactgtagaaattgcagtttgatagttatcagtgttgtaacaacatacaaaaaatgctcaatttttgagcgataataacttcatatttagagaaaagtttactaaattagcgtaaataagtgaattatgtcataaaatgtgtgaataatagaaaacttgctaaaaacaatgaatatgtactgcatttgatagaaaaaagtttttgcaaatatttcgtagatgatgtttctcatattgtacaagcattattgtactcatgtctctgagaagtataatgaaggatgaccgatactgtgttggacttgattgcatccttatggatactagccttcatacctttgttgagaagcctgaatgcacacagagtactagatgtattgaccagttacatacagctgaggactcagatttttgacccgcctgctgtcattggcatcagaaatattgaactggagcctcctcacattaagataccccactatgagaactgtaattgaaggaacgatggagcgatatgctattgattgagaccgcacgcaattcgaaagatcctacatcttgcagtatatctggcgagggcaatcaatccaggtgatcaagttacatattcataaactat

SEQ ID NO: 18805 - DNA, 760 bp, Diabrotica virgifera
  misc_feature (14)..(43): n is a, c, g, or t
  misc_feature (680)..(705): n is a, c, g, or t
cgggactagatctnnnnnnnnnnnnnnnnnnnnnnnnnnnnnnaataaagtaaaccattgccttggtatagaaacatcgaaaaggaccggttctatagattacctgttactctataaagtctgtacttatgaaggcgtaaaatattgtggttatacagtgtagaatatcatagatcatctacggtaaggtcccatattgcaccggactaagagaacaacctatacagcattccatataaaatacatggaggattcatacattggacagctgggctttcagaatgatttagctgattggaatcagttttccttagtgctgtgacaggtgacgatggggtaaaacgtacctgacaacagacattaatcttcgtaggaatgatgttgatactcgttttcatcaaagtatgaggtcgtgatgttttcatcctcgccattgacctctatactataattgaactgcaccgcccgcctataagataatctcataaacacagccaacctgaagttgcgcatcacgccacaatcattttggatggaatgtctacgtgtgataataaaagctgtgtatatggtagcaggcgatgaaactgactgaagagccgaacgtaaataattgacgtatgatggggcccgtatttttcgcgcacgggccacaagatcttaataattctagaaaaaannnnnnnnnnnnnnnnnnnnnnnnnngtccacgacacagtagtaaaaattacttatttccatagtcgtggtaccgttcgag

SEQ ID NO: 18806 - DNA, 57 bp, Diabrotica virgifera
ggggggggtgtgtggtctgttgtttttggggggggaggtttggggggttaggcttta

SEQ ID NO: 18807 - DNA, 929 bp, Diabrotica virgifera
  misc_feature (101)..(159): n is a, c, g, or t
  misc_feature (235)..(255): n is a, c, g, or t
  misc_feature (434)..(456): n is a, c, g, or t
aacggcactaaggctgatattaatgctactgttgactgttacaaaataagcttttcatttttataaagcctttatgagataatccgatcattaatatgagnnnnnnnnnnnnnnnnnnnnnnnnnnnnnnnnnnnnnnnnnnnnnnnnnnnnnnnnnnntctgttttcttgttttgtacatgtattatctattttgttctccagtcccgttattttctcgtaaaattatcaaacnnnnnnnnnnnnnnnnnnnnngggtctaggaacacctatatttattcgggagcctctttatattgatttctgctaactttcaagggttttttaatttctctagctaggttctaggtaaattctaggtttattttgaaccattctagtgaaggagaatgtatgtcttctatatccgtagtacatcgccctttctaaagcannnnnnnnnnnnnnnnnnnnnnntggaaggtagaggtatttaaaattctagtattgtacttcgaacatgttttgaacagatcgtcaaaccaatggtgtctgatgagtcctgctgatttatatctacgatatgaatggtccccagtgcaccgtcctcttttgaagatgattacagaagtcttgaaaatggttttaaatgcttcgtttgagtgagtctaccactttctgaaaattttcagagtgcaggttggacggttttctgcaccaacaacacctaaacctgttgctctagagtggttatgttttgttattgcaaaactaactattttacaaaacgaagcagttaaagccatttttgggacttctgtgaccgttttcggaaggggacggtgtactggagactagaacgtttttaggtgcttaaaaaaatctctcacatttttattggcgaaatcaacagtgtatatttttagatattagattcttagatctcccga

SEQ ID NO: 18808 - DNA, 588 bp, Diabrotica virgifera
ggaggttgattgattattatagtcatgagatgattgtttatgagaatagtcaaaagagtagactatgtttatcggaggtagtgcgtttgatgaataaggatggttgtgatggagttattgctgtaggaggggggatattagtgttgatgttaggatttttgaaagttggggattgtttgtatgtggggtttgtgtgtagaaaaatgttagggtcatttttttgataggtggaggtgaagtaattatgttggaggaattggtgctcagggactcaagtgggtataaaattggattgatactagggtgaagttatgacagtgaaggtgtgagagtgtttggttctgtttctggtgtattaggcagtaatgataagacattggtattttataagggaaggaaattttgagagagtatgaggtggtaagtgctcatgtggttatgtgaaatatatttaggtgaatcattttgtttctgctgtattcttatttgttgtataatatttagtaattggagtatattggaattttgttgtgtattttatagtatataaaaagagaaaaggaattttaatatgggaaaaataaaaga

SEQ ID NO: 18809 - DNA, 949 bp, Diabrotica virgifera
  misc_feature (621)..(647): n is a, c, g, or t
caacccaccactgcacaatacatggtaaacaaaaattagtgttctttataaagtaggtacagatagccgagagcaacttgcgttcgataaacaaattaggtgatattaacacagtaaactgaacgttttcaccacaaaatttatataactatacataatataaaagtttttattacataaacgaataaacaaaaatctcattcaatacgttttgaagctgtgaacatgtgagagataactattgtattaacatgaatgaacatgaatacaaataaagaattcaacttggcgccaggaaagttgtctctggtttacgtcacagtgagcgatagggatgcaagaccatcatgcgcgttgatttatcttattgtcatagttcataagtattatgaaatcctagagccggcaagaacaactagacattttaaaaaaatgtctataggccccaggtcgactcagcctgaataaaataagtaccttgggtaaacccaggggtaataataggcggttgaagcgtagcactggccctgttactttccttgtataccgtaatccctagatatagcagactaccctgctataatcccaaagccgcgtcggcggtataaaacgggagattgnnnnnnnnnnnnnnnnnnnnnnnnnnncataatttcttatgctttattaccggaacataatagagaacataacagcaatatcttgcatgtataactactatattatcacaagaaaaagatttatgatttcctcgtatcattacaacgataaatgtatagtcttcagattaattttaatttgtgactaattaatactcacccctctaatgaacgtgtacttaatacaattcattatattatagcaatatttggcaacaaatctattccacaataggtaggtacttcactaaattattcatgtatttcagagaaataggaaaaaaatatcc

SEQ ID NO: 18810 - DNA, 500 bp, Diabrotica virgifera
ccatactataaggaaacaccaacaatgctagtacacatgattagttttccagggtataactagatgtaggaggacagagccaggcgctattctgagttggaataggctgtcataaaaaacttaatatcatgagagtgaagtgcgcagtcctaacacgctgccaaaggttcaatggatatgttgaacaagtggattaaatcgaaacagagaaggaatttgtacaaaggagaagccgatagtagtatgtgagtgatacatgtacaaaccccacaagcgcagcccttgagtacaaggagacttatgaaagatgctgaggcgacagatgtaacagactgtccgagaatacgtgctagaaggacttctgtagtctgttgatgatataatgcatcgttgctggaactcccacatgaagaacagatagacatgaggaaacactagacatatgccaagagatcccttctaatcttatttactacacaatggagtgatcctaaaacatc

SEQ ID NO: 18811 - DNA, 511 bp, Diabrotica virgifera
cgcgaattcccggattcgacccattcgaccgcacgacccacgtgactgtatcattccatgatgttccatcatttaccatttaatagtggacactgatatccccgctggaggactatgtgtcgttagatttatatataatgttatctcctcattctcatcatcatataaagcatgcgcgcatgaaccaattcacgtagacgtatgtgtacccgtcggtctgatcgcatactccctactgaacatgatcgccaagggagatgacgtccgccccaacccaaccttatgcctccgcctttagtatatcccacccatgatgggcgagctaaaggcagccgcatcgcctttcctcgattgcgcccttccacttttaggagaattcattccagctgctgatccaactgttcatctaaggacgtttcagctgccttccttgtaagatgcatgaccagaaaacaaagcatgtaacgtcatcatttacatcgactgccatacgccaactatcttcacagta

SEQ ID NO: 18812 - DNA, 156 bp, Diabrotica virgifera
ttacacgatagatcaatattctgaagggacgtattgggtgctactattggcgcatggagcgtcgcgaatttggaatgatggatacggaatgtgctaccatacatataccctgctgatatggtcgtgtcgaagttgacgagtggtgagcgtccgaga

SEQ ID NO: 18813 - DNA, 733 bp, Diabrotica virgifera
  misc_feature (85)..(111): n is a, c, g, or t
  misc_feature (120)..(137): n is a, c, g, or t
  misc_feature (663)..(663): n is a, c, g, or t
ctcctgaaataatttattcaactaaaaataagctgtaacatttttattttaacaataacagcatttttcaaagatgttatgtagnnnnnnnnnnnnnnnnnnnnnnnnnnngattaacannnnnnnnnnnnnnnnnnctttggtaattgctttccttctgaatctggtttctttgttacgtgtaccttttcattaactttgtctattttttcatgttcttctttaactctttgtcgtaattcatccccccatcctaatttttcagcaaatagtagacatccctcgtcacaatctcccaaccaacaaacatcccttgtattatctttggaatcaaaatttaagcctcctcccattccaagcatagtcatgatgcttgatcggtgtcctgctttttctctgtttattaaaatccgcggtacatgatcttcaaccctatccactaaggaagcaaacggttgtactgccaatgaagttcctataattattagtaaatcacattttgagtagtctgtctttaaaccattatagaatttagttggtaatacctcaccaaagaatattatatctggttttacaactccagaacatttttcgcatgatggaatttcatctttaaaaatgatttctttcatccagtcttgactatactcttctctgcacttncaacaatgccctctatgaaaggtgccatgagcttcaacaatttatcttcatgtattcctgcaaccctttc

SEQ ID NO: 18814 - DNA, 498 bp, Diabrotica virgifera
  misc_feature (24)..(24): n is a, c, g, or t
  misc_feature (26)..(26): n is a, c, g, or t
cccacgcgtccgcgttggacttgnanaaattgccctcttggctggactctgtcacggtatcaatttggttgacttgcaaaagcaagcagttacaagctgtcgtctctactcgcggtgggatacaactggggcgtcggctcgcgacatcctctgcagcttagacggttttgttgtcttgaagggggctaatgtaattggtgtgataagtacggaagatgttgtgggagatggacgaagcagaatcagaattatacgaagagggcataggaactgctgaattcatacggcacccctccgataatgatgtaaggaaacttaacgggaacttgttgattctttagaaaagttcaaggtaaattatagggtcattgggaagagtttcagtgtcggcaagagtatggctagtgattacataggacatctggagttctgaagctaatgaagtatgtgaatgatggtctggtagggaaaggtgtggaaggttccaggattgtactg

SEQ ID NO: 18815 - DNA, 831 bp, Diabrotica virgifera
  misc_feature (6)..(29): n is a, c, g, or t
  misc_feature (522)..(536): n is a, c, g, or t
  misc_feature (690)..(707): n is a, c, g, or t
agtacnnnnnnnnnnnnnnnnnnnnnnnntaacaaataaggagcagttaactttaattatattcacacattgtcttatacagcagaactatgactaatttcctcctaaagtatatcctctaccccaattaccaccaccaagaagggttccattacatcagtacaggctatctatgtacctgctgatgacttgacagatcctgccccagccaccacattcgctcacttggacgccaccactgtattgtcccgtgccattgctgaattgggtatctacccagctgtagatcctttggattccacctcacgtatcatggaccccaacattattggagccgaacattacaaagttgctcgtgatgtacaaaagatcttgcaagattataaatcactacaggatattattgctatcttgggtatggatgaattgtctgaagatgacaaacttactgtatctcgtgctagaaagatccaacgtttcctttcacaacctttccaagttgctgaagtcttcactggtcannnnnnnnnnnnnnntcctcttgaagaaaccattaagggattccaaaagattcttgctggtgaattagatcacttaccagaagtcgccttctacatggtaggacccattgaagaggttgtccaaaaggcagaaaaattagctgaatctacataaatgctaggataactnnnnnnnnnnnnnnnnnngtgattccatcaatctgcagagagaaagatgtttctttttattaagatcatgtaaagaacttttcattacactaccagatttttttatatcgaaaatttttgtttattagccctaatttcatct

SEQ ID NO: 18816 - DNA, 670 bp, Diabrotica virgifera
cagaacgcggactaagttgttcttgggagatacgcatcgcttccacgaaccacgtgtgccatctgggggagatgcgggtgtgttacaggtgtcagttgcttttggagagaacttccctagggtgtgggagatccaggccttagaagatgttttcatcgtactgatccggagaccctaatggttcttcctgagaccgcagactttggttatgttgctcgttgtgtacctactgaaatcatctgcttttgagtctctgaagagaggttgtgatgagggatcacacattgtaggcctttgaggtctcgtgcgcgattactaccctgttataggaaactggtcaggcaactggcaactgcgacacgcgatgcagagctggcattgactgagtcacgatgaagttgtattgggaacacctggtgctttgggagagaccagtcccaccggtgacaatacgcctcattgtgatgtaccctggagaaattctccccacacaaatagaaaatgaccgtttctgtgtttatatatttgtgttttttgtagctgcacgtcttcaagattattgatgtagattataacgtactatccatgaaatgctgttgtgatctagagtatcgatgatgaccgtctgatggaccatctgtatttctaatccagaggtgattactggact

SEQ ID NO: 18817 - DNA, 249 bp, Diabrotica virgifera
  misc_feature (57)..(94): n is a, c, g, or t
  misc_feature (114)..(127): n is a, c, g, or t
  misc_feature (130)..(152): n is a, c, g, or t
  misc_feature (160)..(182): n is a, c, g, or t
  misc_feature (212)..(243): n is a, c, g, or t
ggtaacaaaatatagacgccggaacagttgcgaataaattaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 18818 - DNA, 478 bp, Diabrotica virgifera
tgcacgtcaaaaactctgatccctgcgagaacaagcggtaaatgattggtcatctagatgccagccgatataagaataaccaaagatgaaaacgtgtcgtattgtactacaagcaaataaaacgccccacggcttgccttattgatcaagcctcaactggccatgaagacatcgaccggagacgggactacatccactgcgacactcctaaggtgaactattaaaacaggaagatatttacctacctagaaggtctcgcccctagatcgttaatttatggctatgataaggctattacaaaagcgctggaagtactggagaaactgaagatatcaattgaagcgtacaaagaagatttaacagatatttgatggacgagtttgaaaacaaagctgcatcaaaaactggttgatgttttgacagatgctttgagtggatgtcgttctagctataaagagagatgccaaacctgttgaac

SEQ ID NO: 18819 - DNA, 399 bp, Diabrotica virgifera
cgaggcccgggggccccctctttcgccgctatataagatgttgcatgttataactcatgggttgtgttttatcagtatagagttcttaggggtggtgtagatatacagcacttagaaaggaagacagtgtttatggcctattatagggaacggatgaatcatcaagctacaagatgagaccgcactcccgactacaaggacagaaggaccttacttgatctccgtcatgaaagtcctgaaataccggtctaggatctagtgaggagctagcctgtgatcaaggcatcgcatgactaacaaacgtctgaacgttcgattgggattgacaggaggcgttacatgcttcacgtttttttagttgaaaccttctccgtcatctttcgagtcaatggtgaacat

SEQ ID NO: 18820 - DNA, 774 bp, Diabrotica virgifera
  misc_feature (723)..(723): n is a, c, g, or t
ataatttttgtgtacttaggatgttaaaaaaatgtctgatataggtatatattgtttatagtttgttaaaataactcagaagataagtaatttttatatcgttattatcagcgttgtaggactcttttaagttttgcatatagaagtctctattgaataaaatgatttgggtcatttcatttttcttcgcaaatgtgtcagtttttgacttttcactaggttcatcggcagctagtttacgacgcctgtctataagttttacttccatttaccttggaggaaagtatcctgttctgatcatttttttgtttttcatcgtataattttgagccaggtgaaatatttcttgtctgtaacaagctcgatcgttttattaaagatctcaagagtcctgtctccttgataaaagcgacctatgtccttatggggagcttcaggatttttcctggattacttgtattgtcggtgtataccttcctttcctttgtttgatatggtccagtcattatttacgagaccttgttcaaatgtcctctgccaaggtccattagactaactgaaagcttcctgttaaagttgttaaagattgtctttatatggatttgttcgataaaactctttatttgttacgatacgaatttgtttgagtttttccaacttttcccactgacactgttttgcattatttatgacattgtattattccttacatcatctactatncatcctgatttggtcatttgtgagaatatgcctcctctacttatttccctc

SEQ ID NO: 18821 - DNA, 1030 bp, Diabrotica virgifera
  misc_feature (363)..(417): n is a, c, g, or t
  misc_feature (483)..(505): n is a, c, g, or t
  misc_feature (634)..(656): n is a, c, g, or t
  misc_feature (865)..(882): n is a, c, g, or t
  misc_feature (936)..(989): n is a, c, g, or t
gaagtagaagatttaattttacaattattcgactttgttaacgaaaagaatgaattatttaggaagcaaacggaattaatgtatttgagaaggcagcaacgtttagaggaagagcatgcagatgtagaatatcaaattcggtgtctcatgatgcagcccgaagccaataaaactgattccgataaagcacgtgaagaagaattaattaaaaggttagtcgacttagtagaaagacgaaatgaaatagtagaatgtcttgaaatggatcgggtgcgtgaagcagaggaagatgacagcataagtaaccacctcagttcatttactctaagtagggagactgacaagtctcaaacggaaccatcnnnnnnnnnnnnnnnnnnnnnnnnnnnnnnnnnnnnnnnnnnnnnnnnnnnnnnncataaggataaatccaaactagacgtagacaaggatgtagataccagtgaaaattttagcaccctnnnnnnnnnnnnnnnnnnnnnnnttagtttattttgagaagtcttaattacttaattttgttagacttgttattcttaaatatatatattgtcgatttgtatattatttaaacagttactataaaatatcaatttgttttgttcgtttgtcnnnnnnnnnnnnnnnnnnnnnnngtgtttgttcttttgtcttaatttttgtaagtaaaaaacttttcaagagaattatttgtgtagatcacattttaagccttgattacctctaaataaatgaacttctaataaataaaactaaataatccattttgcaaattcatgataataggttgtgtaagaattggttgcccttagtttatttccggttgtgggaaagctgggctgtnnnnnnnnnnnnnnnnnntaagaaatattttttttggacttttcgtatgggatttttttcggtggcttaaannnnnnnnnnnnnnnnnnnnnnnnnnnnnnnnnnnnnnnnnnnnnnnnnnnnnngcctcaagagggtccccagccttaacggacccgcggggcat

SEQ ID NO: 18822 - DNA, 389 bp, Diabrotica virgifera
  misc_feature (6)..(28): n is a, c, g, or t
  misc_feature (219)..(292): n is a, c, g, or t
  misc_feature (297)..(362): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtctagttctagatcgcga

SEQ ID NO: 18823 - DNA, 676 bp, Diabrotica virgifera
  misc_feature (40)..(59): n is a, c, g, or t
  misc_feature (508)..(523): n is a, c, g, or t
catcgttcgcttgatgtgagagatgagctactggaaatannnnnnnnnnnnnnnnnnnntggcaatatccaccgactcgcccattagatgctcgtatacaatgagaagtccgacgaggaacatggctcccatatttcacttccagctgttatccaggatcccagcaaacccgatgcatgcaatgtcggtctgcaacatgattctatgaaccatcgtccacgctacttcgacagaagtgcagatgagcatcaaacatctgcgtgtgcatggcgtacatgcattggatggagatcgaatacacccagtgaaatgaagaggtaactctcgatcgggactgataagacttttgttgatatgaaccgaagagggattgaccccacgaaccaggacatgctggccctagaacgaatcagaaatcaccaaacagctacgagacgctacatgaaccgcttatcattgtattgtggtggcagacctatgaacgacttagaggattggcatcaatctnnnnnnnnnnnnnnnntagatgtgcattgacatgggatgagagagataaaaaataattagggtatgaatggcgagatgatcattcaggtacgattttaaatgaagaggcataacaaaatactttggctccagatgagagagggcgatacagacggataagaggactatc

SEQ ID NO: 18824 - DNA, 207 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(131): n is a, c, g, or t
  misc_feature (154)..(154): n is a, c, g, or t
  misc_feature (178)..(178): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagttaaaccggtgtgagccaggntggtttctatcttttaattattantatattttagtacgaaagggaccaatata

SEQ ID NO: 18825 - DNA, 538 bp, Diabrotica virgifera
  misc_feature (425)..(425): n is a, c, g, or t
  misc_feature (498)..(498): n is a, c, g, or t
  misc_feature (525)..(525): n is a, c, g, or t
gggatcataatgacatgggccattttccacctgttcgggaatatcttatatctgagtatcgcgttcactatgtttgtgaagtatactatagcttttctgggcaaatactttagggctctgtttgttatttcgtctggaccaggcgcttttctcggtgaactcttacggattcgtaacggtgttcgttgatttcttccggtgatgttgggggaatgatgtcctctgggtcttctggtccttcttcttgttcttcgacctcttccaggaagtcgtcgtcttcgtcttgatggtagtttaggtcgcattctctttcgagtgtagccctcattgcctctactttatcctctatggtgtataccatgccgtatcttccatgtaatggggggatgggttttctatcgcttctcaacattttttggagcttnccaacgttttttatggttgagtctagttcttccatctcttgtacgaagttgtcccattttctgctgcggtggnagtgtagggtcgttttgacctctctgnttatgtatttgcc

SEQ ID NO: 18826 - DNA, 484 bp, Diabrotica virgifera
  misc_feature (72)..(92): n is a, c, g, or t
ttgcgtgcggtgagcagggatcaaccagaaaagactacatgggtgacgacgatgttggggctcttgttattnnnnnnnnnnnnnnnnnnnnngcaaggtggattcgacggagatgacgcaccccgtgccggcttcccctctatctgcggtcggacaagggattacggcgtaatggttgggatgggaccaaaagactcgtacgtaagagatggaacccgaaagcaaagaagtctcctcacatttaagtataccattgtagaccggagtgtcaccgacatgggaggatatggaaaaaatatggcatcacaccttcgacgatgaaatccctgtagctcccgaagataacgcagaacctcctcaatgaaggtccactctgcccccaggaaatcaggagaaaggaagacccaaatcctgtttgaaagcttcatctcgcgcgcccggtgtgtaggcattcaggccggactatcgttgtacgtttctggac

SEQ ID NO: 18827 - DNA, 527 bp, Diabrotica virgifera
  misc_feature (82)..(82): n is a, c, g, or t
  misc_feature (167)..(167): n is a, c, g, or t
  misc_feature (182)..(182): n is a, c, g, or t
  misc_feature (273)..(273): n is a, c, g, or t
tcatgcgggcgcagagacgaaaaaccgaagccaggaggagaactttttcagacagcggcaaagacgggaacaaggaaaaacncccgagcacacacccgaaaccagaagcgggcacgaactttacgaaacgacgacagcgggcaacagaccgcacacgacgccgccancagcgacaggagcgncgcccgaaggaagaaccgcggaccacgaaagagaagcaaagaacgggcaggcaaagggagaccaaagagaaacaccacccgggacccaaanccaagacggacgaaccgggagaagcacagcccgaacacgagggaagaaacagagagacggagaaaaccgacagaacattcgttatttgtatctattttcttaattatttaaaatgaagcaagaagcgtccaaaaggaatcctgcaatgttagaattgaatggtaccggcgaaggttaacataactatttttgtggaaacgatttttttaatccttctcttggaatcaaaaacacggacccccgatatccaactc

SEQ ID NO: 18828 - DNA, 575 bp, Diabrotica virgifera
  misc_feature (246)..(258): n is a, c, g, or t
  misc_feature (261)..(273): n is a, c, g, or t
  misc_feature (329)..(349): n is a, c, g, or t
  misc_feature (414)..(429): n is a, c, g, or t
  misc_feature (544)..(572): n is a, c, g, or t
accatttagacaaccttatagttcataatatatttatgaatttcgataccaaacaatggggcgtagaagcaacttttccgtcgttaggaattgagagtgattacaaaatgaacggaaaattacttgtctttgaattaaacggcgaaggaaagactcgaggaaatatgactaacatcagggcaaatctaactgttttcttcgactatataacagtgaacggcaaagaacatcttcagattaaagacnnnnnnnnnnnnntgnnnnnnnnnnnnngtagttttgtattcgatgatctatttccgggcaatgaagaacttactgaacgtgcnnnnnnnnnnnnnnnnnnnnnttacagagtgcttttagacgaatttactccagtctttgaaaaactgttatcttctctttgcgttnnnnnnnnnnnnnnnntttacaaaaaatatccatccgaggtattatttccaacgaaagtttaaccaaaataagtttagaatattgtgaataaactaaatcagttttgtacgagtgaatcaataaaatgttnnnnnnnnnnnnnnnnnnnnnnnnnnnnngtt

SEQ ID NO: 18829 - DNA, 926 bp, Diabrotica virgifera
  misc_feature (601)..(622): n is a, c, g, or t
caaccagaggtcacgtggtgtggattgccttatacaacaaatcagtttataaacaacgtttgtattaattaacaatgatagtgagataaattgcaggactgatattaaatttatgatttgcagaatcgctgaaatgccaatcactgacatttgtgtgtaaaatccacaaactacttagtatttttaaaatggatctatattatctctgtgtggtccctgttaatcaatctcaattctctatataccgttgtaggtaataattttcaggatatgatttgttaattaggtattcattgtatgctattaaccgattgtcgagctattatggcctcagatttcagtaagggtgttccaattaagtccgaagatcataatgatgaattaattgtgaataggtccaatatcaaacaagaaagaaataaatcagaatatgtaaacaatcgaaattattctagaattcagatcaaggaagaattgacagacgaagaaagtcattatagtgatatagaccattgtgttgatagtaatacgtatttgaaaaaagaattaaacacaaaagtagatattgatgacataaaatgtgaaaaaaatgaatttgatnnnnnnnnnnnnnnnnnnnnnnacgaaaacaattttggtgaatttgagaaggcaacgatacctccagtacagcagtcaggactcccaaccagagaggaagatataaataaaatcatagaatatctagatagtaaaaagaaaaatcagcaggatggaatcgattttttgtttttgagttatgccgagacattcaaaaaattatcaccaagatcacaaatacatttaaagctaaaactggcaaaattgtttgcgaacgctgaatttacattactagaacaaaactggcagttcctaatcgactcttcatagtagcaacactgtcatat

SEQ ID NO: 18830 - DNA, 576 bp, Diabrotica virgifera
  misc_feature (2)..(25): n is a, c, g, or t
  misc_feature (27)..(158): n is a, c, g, or t
  misc_feature (174)..(243): n is a, c, g, or t
  misc_feature (247)..(340): n is a, c, g, or t
  misc_feature (446)..(467): n is a, c, g, or t
  misc_feature (474)..(496): n is a, c, g, or t
  misc_feature (558)..(575): n is a, c, g, or t
gnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccctataggaggnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaggggaaaacccggaatttttttttggggaagtcccaaactccaaataaaaagaatgggcaccccccaggggggggatttaaagttttaatatgtggggaacnnnnnnnnnnnnnnnnnnnnnngttttcnnnnnnnnnnnnnnnnnnnnnnncgttgttccttggggtttaaaccccggggggggcggcccaacgggggggggtgcttttcctnnnnnnnnnnnnnnnnnnc

SEQ ID NO: 18831 - DNA, 995 bp, Diabrotica virgifera
  misc_feature (73)..(87): n is a, c, g, or t
  misc_feature (890)..(890): n is a, c, g, or t
  misc_feature (896)..(897): n is a, c, g, or t
  misc_feature (920)..(920): n is a, c, g, or t
caaactgattatgttaacggcactacgcaggaagttgaaccggctgaaattactatacaaacaacaactcaannnnnnnnnnnnnnnccagaagacaattacttcaacaaagatcgaactttgtacttaattagtttatataagatattttctcctaaagtaactatgggtgaaatgaaaaccaaacgggaaatgtgggatgcaatagctaaacaaatgtcagaacactatactataacaattacaagcgctaaatgcgaaaatcgttttaaagttctagaaagaaatttcagacagttagaaatacataacaaacaacctgataatcttcctaaaacatacgaatatgaggcagaacttagagaaattttcggggacagatttaaaaaccaagtgaaagaaaagattgttgaaaaaccggagccaactacatctgctgagacaatagacataaatcaacaaccgtatactatacgattacttgaaacacaatcaatacccatagagttacagacaccagacaaacttgagcgaattttattaggtataagaagtgaccttcagtactatcagaatgaaaggttgaaagtggagtggaggaaattagcagttgaagaagagaaattaaaacttgacaaaagaaagttaaaattactcgaagatcaaagaagagaaaactcttaatattaatagagtaaagtggtttttggtttctattttaatatatacgcaattactaccacaaatataaatacatataatcttttgcgcgtactataaattattattttccagtatttattgagggtagctaaaattgtagtaaatcctcaccctaataccttccacatatctgaattaaatagtacagattattttatatccacaancttcanngaaataaacaaaatttaactgtngtgagaactttcacataatagtacattctttcacagtttttgctctaaatttaaaagaccgctttggatgacatg

SEQ ID NO: 18832 - DNA, 747 bp, Diabrotica virgifera
  misc_feature (438)..(461): n is a, c, g, or t
cccgcgcgaccggcgagaacatacttagagtgaagataaattattggttctaaaacttaacatgacgcctgaactcctagtgaagaaaagcggaaaatacttctaaacatcgtcatcacatgaccatctatgatggatcatggatgaatgctccagacgatacaggacatgcaaacacgcgcgtccatgacgatagataggtgctagaatccctgacgcgcaaaaagtcaatatgccgaggacaatgaatcacttgcacgcaagaaccatatgtgccgccgacatgactggagaaaccgctgatcaggaaggaacaaaacgttacgcccaatagggagacacctacagaattactgcccacacacatccccacactgcaaccttgcggagatacgtgttcgtaccaattaccactactgaacatatagcccaaaatgnnnnnnnnnnnnnnnnnnnnnnnnaagcaaacaaattcgaccacactacagacatgacaaggcctgcacaaacattgggaggtggactcaccgctgatgcgccagaagatgacgtcgaaaactatctctcacaagaagcatcgaccgttgacatggagatggcagctcccccacaagagaaccaacagatgggattcggcttattgacatcactaatccgaacgcatgtatccatgacatgactacggcaactcacagatatgatataggacatagacgacaatgaactgatacacacgcccaaaccaca

SEQ ID NO: 18833 - DNA, 1009 bp, Diabrotica virgifera
  misc_feature (242)..(263): n is a, c, g, or t
  misc_feature (916)..(933): n is a, c, g, or t
  misc_feature (979)..(1001): n is a, c, g, or t
gcatagtttgtttgttttatttactgttagccaatcaaaacctacagttcatgtatattgtatttagttttgttgtttttatataccttgattaaaactggatagatacgtaaatacataaaaaataacagaagtaaaattgactgcgtttatatgtcgaatatatagggtgacccaatacgtattttggattgaaaacctgtgaaaaaagataaaatgctcggatatatcttttcccgatnnnnnnnnnnnnnnnnnnnnnnctgagacagtcatgcatctgccttttcactttaaacgttcctgctgagatgatattttgtccagcagattcgttattcatttacttattattgtgaagggtttattaactattctatttcccgaattgacagttctgacgtatttcagtcattttctgctctgctgttgcctgcatatttttatttaagtttttgttgttaatgtttaaatttaacagctgatcaaagtattctaccttcttatctattttctaactttatagctttttcagtttttattgctccttcgatgattctaaaaagaggtatgtttctcctcccctatgttatattccacccaacttctagtaataatattttatgatgacgttgaaaaacaaatgatttttcattgaatttgtttcactgcctttgttttttcttcacatatttgcttagctcttctattgatatcttcgttttgtcaaaaggcatttattgattgtctatcattcttcaccatacgtccccttccatgtcattcatcgcgctctatttatactacctgctttataatgcctggttctcaatatagttgctataaaaatgtaataaacgatcataagataggggaactttggcacattatttttattatcttaataatgttcagnnnnnnnnnnnnnnnnnngatttttccaaaataatccagggcctcaaaaaacttctaattaacnnnnnnnnnnnnnnnnnnnnnnncctttttg

SEQ ID NO: 18834 - DNA, 563 bp, Diabrotica virgifera
  misc_feature (10)..(82): n is a, c, g, or t
  misc_feature (88)..(110): n is a, c, g, or t
  misc_feature (301)..(374): n is a, c, g, or t
  misc_feature (379)..(444): n is a, c, g, or t
  misc_feature (462)..(480): n is a, c, g, or t
  misc_feature (489)..(503): n is a, c, g, or t
  misc_feature (505)..(521): n is a, c, g, or t
  misc_feature (524)..(542): n is a, c, g, or t
tttcgtccgnnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagctttcaat

SEQ ID NO: 18835 - DNA, 677 bp, Diabrotica virgifera
  misc_feature (55)..(83): n is a, c, g, or t
  misc_feature (239)..(257): n is a, c, g, or t
gcgcggtctgttaacagacgattacaagtactctaccatattcttttgagaagannnnnnnnnnnnnnnnnnnnnnnnnnnnncgctgatcccgatgcctttatgaaagatttcctcgctagaggaatttccgccgctattgcaaatagatgagtaaatcgaattctaccgcgaaagggtgcatgtggatgatacaacacatatgacagcaaatagcggatggtcaagagcacaacagnnnnnnnnnnnnnnnnnnncataacactcagcacgagcagtggtcgtgcatagaggtcttaaaattcagctgaagcaatcgtgtataggctagcaatacgtacaatgtaaccggcaataatggtaaaccagtaacaggatcggcggatgctgccgaccgaagaatatgagagcgacagtgtaattacccgagaggaagacgtgaacgtcgaggaactagcacgaggtgtagatccgcctaggaaaattgaaagcgaattaaaggacggagtactatcaggtgactatggaggacaatgagtacaaggacgcgcacgtcgatatgcaccaagacgcgagacgtgtaggatattcgtattacaggtgaccctatcgcggaacgccaagagaattagaacaaaatggagatggtccccgtggtcatcgagccccacgagaac

SEQ ID NO: 18836 - DNA, 56 bp, Diabrotica virgifera
gtaaggagaagggggaaaaggggggggagagggggggagagtacaggggcggggaa

SEQ ID NO: 18837 - DNA, 404 bp, Diabrotica virgifera
  misc_feature (7)..(39): n is a, c, g, or t
ttaaggnnnnnnnnnnnnnnnnnnnnnnnnnnnnnnnnnccctttaatattgagatagaatattatttgcatttgtgcttttataaaaaaataaggaaaaacaatacggtttaactctcaaaaaaggttatgggaggtgttacattcttcttcggaacggtaaataatgggggaatttcctattccttttaccccttgaaggggagtaaagatgttgacagaaattccgaaaattgaattgtgggaggcaggagggagatggcagatggcattgggaaggtcgggtagctgtgctttttttgcgtgattcttattttttgatagatattagaagacagtagggaatttgaatatatgaaggcgagagaatttgtttcactgatgaccaatggtagggagaattt

SEQ ID NO: 18838 - DNA, 372 bp, Diabrotica virgifera
gaaagaagctccgccgcgcgcgtgaccaactgaccaactccatacactacgacataatgagagtgtccaccgctcgcccattagatgagcgcataaaatgagaatggcaaggaactaaagggcacaaccatttcacttccaaaatttgtctgggttccaatcagagccgatgtagtcaatttcgagcaccagccgctgattgtatgaatcatcggcaaccccacagcgttcagtgatagatgactgacatctgatatcagcaagaatcatgggagatacggcagggcttctgggcaaatcgcctggaaacaataggaggtcttggtagcctagagccccgaacgattcgtggacctggcgacatcttggcat

SEQ ID NO: 18839 - DNA, 295 bp, Diabrotica virgifera
tactagccctgtagcgccgcatttggcacgttgggtgtgatgacatactcgacgttgtgaccgatacgcttggcagctacatagatccttgtccttgcacttgcttcccttatttaatctactctaggccatagtgtccctttgaaaatatatcttgactactccttatacgaatcctatttaggggatgacctacctcattaccaaaggaaaaaaatggagggcgcaccgcgaacatgaatggaccacgtttcgacacatcaatctttaaaacctttcatgctagcatttaaca

SEQ ID NO: 18840 - DNA, 1010 bp, Diabrotica virgifera
  misc_feature (894)..(894): n is a, c, g, or t
  misc_feature (958)..(958): n is a, c, g, or t
caaccagcacgatctcaaggatttagtacgggtagaaacgtggtccaaggaaactctagtgtgacgaatttactccaaggtgggattaaaacgatatgcccatccccaactccttcaaatttagggataaaagtattagaaaacgtcacactcaactgtactggtggaaaactgtatccgaataggactatcgatttatcaaagttaactctactaaattcgacgaaatcggctaatacatcagttagtaatgttctacttttgccagatggtaaaataaaaacaatagggaatactatcaaaggaactggtggtactcctatattagtaacttctacaaaatcggtatctagacaaactacaaatcccggacaaaaatatataacatccaaaaagcaattaattgctcagaagcctcctacacctataaaaaaatctgcttacaaatacgcttcgaacacagaaccttccatacccacctccaacttgacgactcaagacatcatggatttacctataatatttgcggatgataatcagattattaattcaaatagttctactactccgcatatttcagctaacacgttaaatagtgtctcaagcgctgctgcaacttcagtatcttcagtgcccttagttagtcaggtgacaaagtcaggggcgcctatgacaaaatatatgttgctgaataaaaacactttgggccaatcgaacttcatacttacacctaacgttaagaaaactgttccaattacacatttcaataaacctgtgccaaagtatacgagaatactcttatcatcaaagaaaaccagcttgaatgaagagaaaacagcccccaaggttcagactaaaccaccagaaataacgtttaaaaatgtcactcctggngcattagaaaagcaacaactatatcgaggatggacgtagatgacatagaaaaccttattgcagncttcacgttgcataaaccgatgtcagctattgccgatgctaaaaatataaaa

SEQ ID NO: 18841 - DNA, 651 bp, Diabrotica virgifera
  misc_feature (28)..(28): n is a, c, g, or t
  misc_feature (66)..(66): n is a, c, g, or t
  misc_feature (68)..(68): n is a, c, g, or t
  misc_feature (70)..(71): n is a, c, g, or t
  misc_feature (75)..(75): n is a, c, g, or t
atttaagggcggaataaattagaacggncttctttttgttgtcttaaaggggactcccccttaccnancnnatcnaaccgggaaagagagcggggcggaaaaaggggaaaaggtctctaaaaaagtgctggaggagtatagggtatggagagggggagaacatccgggttgataagggtctggaattcgaggggtaagaaaaacaagggttggagaatgtggggtgttaggataggggagaagatggaggggagggagaattagattgtatgcaggggggggaggagtagaaggggtaggaataggaagaagaggaggtagaattttaatcaggaataagaattggggaagatggattcaatttgggggggaggggggatagctattatgtagaaatactcatgatggacggattgggtgtatatgtgagtggttttgtcacagggtaaagtaaaaagagtaagatagccaatagatgggtgaatactcatagggaattggtggaagataaattttcgttggggggagatgaggggactttagataggagtgagaataggagtttaaccatggagagggggaatatttttagttttgtgggggagtggaagaatttgttgggaggggaggttagtggaattagaacttatt

SEQ ID NO: 18842 - DNA, 1079 bp, Diabrotica virgifera
  misc_feature (847)..(875): n is a, c, g, or t
  misc_feature (1053)..(1077): n is a, c, g, or t
attaaaattgtttaaaaaaagtataaacagaattataattaaacactaagtttattagctaggtttattagtaaactacatctgtcataacagttaacatttcattggattttaattggattagagttgcagtaacagtttgttgcgtatgattttgggtttacgtcataaaagtatttctatccatcaaatgtctccatcggttaaggagaacacgatgaaaaacctatgtggtatctagatactatttcaccatgcccccatcactccctcatctgctctctatcgtaagtgctcttctgcaacattgtgctccattttaacatacaacattctcaatgcgttcttccactacctttcgaatctctttttttatcgccgtagcaatcaaaacattcacaaagttccaatctttctcgctaaacagcgtcagttcaactagcacatgcactcagcgatcctcttacccaaggccttatactgccgtctttctttcatgaatctcatgtataggaaaactaagtacgttccatagtatcaccatattatgccctttagcaattttcaaacgtgccacgttccttcatgccaaagcgaatcaggtgataaaaagaaaatctcccgtgaatacctgagttgatagtagttatctccttgcattcacagtcgactcacattagattagtaacatgttagtctagcctgtcgtttgtacacaatataataaaatgtgattgatcatatattaacaaaaaggccttttggaataaagacacttacttttttaatatcaatttatttgttatagtaaaataacccttgatttattggttgcccttgtttatgnnnnnnnnnnnnnnnnnnnnnnnnnnnnngccgagtgtaaatttagtcatgatttaaaaatgtcttgtataatggcgttaaaaaataatgcagagaaataaaaatatgcattttgcgatttaaatgcctttcctgtattaaagttaaaatggaaaatttaaaaaaggaatgttttccttgtttattataatataccccaaaacctannnnnnnnnnnnnnnnnnnnnnnnntc

SEQ ID NO: 18843 - DNA, 538 bp, Diabrotica virgifera
  misc_feature (376)..(395): n is a, c, g, or t
cttcgtccgaatatcacaaactaaagcgcaatgtaaatgtaacctagtgggtgttggctatgactaaaaaaccgaacaccggtctttggaataaccgattttttgaccggttataaccgccaggataaaccgtaggtaaaataaaccggtataaccgaaaaccggtgttttggcaacaaccgccatccctaggaaacagtgcaacagatgaaggaaaggcaggagaccgaaaggcgtggaagaaatgggtaaaaaatgggctaggtgacaccaaagtcggacgcccttatatggcataaggacgaggagaagaacaagtatataacttcaacgataattttggatttgactaatttgttggttggatgccggtaannnnnnnnnnnnnnnnnnnncaaaatttcacccaattacctaataaattaggtgctattagtgacatccagtaccttaattgaatcaagctgcagatggatatcaacacgttaactgtgttagatattgtgtttctttgtgtaagatatcaacatatcgacct

SEQ ID NO: 18844 - DNA, 219 bp, Diabrotica virgifera
cccccccccttctcggccgcagaccagccgcacaaggggtgacgtgggaccccttatgaaggctaggtatatcgtgatactctattcgagtgccgtgcatgaagcccttataaaatgcctaggaaaatctatggaaggttaagtacgccgaggaactcctaataggacttgagaactttaattcctgaaaatgcttagcggttggatggaaccatacaa

SEQ ID NO: 18845 - DNA, 922 bp, Diabrotica virgifera
  misc_feature (775)..(775): n is a, c, g, or t
acaccattgattgaaaaaggagaccttgctgctgtgttcaaaacagctccacatatactggagggagaatgtaaaatgggtggtcaagaacatttttatttggagacccagtgctgtatagctgttccaaaatcggaagataatgaaatggaaatattttcttctacccaaaatcctactcaagtttcgaaactaataagtcaggtgcttggtgtcccccaaaacaaagttatagctaaagtaaaacgtctaggtggggcttttgggggaaagagccccaaagcaactctggttgctgtacccgtagcaatagcagccaagctgtttaatagacctgtcagatgtatgctgaatagagatgaagatatgatcacaactggaggaagacatccgtactattttaagtacaaagtagctttcaatgatgatggcaaaattttgggctgtgttgcggagctatattcgaatggaggttattcaagagatttatctgaatcggtaatggatagagcagtaacccattttgaaaacgcttatcacataccagcttgcaaagtaatcggaataccgtgcaagacaaatctgccatccaacacagcttttcgaggattcgggtgtcctcagggtatgtttttggccgagaatattgcccaacatatagccgactatctcagaatagatccagtggtggttagtgaacttaatatgtaccatgaaggtgatataacctactataatcaaaaattggagaattgtacattgcgacaatgttggnaaagaatgtatggagtcttccaattttcataagcgtagaagaaatattagggaattttatagattaaataagtacaaaaagcgaggtattagtatcatccccacaaagtatggcatttgctttacaggaacctacttaaaccaagct

SEQ ID NO: 18846 - DNA, 693 bp, Diabrotica virgifera
gcgagatctctaacacagatgttacttaactttttggctattgagacgaaaaccattgctaaaacatgatgaacaacaaaacactgccagcaacgccaaaaagacaagcttcggagagacgcccttgaagaataccatggagagaaatcttatagtactaacggaaaagcctacaccgaaccacccacatgctaacttaaataaaaggatcctgagccacttgtatcatagggaaagagcttatggattgcaacccagaaggatgggaaggaccctcgttctcgacatacttccaaacaccagatcgtcaacgaagacaactgcctctacatgagtatatacacgaaacagctgccatgccgtaacccgaacatgcatgagagacctcggatgcctgcatccatgtcgtccacaccatatatggctgcaccaaaggcatgaacgtgtcctccagatattaaatgactgctgatcttggatacgtgtgaatcaaccatagatggcgagtatgtggccgctgaaagcgagaagacccttcgttacctcgtacccggaaatgcacagactgatagatcagacgatgtcactaatatgtacaccaaaacacatggtgaatttggtcggtgagcctaacatcggaacaacatttgcggaaagcgctgtcatagcctcgaatactgtcttgactgtatc

SEQ ID NO: 18847 - DNA, 973 bp, Diabrotica virgifera
  misc_feature (212)..(231): n is a, c, g, or t
  misc_feature (296)..(328): n is a, c, g, or t
  misc_feature (468)..(487): n is a, c, g, or t
  misc_feature (552)..(580): n is a, c, g, or t
  misc_feature (839)..(857): n is a, c, g, or t
gtaatttgaaagaacatttaagagtgcacactgcttgaaaaaccttacaagtgtgtaatttgttttaagcaatttactcacgcaagcagtttgaaaagacatttgagagtacacactgaagaaagacctcacaggtgcgaaatttgtttaaagcgatttattcaagcaagtaatttgaaactacatttgagagtgcacactggggaaaaagnnnnnnnnnnnnnnnnnnnncttaagtttttttctcatgcaggttccttaaaaacagatttgagagtgcacgatggagaaaaatnnnnnnnnnnnnnnnnnnnnnnnnnnnnnnnnnttcaagcaagtgatttgaaaatacatttgaaagtgcacactgggaataaccttacaagtgtaaaatttgttttgaacaatttagtcaagtaaatcatttgaaaagacatttgagagtgcacactggagaaaaatctaagnnnnnnnnnnnnnnnnnnnnatagtttagtaaaacagttcatttgaaaactcatttagcagtgcacactagagataaatcttatnnnnnnnnnnnnnnnnnnnnnnnnnnnnnggtctgcgcatattagatcgaatcgatcgacaacggaatggactactacagcccggaagtaaatgcctaagcgcgcatttattggcaacacatcggcaaaatctcgccagctcagtcagtatacataattccgagaagatggataaaaaaactattattgttagtttgttattttgcttgaacttattagttcctaatgttgattatgcaatctgtaatttttttcaattttgcaatagattgtttttgttatatttcnnnnnnnnnnnnnnnnnnngacgatttatgtaatttgagtacatatatcgtagtttctactttttttttctgactcattttaagattgtctataaattgtataatgtttatgacataaagcatattccattcaac

SEQ ID NO: 18848 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18849 - DNA, 252 bp, Diabrotica virgifera
caccccccagagacaggaggagcacgggagacttttgagaaaaacagaacagcaggaaagacaccaggccacatcgagcgggaggaaaggcaacaacagacccaccttttggctaatatgcaccatttcccaaaaatcgctgcagttcctacagcaaaggactttacacatattatattgcacaagacgcaatggacgaccacctaccgcattccactagcaatatcaaatcactagaatattggtttttta

SEQ ID NO: 18850 - DNA, 1241 bp, Diabrotica virgifera
  misc_feature (14)..(14): n is a, c, g, or t
  misc_feature (17)..(17): n is a, c, g, or t
  misc_feature (22)..(23): n is a, c, g, or t
  misc_feature (27)..(27): n is a, c, g, or t
  misc_feature (29)..(29): n is a, c, g, or t
  misc_feature (38)..(38): n is a, c, g, or t
  misc_feature (51)..(51): n is a, c, g, or t
  misc_feature (63)..(63): n is a, c, g, or t
  misc_feature (65)..(65): n is a, c, g, or t
  misc_feature (67)..(67): n is a, c, g, or t
  misc_feature (82)..(82): n is a, c, g, or t
  misc_feature (86)..(86): n is a, c, g, or t
  misc_feature (94)..(94): n is a, c, g, or t
  misc_feature (96)..(96): n is a, c, g, or t
  misc_feature (192)..(193): n is a, c, g, or t
  misc_feature (199)..(199): n is a, c, g, or t
  misc_feature (207)..(207): n is a, c, g, or t
  misc_feature (227)..(227): n is a, c, g, or t
  misc_feature (235)..(235): n is a, c, g, or t
  misc_feature (238)..(238): n is a, c, g, or t
  misc_feature (245)..(245): n is a, c, g, or t
  misc_feature (255)..(255): n is a, c, g, or t
  misc_feature (264)..(264): n is a, c, g, or t
  misc_feature (272)..(272): n is a, c, g, or t
  misc_feature (296)..(296): n is a, c, g, or t
  misc_feature (338)..(340): n is a, c, g, or t
  misc_feature (350)..(351): n is a, c, g, or t
  misc_feature (363)..(365): n is a, c, g, or t
  misc_feature (385)..(385): n is a, c, g, or t
  misc_feature (390)..(391): n is a, c, g, or t
  misc_feature (393)..(393): n is a, c, g, or t
  misc_feature (400)..(401): n is a, c, g, or t
  misc_feature (422)..(422): n is a, c, g, or t
  misc_feature (429)..(429): n is a, c, g, or t
  misc_feature (432)..(432): n is a, c, g, or t
  misc_feature (437)..(437): n is a, c, g, or t
  misc_feature (444)..(444): n is a, c, g, or t
  misc_feature (446)..(447): n is a, c, g, or t
  misc_feature (449)..(449): n is a, c, g, or t
  misc_feature (451)..(451): n is a, c, g, or t
  misc_feature (471)..(471): n is a, c, g, or t
  misc_feature (476)..(479): n is a, c, g, or t
  misc_feature (495)..(496): n is a, c, g, or t
  misc_feature (506)..(506): n is a, c, g, or t
  misc_feature (508)..(508): n is a, c, g, or t
  misc_feature (510)..(510): n is a, c, g, or t
  misc_feature (520)..(520): n is a, c, g, or t
  misc_feature (529)..(530): n is a, c, g, or t
  misc_feature (616)..(616): n is a, c, g, or t
  misc_feature (618)..(618): n is a, c, g, or t
  misc_feature (643)..(643): n is a, c, g, or t
  misc_feature (650)..(650): n is a, c, g, or t
  misc_feature (653)..(653): n is a, c, g, or t
  misc_feature (655)..(655): n is a, c, g, or t
  misc_feature (658)..(658): n is a, c, g, or t
  misc_feature (664)..(664): n is a, c, g, or t
  misc_feature (674)..(674): n is a, c, g, or t
  misc_feature (682)..(682): n is a, c, g, or t
  misc_feature (771)..(793): n is a, c, g, or t
  misc_feature (851)..(873): n is a, c, g, or t
  misc_feature (968)..(1002): n is a, c, g, or t
  misc_feature (1037)..(1054): n is a, c, g, or t
  misc_feature (1077)..(1097): n is a, c, g, or t
  misc_feature (1101)..(1118): n is a, c, g, or t
  misc_feature (1127)..(1165): n is a, c, g, or t
  misc_feature (1183)..(1206): n is a, c, g, or t
tacaggcgcggaanagngaaannacananaaaggaagnaccctttgaagangaaggagaagangngngcagagcaaccaacncggnaggaaccncngagaccaaaggcaaacaaaccatcaaaccaagggccaaggccaccaacggcaagaaaaaagccgcagaagacaaacccccaagaagaggagaccanncgaaancagcagcngaagaagacggcaagccagnaacccaancgngccgcanaagaggagcnaacaaaggngacggagncgggcgacacaacaacaaagaaancaaaccacccaaagaggcccaagagaccaacgaagcaaacannnacaaaggaanncaggcagaaagnnnccccgaagaaacgggggcanacacnngngaagcanncaacgacgcaggagaaagcancagcagnggnacacnaaaggangnngnancaggggaacagcccaagagncccgnnnncaaaacagacccgaannccgccacggnancngaaggagaancagcaaccnncgaagcggagaccgaagacgaaccaccacagaaaaacggggggaaagaaggaaaagccacaaaagaaagcagcgccaaaaacaacncnaccgctgacggaaaacgctacacanaacaaanccngncgnggaaanccaacgaaangggacaanacccaagcaaagcaaagggaaagaagggagaaacattcgcggccttctcactcaacgtagtaccacctagtgaaatctagaaatacttnnnnnnnnnnnnnnnnnnnnnnnaataaacaaacgatttgctccaaaattggattggacgtatataaactaagaatatggnnnnnnnnnnnnnnnnnnnnnnngtgttttatatgaaatcttttggttgttaaattactccctttttggaaatttcatttacaatcgggaatcctttactttgtaaaattctaccccnnnnnnnnnnnnnnnnnnnnnnnnnnnnnnnnnnnccaaacaacttttctttggaaaacttcaaggggannnnnnnnnnnnnnnnnngcgcaaacaatttccttgtgggnnnnnnnnnnnnnnnnnnnnngttnnnnnnnnnnnnnnnnnnaggggaggnnnnnnnnnnnnnnnnnnnnnnnnnnnnnnnnnnnnnnngggtgttgtttatggaannnnnnnnnnnnnnnnnnnnnnnngggggaaagagagggtttagccccttttttttttt

SEQ ID NO: 18851 - DNA, 446 bp, Diabrotica virgifera
  misc_feature (364)..(382): n is a, c, g, or t
ttgcggccgaaattaacatagaatttgacgattattttaaaatttcaaggaatgtagagttgtaggttaaaataatcgtcaaattaacatagaatttgcaagaaacatgtacaatgggtatttaagatctgctgccgtttgatatagaattcccttagtgttaattttattgatttgattttgtaaactgtagatgaataattattgtagatgatagtttgaatgtatagattttattgtacctatgtaatttattatgagaggataaaacgatctatatgttgtatacaattgatttaagtaagtttggtacatgtattgtccaatgtagatcgtaaaatttggtgtaattttttatagcatnnnnnnnnnnnnnnnnnnnccaactgatactctattgctctattcaaattgtgcttttttgtctaagaaataaaatagttgtg

SEQ ID NO: 18852 - DNA, 768 bp, Diabrotica virgifera
  misc_feature (563)..(583): n is a, c, g, or t
  misc_feature (631)..(687): n is a, c, g, or t
gtgaatgttcatcgagagatttctgttacataaaaaaggtttccaggttataaaaaccttacgtgatatttcgatcctggttattatacaaggatataacagggatcaacatatcacgtattcaaatatctaagtatcacgtatcgcaatatcaccaatatcgaaatatcttcatcggagtcgaactttacatttaatcaggaagaattgcaaaatgcttgctttcaccagaactttgatgacagattggatataactatgaactatgtccgcagaagaataaaaagacaattaccaggtattctttaatactttcaactatagcttggaataaaaatcatgtttttcaaaatttgctatcattttgactacacgatgaatacgcttttgtatataacccttttttttcacaatactttattagctctgtaattagatgtaaatattatttatttcctttagtgctattgtattactctttttgttaaaaatctgatcaaatatttttaatctaattattgttacgttctaaccaaataccaccaataattgaagttaaagcnnnnnnnnnnnnnnnnnnnnncctaaatatgtttttgtatttgtaagagatattaaataaacgcaaagnnnnnnnnnnnnnnnnnnnnnnnnnnnnnnnnnnnnnnnnnnnnnnnnnnnnnnnnngagcttgaatgtaattgtgtagctgaccttgtttttttttatcaatctaacaaaaataataattatatctatctgtactct

SEQ ID NO: 18853 - DNA, 748 bp, Diabrotica virgifera
  misc_feature (34)..(53): n is a, c, g, or t
  misc_feature (626)..(626): n is a, c, g, or t
  misc_feature (654)..(654): n is a, c, g, or t
  misc_feature (668)..(668): n is a, c, g, or t
gaagtatttagattgtggaatttaaaacttcgannnnnnnnnnnnnnnnnnnncagaattcattttacctgatctgttagttaggctatctatagatatattactttggctgatctttttgttatgttgcatgtgttatgatttcgcttgcatcctttggcagtgactgaattaaacaatttcatgaaatgattttgtgaagattgaaagtgatttatagttgccaacaaattattgcagaaaaccttatcttcagcttattacggggtcatttgtatttgagtggttttgttaagtttccggcacaggtagaaagtaatataaatgttaatctattgtaccgggtgtcccagtaggagtggctctcgaccatgtctcgggagccatttatagtgcagttttgagagaaaagtatttgtagcaacggttgcctcgggaagggcctggtaattgttttcgtagttgtgggtccgccgctagagggcgtaattgagtatcaagggttaaaggatctaaattttgcaaaatttacctaatgaaggggaactggaggtccaatcgtcgtgttcctcatggagttctgcgtatatttgatttcacaggtttgggtctgcctttgcaagtgngaggtgggggtgagtgggaaccttatgnaaggatggctgtgngtccggttctgctgggtcgagttttgcatgcttggtctcgttgaaaacggctctttttcgtcagtgtgagagtcttattt

SEQ ID NO: 18854 - DNA, 908 bp, Diabrotica virgifera
  misc_feature (40)..(82): n is a, c, g, or t
  misc_feature (450)..(469): n is a, c, g, or t
  misc_feature (867)..(905): n is a, c, g, or t
ggttatattaaggttaatagtttaatgtagtaaacataannnnnnnnnnnnnnnnnnnnnnnnnnnnnnnnnnnnnnnnnnnaacaagtgtctttaaacttaattttgtaaggatggtacaattgttcaggcgcttctaggactaaccctcttatagtagctttagacgttagtcgtttattattttgatccattatagatggcgcaaaattgaattctagttttagaaacatgttgtattgttaatatttttgatgaaacttacaaaaaaagccttggaaaggttcctttttgaaacaaatacagtcaactccagtttatccctagggttgggtagcacggttgtcgcggataagctgtaactggaattcaaatacataaatgtaaaaaataaaaatgtagtttcacctaaagctttaataacttatattttcaatgtgtacttatatnnnnnnnnnnnnnnnnnnnnatctctcacttgtttctgcttctttgaatggaaaacgtgtttctctattttttccattgctacgcagcatcagtttttcagcaagtagcgcgtcgcccttgtcctctaggtattctattaggaagttcatttacgtgaccaccaaatccaagctcctcttctttttcatcactttcctcgttttctccccagcattttattaggaatgtcttcatccgttagatgctcaaatcccgggtcggtagcatcgaagtctaaccactcttgcaggtttcctgcgaccacattctctcgtttgtaacgttcctgttttctttgagaaaatttctcacttgtgttcaaatttttctgatggtggggaaaggagtgtgtaaacgttacaacgtcacatcttttgnnnnnnnnnnnnnnnnnnnnnnnnnnnnnnnnnnnnnnncaa

SEQ ID NO: 18855 - DNA, 535 bp, Diabrotica virgifera
  misc_feature (13)..(13): n is a, c, g, or t
  misc_feature (20)..(20): n is a, c, g, or t
  misc_feature (23)..(23): n is a, c, g, or t
  misc_feature (25)..(26): n is a, c, g, or t
  misc_feature (54)..(54): n is a, c, g, or t
  misc_feature (56)..(56): n is a, c, g, or t
  misc_feature (73)..(73): n is a, c, g, or t
  misc_feature (79)..(79): n is a, c, g, or t
  misc_feature (87)..(87): n is a, c, g, or t
  misc_feature (90)..(117): n is a, c, g, or t
  misc_feature (131)..(131): n is a, c, g, or t
  misc_feature (141)..(142): n is a, c, g, or t
  misc_feature (147)..(147): n is a, c, g, or t
  misc_feature (151)..(151): n is a, c, g, or t
  misc_feature (175)..(175): n is a, c, g, or t
  misc_feature (183)..(183): n is a, c, g, or t
  misc_feature (190)..(190): n is a, c, g, or t
  misc_feature (196)..(196): n is a, c, g, or t
  misc_feature (199)..(199): n is a, c, g, or t
  misc_feature (208)..(208): n is a, c, g, or t
  misc_feature (214)..(214): n is a, c, g, or t
  misc_feature (222)..(222): n is a, c, g, or t
  misc_feature (239)..(239): n is a, c, g, or t
  misc_feature (253)..(253): n is a, c, g, or t
  misc_feature (264)..(264): n is a, c, g, or t
  misc_feature (273)..(273): n is a, c, g, or t
  misc_feature (278)..(278): n is a, c, g, or t
  misc_feature (368)..(368): n is a, c, g, or t
  misc_feature (412)..(412): n is a, c, g, or t
  misc_feature (425)..(425): n is a, c, g, or t
  misc_feature (514)..(514): n is a, c, g, or t
ttaaggaggcggnagaaaantanannagaggaagagagggccctaaagaggagngnggaagggaaaaggaganaaaagnagagaagnagnnnnnnnnnnnnnnnnnnnnnnnnnnnnccaaaaacggaacnacgggaagannccagncgcnacgaacgaccacggggaccagccncagaagcncgaggangaaggnagncaagggagnaaaganagggaggnaccagaaagcgaagacnaggcaagaagaggnagaaaagcganacccgacgnagganagcgggagaccagcaaagagccaaaacaagacggccggagcggagaaggagccacaaagcaagcgccggcttgaaacagcagcgggcgcnaggaacacgagagagccaaggcgcgagaaaaaacccaagcagcnagacaacgcaggnagaaaaaggagacacccgacaacaaagcgaaaacgcccacaggcagagaagggcaacggacagagccacaaacaaaggcgccaaagganaaagacgccgcggaacgacaa

SEQ ID NO: 18856 - DNA, 489 bp, Diabrotica virgifera
gcgcgagtcattgggatataactaaacctaaaggcgtaatgaaagtaaaggtttaccttgcgtagatcgagggaggataagcggtttgcccttaaaagttgccgcttcgcactcccagagtgtctcattctcattgcgagaagaggcgcatcaagagcgtacacgctgggacccgaaagatggtgaactatgcctggtcaggacgaagtcaggggaaaccctgatggaggtccgtagcgattctgacgtgcaaatcgatcgtcggaactgggtataggggcgaaagactaatcgaaccatctagtagctggttccctccgaagtttccctcaggatagctggcgctcgttccgtacgagtttcatccggtaaagcgaatgattagaggcattggggtcgaaacgacctcaacctattctcaaactttaaatgggtggaatcttcggcttgctcgaacttatgaagccgtgagaaacaaatcagagtgcc

SEQ ID NO: 18857 - DNA, 860 bp, Diabrotica virgifera
  misc_feature (22)..(22): n is a, c, g, or t
tacgtccgaaggttagaatggntcaattttttaaacttttcttatgttttaaattttaaacagtaataattaaatagaagctataaaaaatggctgaaaattcgacagtacggttgccccagaagcgattttataggcaacgagcacattccaacccgatagcggatcattgttttgattatccccatgctccagaactcatggactggagtccattttatccagaaaagtttgtagacaatgagaataatccccagaaaatagaatttgcagatattggctgtggttatggtggcttactcattactttatctcccatgtttccacagacattaatgttaggaatggaaataagagtaaaagtttctgactacgttatggacagaattactgcattgaggtcgcaacatcctactgagtatcagaatgtagcttgtctaaggtcaaacgctatgaaatatttgccaaattttttcaaaaaaggacagttacagaaaatgttcttcctatatccagatccacacttcaagaaagcgaaacataaatggagaatcattaatcaaaatctcttagctgaatatgcttatgttttatcagaaggtggtattgtctatacagtaacagatgttaaagatttgtatgaatggatgtgtcatcattttaccatgcatcctttgtttgaacaaattttagaagaagatttgaagggtgatccaattatagaaaagttgtatagtagcaccgaagaaggtcagaaaggaacccgaaaataacggtgacaaatttctagttgtattaaggaggatacaggatccacttttttacaaatgatatatttttaaaccaaaattcatataatt

SEQ ID NO: 18858 - DNA, 892 bp, Diabrotica virgifera
catcaacaacaacaatatcaacctccccaacaacaatatcaacctccccaaaaccaataccaacctccacagagtcaaaaccaattctctaggcctacagctcaggctgtacccttccaatatccttctgaacaacaatatcaaactcaatctactcagcaatatcaatattctcaacaatatcaatcttccgaacagagttaccagtctcaacctcagggttatcagtccgttccacaatcttctcaagtgcatagtgttccaatacaggtacaaagacaaacttcaaaacctgtggaacctcccccatctacaatcactctccgtcctcaggctccagtgagccaggctccaccaccagtttacacttctcaaccagccacggcgaccctaaaagtttatgtcaatccgaaaaatttacgaggagacctaaaatggcctccagaagatgtaaagcaaaagatgtacgaagaagctgaaaaccttaatactagtaatagtttcctttctattcaaggtggaaaacatctccgaggagatatgaagtggcctccagaaaacgtcaaggtccaagccgaagaagagaacaggctacgtcttgaattagccaaaggacctgtttgtaggccacgtaaagtgcatagggattacacagagttctttgatcagcatgctctaaattccagttatcccggatacaaaatccctccaggcactcagttctatagagccgaataaatatattttaggtcttttgttattttctaatttaatatgcttatttgtaagtctcatttgttattaacacatggtctgtataagattaactatctcgttattcgaagagatgcattatctttgaatctgcttgtacaaaatataaaaacctact

SEQ ID NO: 18859 - DNA, 104 bp, Diabrotica virgifera
  misc_feature (60)..(83): n is a, c, g, or t
tttttgtgcgcggttagggttgataactagcgattataaccactctttacatataagttnnnnnnnnnnnnnnnnnnnnnnnnaaatcataatgatcactcgat

SEQ ID NO: 18860 - DNA, 343 bp, Diabrotica virgifera
  misc_feature (47)..(48): n is a, c, g, or t
  misc_feature (51)..(51): n is a, c, g, or t
  misc_feature (63)..(63): n is a, c, g, or t
  misc_feature (88)..(88): n is a, c, g, or t
  misc_feature (91)..(91): n is a, c, g, or t
  misc_feature (115)..(115): n is a, c, g, or t
  misc_feature (122)..(122): n is a, c, g, or t
gaattgcagaaaaatcaggccctttaaaatattgataatttggagannaanaaggagaatagnatagaagaaaatgggaatattaagnagntattttcctataaggagaatttanaaaagangagtggagatgaagaagaggaagatgttttaagggaaatgttgttagaatgtatgtgaaggaaaatgagtaaatttggtgagtaaaaaagtgtggaggaaggtgtagtagaaaaggtaaagtggaattgaaatgttgtagaaggatttattgttaggggagagaaaagtgtgggattatgacaacatgaaatcggacgaattattataaatattggtaggg

SEQ ID NO: 18861 - DNA, 925 bp, Diabrotica virgifera
  misc_feature (89)..(151): n is a, c, g, or t
  misc_feature (823)..(842): n is a, c, g, or t
ccgaatttagagatgaattttacaaaatgtacacatttttagcaaccaatgatgtaaaagttgaacaattgtggaaattaatatgtggnnnnnnnnnnnnnnnnnnnnnnnnnnnnnnnnnnnnnnnnnnnnnnnnnnnnnnnnnnnnnnncagcagaagacaaacttcaatcaagaattttttcaagccagaagatcctggaccatcaacttcagcatttaaatcaaaaaagttctcttttggcaaagtaaatcgccaaaatgataaagatttggatattgtgctaaatagtcctgacctttttgaaaaatttttctctgacagtcccacagaagacgaatccataacaaaaaagaaaaaagtcactaatggtttaaaactacctcagcagaatgatagtattggagatttaatagatggtatagacagtggtagattctataaacagaattcaagattaccccaacagaaatatgtacagaacgatattggagatcttatagacagtatggacaatagtcggactcgtaaacacaaagaccaagataatcagaaatatgtacaggatgatatcggggatcttatagacagtatggacaatagtcgggctcataaacacaaagaacaacaagataatatttccgattctttacttagtttcgtagatacacttcgtcggaaaacagcacaaagcgaaccaaagaagatcgagcagatggaaatagatactgttgaagatacttcagatgtagttatggaagcgaaagtgaaaaataaaattacggaatattttcagaaagttcatagcgattgtactatgcnnnnnnnnnnnnnnnnnnnnagattcgaattatatttaggtgaacagtggcgatcgacgggtggcagcaacgcggtcagaattgcgaaagtctgcaactttca

SEQ ID NO: 18862 - DNA, 921 bp, Diabrotica virgifera
  misc_feature (18)..(31): n is a, c, g, or t
  misc_feature (34)..(53): n is a, c, g, or t
  misc_feature (76)..(104): n is a, c, g, or t
  misc_feature (113)..(167): n is a, c, g, or t
  misc_feature (184)..(219): n is a, c, g, or t
  misc_feature (234)..(307): n is a, c, g, or t
  misc_feature (373)..(491): n is a, c, g, or t
  misc_feature (524)..(582): n is a, c, g, or t
  misc_feature (591)..(607): n is a, c, g, or t
  misc_feature (610)..(664): n is a, c, g, or t
  misc_feature (678)..(773): n is a, c, g, or t
  misc_feature (838)..(913): n is a, c, g, or t
ctgtggtggggggggcgnnnnnnnnnnnnnntcnnnnnnnnnnnnnnnnnnnngggaaataaaagggggggcgggnnnnnnnnnnnnnnnnnnnnnnnnnnnnngcgcggggnnnnnnnnnnnnnnnnnnnnnnnnnnnnnnnnnnnnnnnnnnnnnnnnnnnnnnnccccccccgcccgcgcnnnnnnnnnnnnnnnnnnnnnnnnnnnnnnnnnnnngggggagggggagannnnnnnnnnnnnnnnnnnnnnnnnnnnnnnnnnnnnnnnnnnnnnnnnnnnnnnnnnnnnnnnnnnnnnnnnntccgtcggcgggcgggccctcccctctctcttttttatttgttgttgttttgtgtgggcgcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttattttttctttctctcctccccctccgnnnnnnnnnnnnnnnnnnnnnnnnnnnnnnnnnnnnnnnnnnnnnnnnnnnnnnnnnnngacaaccgnnnnnnnnnnnnnnnnnggnnnnnnnnnnnnnnnnnnnnnnnnnnnnnnnnnnnnnnnnnnnnnnnnnnnnnnncggggggtgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttcctcttttccttcttctccttctccctctccttctcttctccccctcccttcgcgcgcnnnnnnnnnnnnnnnnnnnnnnnnnnnnnnnnnnnnnnnnnnnnnnnnnnnnnnnnnnnnnnnnnnnnnnnnnnnngggccaac

SEQ ID NO: 18863 - DNA, 771 bp, Diabrotica virgifera
  misc_feature (232)..(271): n is a, c, g, or t
caaaaagtgagttgcagaaagtagctgctcagttgaagactcaaaccggtgtaatgcagaaggaagtcgattctgaggctactgagagtagttcagggggagaaagctgtgatgaaatgcaaagttacaataatccacatcaacagtatcttggcatacaaaagagggcgctgtggaaatactcgaacgatcgagccttgatagccgcgaaatggacgtggttgcaaggccnnnnnnnnnnnnnnnnnnnnnnnnnnnnnnnnnnnnnnnncttgcacaaacaagctcgcttgaacaagggcagtattcaactgggcggtgccagtccacctcacatccctgccgcctctcagactgccgttaacgggtatcgcggtcagcttcccggcggatcgttgctgtcttcgaagtctgcggacgacgcggccgaagaatccgcgacggactatcagtgtgccaggaccagaccgttgaccaaattcaagaagaggaagctgctgcagatggccggactgcacgcggtatccagaaaggctgtgcggccgagcaccatgcggtgcgggtgcgtgccgttgtcgaatccgtgcgcgttgtgcacgggcaggacggaccccacgtacccgagggatcccccggacacgctcagcccggccgagaaaatcatgttgctggatcccagtttcacaacgtattttcgctacctgaagacacctcagaaagcatccatcttggatggcgataatgaagacgcaggaaatggcagcagaaatg

SEQ ID NO: 18864 - DNA, 481 bp, Diabrotica virgifera
  misc_feature (131)..(150): n is a, c, g, or t
tacggccgctcagaaaccttgaaacggaggacacgagcacttttaacgagacctcaggaaccttgatacggaattgcaacgcgatggacaagagttgaagaaaactcgcgaactgatttaccaactcgccnnnnnnnnnnnnnnnnnnnncgaggagctcaaggactccaagattaacattaccgagcttactcgtcgagtccatgaactccacttggaagatcggcagctggaaaatgaacggagaaggacatactgaagcaaagaaagaaggtgaagcgggacgaaaagatggaaaacaacgaggaccacgccttgcactcaaaattggtcgaacgcggcacgaagcgggaaagagacggcgagaaaaagacgagaaaaaatggagctatacgtagggcaacaaggaacgtaaaaggatggtgcaacgcccgtctctggcaacaaggaagcactctataaactgagagagacccagatg

SEQ ID NO: 18865 - DNA, 180 bp, Diabrotica virgifera
gactcactacccatgaagagatcgccagctactgcgtatgaaacgctgggaacaatagagtgcaggttcgtggactatgacgaatatgatgatgtggctaagacatgcaaccgcgcttacgttgaaaacgggccaagatgtctaccctgaaatgtccatagcggatgtttcgtctcttgc

SEQ ID NO: 18866 - DNA, 409 bp, Diabrotica virgifera
  misc_feature (2)..(71): n is a, c, g, or t
  misc_feature (76)..(108): n is a, c, g, or t
  misc_feature (110)..(149): n is a, c, g, or t
  misc_feature (196)..(216): n is a, c, g, or t
  misc_feature (350)..(377): n is a, c, g, or t
cnnnnnnnnnnnnnnnnnnnnnnnnnnnnnnnnnnnnnnnnnnnnnnnnnnnnnnnnnnnnnnnnnnnnnngggannnnnnnnnnnnnnnnnnnnnnnnnnnnnnnnngnnnnnnnnnnnnnnnnnnnnnnnnnnnnnnnnnnnnnnnnacaaataataacctttaggataacagcggaattttattgggaaagtnnnnnnnnnnnnnnnnnnnnngcgacctccagggggggataaaaaacattaaatggggggagccactttttaaattcaatccgggttggacttttaaaaatttttccttgaatctggtggattaaccccgtgggggggccagggggggggttctnnnnnnnnnnnnnnnnnnnnnnnnnnnngtgagaaaaaaaaggggcacaaaacatatatc

SEQ ID NO: 18867 - DNA, 1216 bp, Diabrotica virgifera
  misc_feature (276)..(299): n is a, c, g, or t
  misc_feature (1031)..(1056): n is a, c, g, or t
  misc_feature (1169)..(1195): n is a, c, g, or t
aatttgccatatcgaattatgaaaaaataaagcagcccaactcttgtttttttgttgaaaatcctaaggaacccgtttatgcagagccatatcaacacagaaaagattcactagattctgttcttatgaagagagatgggtcctgcagaagcaaggaaagtgcacgaaatagtctgtattatatgagcacgcctgtactgactggaccaaaatttttcaacatgactgaaaatagtgacaaacagatgtctgccgaaaactcatccctctcttctnnnnnnnnnnnnnnnnnnnnnnnnccaactgaggaatctccaaaaattcgcagtattatagaatgttatgaatctaaaagttctaaaagttccccaaccgttagccgggcgaccggcaaaagtcgagtggagaatttaaagaattcgctccaaaaaaccttggatacaagttttaacaatatatgttccatgaaagattctgattcagaaaataatgacagcgaaaaagtgtcctctattatcaagaaattcgagacatatcggcaaaatgtacccaaatattgcaccaataaagttaacaaggatacgttattttattgttgtttaataatagaaaaagtcaaagatatagccaggattaaatttaaatatccctcatgtgctgaagttcctcaaagcatagaacatctgtgctttcccgaaaatgacattacaacggctaactatgtcggacctctcgcaaaactatttccctcttaataaccaatgataaaggtgaacgtaccatatggatactgtaaaagagtacttcctgaaaggtcctcgtggtgtttaccactaacccattgaatcttgagaaaaaatagagcttcccaggtttattaggaaaaatttagttgaacttgaacccagggacggcatttccaaaaaataaaagaaacaaatttattaacaaatttttacaattaaaaatttcccaactgggaaaattaaaaagggttaaaccccaccccattagaaccaaaagggtttccnnnnnnnnnnnnnnnnnnnnnnnnnnaacccctaatgaaaaaccttttgacaaattctttggaattaatattctcaacttttccccaaaaaccaaaacctgggggcaatattgctgaggaagacgcggaaacattttcnnnnnnnnnnnnnnnnnnnnnnnnnnncatggagtatttatttttttt

SEQ ID NO: 18868 - DNA, 308 bp, Diabrotica virgifera
  misc_feature (102)..(119): n is a, c, g, or t
  misc_feature (182)..(198): n is a, c, g, or t
gcccccccctctcccgcggagatcgggggaatctcatgagaccctaccgccatacgaactcttctgcgatagcttgtctgtatctgtttgatcactctagtnnnnnnnnnnnnnnnnnnaaaaaataatgtgagaccgtaactaagaacatagactccagagtaccggaaaaatcaccaacnnnnnnnnnnnnnnnnncctaatagaggttctacacctctgccaccgcatataatccttgtcttttccaaaactatgatagaaagaatgacggtgaacccaggctccgcagtctcacgataatcact

SEQ ID NO: 18869 - DNA, 180 bp, Diabrotica virgifera
  misc_feature (16)..(16): n is a, c, g, or t
  misc_feature (26)..(26): n is a, c, g, or t
  misc_feature (55)..(55): n is a, c, g, or t
  misc_feature (75)..(75): n is a, c, g, or t
  misc_feature (78)..(79): n is a, c, g, or t
  misc_feature (82)..(100): n is a, c, g, or t
  misc_feature (148)..(148): n is a, c, g, or t
ccttttacggccgccnccgatgaganacaacgcacgagggccactttttcgcaancgcagcaaaagaagaaaacnggnnacnnnnnnnnnnnnnnnnnnngaacgcccacgcccgaaaaacttagcaaaaggaaaggagaaagaaccnacaggggggacaacaaaggacgaaaagagcgc

SEQ ID NO: 18870 - DNA, 408 bp, Diabrotica virgifera
  misc_feature (368)..(382): n is a, c, g, or t
gtggcctagtgatatagaaaagatatgaacaatgtttgtacccatacatccaaacagcttattttgacaggcagaagacaaactacaatcacgagattttgcatgtctgaagatgctggaccatcccccacaggatttaactcccaaatgataacttttggcagatatgatcgccgaaaggatgacgactaggatccagtgctaacaaatgcggaccttatttctgcctttttctctgtcagtctctcggaagacctatccaaaacgaatgagagagaagtcactaatggatgaaaagtacctctgcaggatgtccgtgtaggagatttaatacatggtatacacggcgacatgttccatcatcggannnnnnnnnnnnnnnttcagaaagaggtgcagaaagatatt

SEQ ID NO: 18871 - DNA, 112 bp, Diabrotica virgifera
gtttattcatctggtacatctatgaggtcctcccttttcctcttcaggatgatagattcgtatattacagattcaaatgtgccgcgaagtacgagaacagtttgtaatatac

SEQ ID NO: 18872 - DNA, 605 bp, Diabrotica virgifera
aaaattaatttttatgtattaaatatctttgcctttatcctgccacgttgtaaacggttttaaattagtgttttttaggcatacttgacatggcatgactcggaaacttcctggcgatatggatatgaagattgaaggatccaagatgaaacagccgaaggatctagaacattagaactgggtgagaatgagtatccgtacagtccgcgaggacgactgaggacttctcgaccaagaacttatccctaaagcacgcaaggcatagtgcaaagtattaaaactctcgatgcagggagattgctatatgtcggacatataacgcgtgaacgggagatcctgggttccttgacgtgagattattcagaaaagactcatcgagatgacatacgaagtctagaaggcgaacgtgacgcctgcgataccagcaagaggggatcggctgttcacttcatggagttttactaagaaaccgtatctacaatacaaaaagcttgccatgaatggtaaaccggcgtctgaggatattgtactcaagatggacgaacttgacaataaatcatatgagagcagttagcctgatttggcagttttcacccagataagct

SEQ ID NO: 18873 - DNA, 332 bp, Diabrotica virgifera
tttccaccccctcgccccggaacgatgaagcgggtcgcctgcatactcctcgttggtgtctggcccacacatgtactattatctcattaccgagcgagaaaagagatttaactactagtttcttcgaatgaactccgtgaacgtgcccaagctatccctcgaagagaatccagcataaggcagcagttgaggaagcatttgatgcgggtgaagtgattggagattctgacgacagatggtgtggggcttggccccttctttctagggtgtgaggccctttgctcttgcgtagagagttgggggtacccccctctcccccacaaaaggggtaa

SEQ ID NO: 18874 - DNA, 1159 bp, Diabrotica virgifera
  misc_feature (265)..(284): n is a, c, g, or t
  misc_feature (434)..(434): n is a, c, g, or t
  misc_feature (673)..(695): n is a, c, g, or t
  misc_feature (721)..(761): n is a, c, g, or t
  misc_feature (961)..(995): n is a, c, g, or t
  misc_feature (1023)..(1046): n is a, c, g, or t
  misc_feature (1048)..(1060): n is a, c, g, or t
  misc_feature (1071)..(1108): n is a, c, g, or t
gaggttaacaaactgtttcaattttcctttttaatctaggagccgagctcgtagattatttatataccattaatatatcacatatttcgtaagttaaaaattataattcaaagagggaaataattagttcacccttcttatgtgtttaggttatgttaaaatattcctaaaacaggattaatgataaagatttggcaacgttgattttataatatcataatacacattttactaggaaaatttcgtgtaaaagagacattttcannnnnnnnnnnnnnnnnnnncgtttaaaagtaaacatgctcaatatagcaacgaattatacaaaagtacaaatgccgaaaaaaattctaaatgcaaacataacctaacttaagtagaacaaatttcgttaaagatatcgtaacctaaaatcatacaaccctttcaacaanaaaagttgataaagtaatacctattgtttcagctaaaatctaataaaaaattagacaatgctgtccaatgtcacaattgtgtcaaatttgacagacgtcagttatctgtcaaatgtcactttgtggcaaatttgacagatgtcaggtgccctgctgctttgtcttcaacgccattttccttgggaaaaaaccatcaaaaaaactttggggggaggggaaagcaaaatggtaaaaagggnnnnnnnnnnnnnnnnnnnnnnntaacccaatttttttttgacacggcnnnnnnnnnnnnnnnnnnnnnnnnnnnnnnnnnnnnnnnnngcgtctaaaagggaccaaagttttcgatcccgggggggtgggagcgggtaagatctttttttatagagggcccccaaaatatatattcctggggcggggggttttaaaaacggcgggggagggggaaaaaacctgggggggtaccccccatttaaatctcctgtgtggggacaccccccccctcttcccccgcggggggnnnnnnnnnnnnnnnnnnnnnnnnnnnnnnnnnnnttcccccacacttcgcccccccgcgaannnnnnnnnnnnnnnnnnnnnnnngnnnnnnnnnnnnncgccaaatatnnnnnnnnnnnnnnnnnnnnnnnnnnnnnnnnnnnnnnaggggggacaactaatattttgtgggggggcccccaccgccgccgccctct

SEQ ID NO: 18875 - DNA, 182 bp, Diabrotica virgifera
  misc_feature (16)..(81): n is a, c, g, or t
  misc_feature (89)..(176): n is a, c, g, or t
caaaaaaacccaatannnnnnnnnnnnnnnnnnnnnnnnnnnnnnnnnnnnnnnnnnnnnnnnnnnnnnnnnnnnnnnnnngggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttag

SEQ ID NO: 18876 - DNA, 896 bp, Diabrotica virgifera
  misc_feature (780)..(780): n is a, c, g, or t
aggactacacttctggagaagttttacttgaatctatcggtaacaatggacagaagaaacttagcattcaagttcaaagtgaaatctatcctcagaaattcattaaagctgtactttcttcacctgttaagtcagcctttgctgaaggaagaattacaaatacaaaccaagaaaaatcgttgctccttaaagctggccaagacaacgttgaaacttaccttaagttcggtgttgccatctcaggttcccaagataaagcagtttatagtccaattcttgaatataaaactccagatggtaaccaacaattaccagttcaagttgaaggaagaattattgctgaacaaaatggacctaacaggaaatatatatttgataacgtacgagttcacttacccaaccaaaaagtcttgggaattaatggaaacatcggaaatgaagctggaaatcaaggcgaagatttcttcagcgacttaaccgtctctgaaggacaacaatcaggttctttggcaggtcgtttacacttggacgcacatcaattgaacttaaatgccgaagtgaagaatagcataaacccaggttttaactttaaacttcaaggaggcctgaaaagatcaagtgacctgtctcaacttgacagcaactggcagttaattcacggtcaagatctagcttccaagacaaatattattagcctggcaactggtgttacaagaagatacaaaacacaaaatgatttccattttggatttaagaataaggtcagctatccattgatcnggattggttgtcaatatcgaagcagaccagaaaccaaaaagtgttgattatgattttgacttccaatataatgacattaaatttggttcagagttggatttcaacgtcgataaaaa

SEQ ID NO: 18877 - DNA, 179 bp, Diabrotica virgifera
gtctgtcagggggatgccggcgtccttgccgccgtaggcgcccaggaccggggccttgaggtcgttgaccaggctcaggaccgacttgggcttgagttcgctcgggtcgccgcccaactggccgtaccaggcggcgccggccttgagcttggggttgtgggcggcgtagagccagacct

SEQ ID NO: 18878 - DNA, 1175 bp, Diabrotica virgifera
  misc_feature (345)..(358): n is a, c, g, or t
  misc_feature (361)..(374): n is a, c, g, or t
  misc_feature (768)..(780): n is a, c, g, or t
  misc_feature (782)..(794): n is a, c, g, or t
  misc_feature (914)..(942): n is a, c, g, or t
  misc_feature (996)..(1013): n is a, c, g, or t
  misc_feature (1104)..(1166): n is a, c, g, or t
caaactagaataattaccaaagtattcacagacgtgcctttttttctgtcacatacaatttaatgcgttagagagaaatcgaaaaactgtgacgcactgaaagatgatcatgagaaaaagattaccagttaaataacagctgctaatttgtttgaaaatcaaaatattcaataaatttaagtgtggtagcggatacggcttaacactagaaagttgccaacaccagaaaggggccaatttggcccctgttgaaatttaaagttattgtagtttttttatttcaggcaatattaatttcatattttgtgacttttagtattttgatacgaagccttatttaacacnnnnnnnnnnnnnnacnnnnnnnnnnnnnnggattttctaacgaatctaccatagaagtctaaaggggccaaattggccccgtgtaatttattatcgttttctgggaaatttcaactttcctttctttgactttctttcaaattcctgtcggatgggttaaattatatttatgtatgtttattgtaaatggttacccttatactggtactcatcatctacggaataaagatacaataattgttggtgaacacaagtgaacacaaaaatgaacattgttggtgtagaggaccaaatgacgcgtctttatattacaaaagtaacttcaagacgatggcctatgtacgtgtttacactacgcctagcaacaccaggtctaccagcaactatcacctgttactatccaaaaacgaaaaaaatatcagnnnnnnnnnnnnngnnnnnnnnnnnnngaaatcatacttccaatcattgccacggttgtaacaagggaatgtgtggcaaatattaaaaaatgcaaactggatggtggtccgaatggtttttgataaggaggcaaatgtggtaaaacnnnnnnnnnnnnnnnnnnnnnnnnnnnnntcctcccgcctaaaagtaaattttattttctttaaactggagttttaattggtnnnnnnnnnnnnnnnnnnaaaaagattcccttccgggcttttttaggaatggtagggtaaaacccaactttcttaagggttaaataaaggggccttgtttgggggtttnnnnnnnnnnnnnnnnnnnnnnnnnnnnnnnnnnnnnnnnnnnnnnnnnnnnnnnnnnnnnnncccatccct

SEQ ID NO: 18879 - DNA, 759 bp, Diabrotica virgifera
  misc_feature (54)..(71): n is a, c, g, or t
gtggtgtcataaaatttgagtttttagtagtacaaaacaaagtgaacaatatgnnnnnnnnnnnnnnnnnngtgtgcatttcgctattttgtttatcattagtgttaagtaactacctattcagaaatagataaacaaagtagaagacttaaatctggattaatagtggttttccaaatgtatgaatgtcaatttttattttaagaataaagatattggagttcaaggcggatttactagggcacattctacttactaattggtccctaaaattggataaaaagggtgcataagttctcaaggagctgatctaatggtttccctacgattttcctgattgatcgagaatatacatattcttactaaagcatctgtgatattcaagatgtgattgatattccttcacaaacctgcatcaactgcacacaattcgttaatagtatccacaatattcaacaaccaaatagctcacaatggagaaagaccagaaacagaaaaactcaaaacgtcacaatgcaacagacgcacactcaaaccgccacaacgtcaattccagctcgggcgtcctgatggtggggcctaactacaggggtaaaaagatcggctgtggcaattttggagaactgagattaggtaaaaatttgtataaataacgaacacgtcgctatcaaaaatggaaccgatgaagtccaaagcgccctcaacttcatctagaatatagattttacaaactcttaggtactcacgatggtgtacctg

SEQ ID NO: 18880 - DNA, 918 bp, Diabrotica virgifera
  misc_feature (850)..(850): n is a, c, g, or t
gttaagggttaaaaagtcaaaatgaaacatcaaaaatacaaagtttttacattgatcaagataaaatgtgataaaagcgacagtagagataattaaaacacattattcatatttcctcgtggtttcaaactgaaatttaatggaaggagatttttttagaataaataacttaaaaccaagatgaaaatgaaagagtccaccctgaaagtgaaaaattctttgaagagaaagaggaagataaactggctttcaaacaatccaaatttggtggtcttcagttttgacctacaaaaatgtttgctcactccctacttaaaaagcagcatttcattctataagagaaaatttggactctgaaccaccaacaagcagcagcaatggtctttggatacaatttttacttccactttctgtaattgtttctgtcttcaagcactcaattacttcaacacctacttacaaattagcttcattaatatgtatgggcatgatatttgtctctttgataatatccatgcagaaatatagaaagcaaagactgaaagtatttagtttatggaccatattagctttagctgctacttctgcactgtttcatatatgtttacataaagatgtgccattttcagtatttggaggatttttctcaacagtggtatatttccaaatatacaaatttgtcttgaaacattttaaagaaagctttacgcttggggaagctggaattatctgccaaggccttactttaatgttatattttacaatactaaatgttgtcaatcataccacaagacctcttccatttaaaagtaatattcaagtagcaacattaataattcaggtcttgtangaattctggctattgctttttgttccattattttcagataaagaatattgttcccattttatactaat

SEQ ID NO: 18881 - DNA, 336 bp, Diabrotica virgifera
  misc_feature (2)..(27): n is a, c, g, or t
  misc_feature (35)..(129): n is a, c, g, or t
  misc_feature (202)..(236): n is a, c, g, or t
gnnnnnnnnnnnnnnnnnnnnnnnnnnattggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttataaaatgattgattaagatatttcagcataaaatcttatgtatatagtaaatttatttaattgtgannnnnnnnnnnnnnnnnnnnnnnnnnnnnnnnnnngtatatgaagaaagtaatgctttcgctccccagagagtggggtacggatagtaatttaacgaagtggacaacggcgtcgtatctattatacgagtagata

SEQ ID NO: 18882 - DNA, 612 bp, Diabrotica virgifera
ttaaggccgcaccgcagcgagcggcgcacacaaaaagaacccttttaaccggatccacaggcggggcgcgacgagacagccagcgcgagagagacagagcaaaaacggagcggaaaaattcaacagacgcgagaacacacagccacgaaaaaaagggcagcgccacagggacgggcaaacaaccggagaaacgggccaaccaaaggagcgcacgagccggagcaacagcaacaagcaagaggaaccgcaagcaaagggaacgcgagcgaagcgaccaacgggccaccaaaagacagcgggcaagacccaaacctctcgatcatcttcggtaccatcgtcttcagcacagcgtgtctcggatgctgcggagcagaccaagaaagtaccttgcatgttgactacgtatgcaataatcctgctgacgatattcatcgtgcaagctgccatcggagtgtaaactttcatacaaatcagagacaagaactcggttaactgcgagcttactaataacatgcaacagagcttccacaaaatatgtgtaagccgggaagccaacgagactatggtgggcacacggagagtcttcaaatgttgaggcgttcgtggagaaaa

SEQ ID NO: 18883 - DNA, 93 bp, Diabrotica virgifera
  misc_feature (16)..(31): n is a, c, g, or t
  misc_feature (33)..(48): n is a, c, g, or t
  misc_feature (54)..(74): n is a, c, g, or t
gttaataaaggcatcnnnnnnnnnnnnnnnncnnnnnnnnnnnnnnnncatgcnnnnnnnnnnnnnnnnnnnnngttctcgccctgcccccct

SEQ ID NO: 18884 - DNA, 834 bp, Diabrotica virgifera
  misc_feature (7)..(57): n is a, c, g, or t
  misc_feature (70)..(101): n is a, c, g, or t
  misc_feature (104)..(155): n is a, c, g, or t
  misc_feature (170)..(204): n is a, c, g, or t
  misc_feature (208)..(229): n is a, c, g, or t
  misc_feature (248)..(282): n is a, c, g, or t
  misc_feature (284)..(349): n is a, c, g, or t
  misc_feature (360)..(578): n is a, c, g, or t
  misc_feature (595)..(624): n is a, c, g, or t
  misc_feature (626)..(679): n is a, c, g, or t
  misc_feature (687)..(767): n is a, c, g, or t
  misc_feature (775)..(803): n is a, c, g, or t
aaaaaannnnnnnnnnnnnnnnnnnnnnnnnnnnnnnnnnnnnnnnnnnnnnnnnnncctctcccctccnnnnnnnnnnnnnnnnnnnnnnnnnnnnnnnnttnnnnnnnnnnnnnnnnnnnnnnnnnnnnnnnnnnnnnnnnnnnnnnnnnnnnccgcccccccccgcnnnnnnnnnnnnnnnnnnnnnnnnnnnnnnnnnnntctnnnnnnnnnnnnnnnnnnnnnngcccgggcccgcccccccnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnntcctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagggggcgccccgnnnnnnnnnnnnnnnnnnnnnnnnnnnnnngnnnnnnnnnnnnnnnnnnnnnnnnnnnnnnnnnnnnnnnnnnnnnnnnnnnnnntttagagnnnnnnnnnnnnnnnnnnnnnnnnnnnnnnnnnnnnnnnnnnnnnnnnnnnnnnnnnnnnnnnnnnnnnnnnnnnnnnnnngaaaggannnnnnnnnnnnnnnnnnnnnnnnnnnnnatatcgagagatccccctcccctccccctct

SEQ ID NO: 18885 - DNA, 1116 bp, Diabrotica virgifera
  misc_feature (874)..(889): n is a, c, g, or t
agtaaattaattttttcagtctttagaaaacctactcagactgaccataccatccttagatcttctaaccatccttttcaacagaatatggcttccttttattgctacatccatcgtttacttagtctaccattatcagatactaatttcaattcagaattagatattatcaaacaacttgcatatagtaatggttatttccctactttagttgataatatcctcaacaaattaaggagtaaaaggaatagatccctagcttacaattctgtccttaacaattccactacagcagttatgtatagatcaatatcatacataggttgtccttcagataatgtggccaaggtcctgaacagcatccccaaccttgggctgtcattcgaatgtggggaaggtatcgaatctattttttctcgtaccaaggataaaattggaaaagcatcaaaaggtggtatatacggattgtcctgtggagactgccctgttacttatgtggggagaactgtgcgacctttggaagcacgcatcaaggaacatttgtctaggattgacaaatctagttttggcaatcacttacatgcttctaagcatggcttcggttcccagggagatagtaggattctacatggtgtacccattaacaactgtgcaagggtgaatttgttggaagacttggaaattagcagggaattggggggaggtcctcaaaattgtgttaacacccgggttcggttaaattgtgaatttgatccaatctttaagaagtttctttagtactgttgtattcggcatgcccagcgattgctctagttttttgaacgttgctttgaacatatttgaattttctttcattgattgcagtaaagtgggnnnnnnnnnnnnnnnnttttaataataatattggtttttgaaccagttttggaactctgaactttgtcccagcggtggctccctccttgggttttcatttggtcttcacttctaaattttgggccggagcttgactggggggggtttgggtttttttgatataatttgaaagagacatttggaaaggggttttggatttaatttttcccaagatttggaatatttttaatctttgaaaaccct

SEQ ID NO: 18886 - DNA, 969 bp, Diabrotica virgifera
  misc_feature (395)..(418): n is a, c, g, or t
  misc_feature (849)..(866): n is a, c, g, or t
caaaatcagaatagaaaaggctagagcaaattttaacaaaatgagaaaagtgctctgcacaagggatttgaagttggagctaagagttaggttggctaggtgctacgttttctcgactttgttttacggaatggaagcttggaccttgaatgctgcatcaatgaaaaaactagaatcattcgagctgtgggtgtacagaagaattctgaaaatatggtcgacagaacacgtcacaaacaaagaggttctgagaaagatgaataaagaaatggaaattctaaataccatcaaaacaagaaaattggaatatctcggacatattacacgtggaaagagatacagcttcctccaattgattatgcagggaaagattcaaggaaagagaagcatagggnnnnnnnnnnnnnnnnnnnnnnnnaacctgagagagtggtacggatgtacatcaaatgaacttttcagagcagccgtctctaaaatacgaatagctacgatgattgccgacctccgccgcggagatggcacttaaagaagaagaaggtgccaatatagttctgagattattcgcaagtcttgttttttcagttccagttgttctcagaatttcgatcgtctattgatggttaacgctgtcaaatgcaaatgcttttcgataatcaataaaacatgcatatacatctagattcatgaacctgcatcgttttttaacacatttaaggtaaaaagagcttctcgtattcccaatccgtttcgaaatccgaattgagtgtcactcatctgtttgttttgttctttctttttatgatctgccttaattactgacacaaatagtgggtataaacttttttnnnnnnnnnnnnnnnnnncagctgtagatgaagataccttcagaaaatggtcgaaagacaatatgatataataaagagagataaaagcaaacaaattcaagatgatgtttaacccgaaaca

SEQ ID NO: 18887 - DNA, 220 bp, Diabrotica virgifera
  misc_feature (86)..(106): n is a, c, g, or t
caaataaataacctatattttaacatttcacatgattttagagttaagatttatgacgcttaacaaaagagggatgtacataaagnnnnnnnnnnnnnnnnnnnnngatgagatgatattgcatttacgaattaaaaaatgatagggtttccgcaataaaacgcccaattaactttcctccaaacctcccaacaaggaggatgagcgtgggacaccccgg

SEQ ID NO: 18888 - DNA, 112 bp, Diabrotica virgifera
  misc_feature (2)..(19): n is a, c, g, or t
  misc_feature (21)..(77): n is a, c, g, or t
  misc_feature (79)..(105): n is a, c, g, or t
gnnnnnnnnnnnnnnnnnngnnnnnnnnnnnnnnnnnnnnnnnnnnnnnnnnnnnnnnnnnnnnnnnnnnnnnnnnngnnnnnnnnnnnnnnnnnnnnnnnnnnntatagag

SEQ ID NO: 18889 - DNA, 725 bp, Diabrotica virgifera
  misc_feature (6)..(69): n is a, c, g, or t
  misc_feature (75)..(97): n is a, c, g, or t
  misc_feature (288)..(361): n is a, c, g, or t
  misc_feature (366)..(431): n is a, c, g, or t
  misc_feature (449)..(467): n is a, c, g, or t
  misc_feature (476)..(490): n is a, c, g, or t
  misc_feature (492)..(508): n is a, c, g, or t
  misc_feature (511)..(529): n is a, c, g, or t
  misc_feature (544)..(564): n is a, c, g, or t
  misc_feature (691)..(710): n is a, c, g, or t
gcggtnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagggggcaggcgagactttatatttaatactaaaagacatgtttttaataaacaggtgaaaaaaatgttgccgaaatcnnnnnnnnnnnnnnnnnnnnagcgcttctagagga

SEQ ID NO: 18890 - DNA, 624 bp, Diabrotica virgifera
  misc_feature (8)..(43): n is a, c, g, or t
  misc_feature (465)..(487): n is a, c, g, or t
  misc_feature (514)..(543): n is a, c, g, or t
tacgtccnnnnnnnnnnnnnnnnnnnnnnnnnnnnnnnnnnnnttcacttgtcttctttgtccatctgttgtctctctgtcttgccacgtgtcctaaccatttccactttaacttcctaatgcgttttatgatgtctttcactccagttcttcgccttaactcattattttgtattctgtctctcaaagttaggccaagcatggatctttctattttttgttgtgctacttgtaattttcttattgatgttttagtcaatgtcagtgtttcagctccataagtaagcaccagaagtacacactggttaaatgcttttctttttagctttattgggatgttttccttgaacacgtctcttagtttgccataccctgcccattaggatggatcgaaaaaaactttttttcgaatttgataatggcccttgtggcaaaagttgccattcataaaagtaagttttttgnnnnnnnnnnnnnnnnnnnnnnncaaccccttcaggtgccccaacctccnnnnnnnnnnnnnnnnnnnnnnnnnnnnnntttcgatacggccctatatgtaaactcttcttgaatggttaaaaagtctggggtcaaaattttgaggctctcggaaaattt

SEQ ID NO: 18891 - DNA, 705 bp, Diabrotica virgifera
atgagtccgatataatgtcaacaagacataataataatcaacttttcaaatatttgctaaaaagtgttaataagttctttcaaatttaaagttttagtttgtttaagtaacatgtcgataaattctcttctttctaccctttttcctaacgagccaacagatgaattggtttataatccaccaattcaggattatttaaccaaactaggcacttacaaaattaaagatttaaataccgaacccgacaaattgaagcaagaggcgttggttttacaagaacaaattcaggaattagcaattacaaactacaaaacatttatagaaactgcattgtgttccaaagatttatttacaaaatttagtgttatagaagacaaagttaatgatcttcttggaggtgttccagtattcgaggaaaaatgcgaaacatttggggagggatccagcagaataaacgccctacgaaggatagattccataactttagcaaaaagcgctcaaatattagaaatactagaaataccccagttgatgacttcgtttattaaggatggcctgtatgaagatgcgttacaactgttcgattatgtgatgaagttgtcctttaagcattctgatggtgcacattcgagaatattaatgatgatgtgaacaagggctggattcttatgctagttcagatactgtcccactttatgtcagata

SEQ ID NO: 18892 - DNA, 660 bp, Diabrotica virgifera
  misc_feature (146)..(166): n is a, c, g, or t
ccgaagaagcggtactggcttggcttaatgaattaaacattcaatgtcaggaaaacttgagcaaatatcctagtctgagctattttcagggggaactagaatcgaaaggatacccatgtccagaggccaatattgcatatatgttnnnnnnnnnnnnnnnnnnnnncaaggaaataggtgatctagaactaccaacgaaattcgtacataacaaagaccgaatcgagagagctttgtacgagattaactcccacttttatagaaccatggtacagtataacgaggatcttaaatatatggagttgagacacgtaaatccaaagaaggatgttactaaagcgatcgccgctagtgaatattacttctacagcgtaaaacaagtcgctagtgacagtgattattataaacgactcgtcagcaaatttggtgactctctttgtactataaatgttatgactcagtggttgaatcaactcggcataggacaaagaaaccaacgatgctttaaagacattccaaatctggactatttttgcgaaaaattattcaagaagaattccgttagatatagcaaacacctcgtccgaaaatgggtaatagaatcagcaatcgtttttgaatacgaagaccttgatccattaaaaaatcaagataatgatc

SEQ ID NO: 18893 - DNA, 946 bp, Diabrotica virgifera
  misc_feature (339)..(372): n is a, c, g, or t
  misc_feature (469)..(492): n is a, c, g, or t
cattaggtttgaaaactctctctcaaaatcttgttggctacactcagcagaatattaaaagaattagacaatagatataagtacagacactgatcgctgaggcaagacaaaagtgtttcctctagagttaatgaaggatattaacccataaaaagaagaaaatattgtggagttatgttgtgaccttgtttcatgttaatatggttctgaaatgaaaatatctcagtaccccactttgtacacttggttactctactctgtagtataaacacaatactgaaacagataaaatcatgtctgatcaaatagaagtaaaacaagaatttagtgaagtatgtnnnnnnnnnnnnnnnnnnnnnnnnnnnnnnnnnncactactggatacctttaaaatcgagatcaaggaggagcctaagaaggaacgtgccaatgatacatttgattctgcagaccttaagaaatatcctannnnnnnnnnnnnnnnnnnnnnnngtgtctcttgcgaagacatccaaaatgatgcatatgacctgttaaaatatactggaaataattctaaccaaaatttaactgctattacggatgtggacatcgcagaaaaacattttgaatgtgaaatatgctccaaacaattaacaacaaggcgttctttaaaagttcacatgagaatacacactggagaaaaaccctttacatgtgaaatttgtaccaaacaattttcatccaagaaatatttaactgggcataggagagtgcatactggtgaaaaaccctttatatgccaagtttgctccaaacagttttcatcaaacgcaaatttgactgtacacatgatagtgcatactggtgaaaactatttgaatgtgaaatatgctccaagcaattaacaacaagctattctttaaaaatacacatgagagtacacagtgggggaaaaaccctttac

SEQ ID NO: 18894 - DNA, 246 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattagggaag

SEQ ID NO: 18895 - DNA, 291 bp, Diabrotica virgifera
  misc_feature (6)..(27): n is a, c, g, or t
tttcgnnnnnnnnnnnnnnnnnnnnnnacaaaagaatatattctatagtctgcatgtgatggaatctgaggagagaaaggaagacctatattcttatccgtggacctgaactggcgcaactgttgaagggaacgactacaaagaataatgggcaggtgtagctgccagcttaattgatgatgttctttcatagcataagaagattatcgtgtgcacattgaattgtgagtttgtttcgagtaatatgcaatagtgaatcgttgccataactactgatatccgcccactaat

SEQ ID NO: 18896 - DNA, 148 bp, Diabrotica virgifera
ttgcggccgcgtatagatcgattgagtgtgagtgcacgaacttttattcatttggtttctaacagcgtatacggttcacagttatttttagtcttcgtgacatttttccaactgttttttacaactttcgtgagggcgtgtatacaca

SEQ ID NO: 18897 - DNA, 862 bp, Diabrotica virgifera
  misc_feature (607)..(624): n is a, c, g, or t
  misc_feature (670)..(689): n is a, c, g, or t
ggacatacgggtgtggtcctaaaatattcacctatgtccaattaggcaaaaggtaataattaaaccatttttgccacggtggggtgagattgaataaaaactcacaccatatttcatgttgcaaaagatagagaatcgtttaaagaagtgatcgccaaccttcgttaaaagacggcacaagaagaataatgtaattgcttcttcggctataaaaattatttctaggcattattttatcaaaggtaataccacgagtcctctaaatgttgtcgataaatttttttgttttcacgaaaacttctttatttggtaaaattacgaaaacaagccgaatgataaaatcacgagtccgaaggacgagtgattttatccatttcggtttgtttgagtgattttaccctaaatcaagaagtttaagtatgaaagcgaaaaaatttatcaagcaaagtttagaggacgagtggtatttgaaaagattattttgtgaaccaatttggtattattagtaaatacgggcatctgtgaaatatttttaagacaactaggatcaatgtcttaagtaggttatagataaattaatacttgcttcgtggtcttacccagctannnnnnnnnnnnnnnnnncagtgcagtgttgtaattggttttgcctaacccccaggtgaatgcnnnnnnnnnnnnnnnnnnnnacccgtgtttttgtaataataaaataggagaatgtaattttagaactattttactaattctactaatataatgtgtatttttaaaagtaactattgttacaaaatattacgttgtaaatattcgaatcctttttatgtgataacactgggtttgttgaaatcggcaacaaaat

SEQ ID NO: 18898 - DNA, 706 bp, Diabrotica virgifera
cattgatgagagggtccacgctaattttatgacatgttatctcaaggaatttgtatgaaaattaacttagttaatctttatggattataccgcccaaactagcactaaattagatattagggcaaccaactatacctcacatgagagaggaagtctctcccgaacgatgcaaatacacaatcgcataattcatgtcgtctcgaaacgtactcgaacggatcaagcattatatccacagcctatccatattgggtgacttccacacgatcacagacacgtaccatcctatacgatgacaaaaaccacttaaacatgaccccccatagaactttctcgactgcaaacaccactactctgcgacgcattcgatgacaggaatgcccattgtcactcgcgacattggacattcgaagtgacctattgatgaaaggcagacaatgagtacttatgagtcaggatacgaattatgaagacaaatcacatctactgctgaagaagctctcccaccatggaccatcactttacgaatgtacaaccacaaccatactacggaaacaatgtcaccaacagctcgtcttcacagaacctgcatatctcaatgaatcccaatgtcaagatacctaagaagctcgagccatcgctgtactccaggtattacgcatcagtagcaaccccactgctgatgccatcacctatggtatagaca

SEQ ID NO: 18899 - DNA, 809 bp, Diabrotica virgifera
  misc_feature (76)..(132): n is a, c, g, or t
  misc_feature (283)..(302): n is a, c, g, or t
  misc_feature (730)..(751): n is a, c, g, or t
ttgcgtccggggaaataaaactggtagagttgttaaatttatttatgttaacatataagttcgcattatattgatnnnnnnnnnnnnnnnnnnnnnnnnnnnnnnnnnnnnnnnnnnnnnnnnnnnnnnnnnagtggtatttgccaaactcgtccgatacgtctaagggtgggaaacggtcaatataatgtgaacttttaggttaatatcgctaaatttcccagctcgactagttttattttgtttttatcttacaacttagtacgttttccatctttttagnnnnnnnnnnnnnnnnnnnngatatattaaattattatacttttttgcagaataattttttcctaatattagctgtcaacataacttcaaaacgataagcagaatctttaaaataatcataatgaataataaattctgtaattactgatattaattatcgattacaatccaattacttctttgcgttgtgggtattgcacgataggaattaaataataagtttgaaacaattatttgcttttctccttttctctttaaattactaatcgaagttgtactagtggtccactgggtggcgataccagcgaagctcgcagaggataggcaatacttctctctttaaatttcccaccgaagtgatacaagtaatccactatgtggcgataccagcgaagcttatggcgaataaccaaaactcctatgtctcctgcagtgggttcggtggacnnnnnnnnnnnnnnnnnnnnnncaaccatgaaaaccgaatgggaccagatagattagcgaacatctgtaaaatcaacaag

SEQ ID NO: 18900 - DNA, 771 bp, Diabrotica virgifera
  misc_feature (142)..(163): n is a, c, g, or t
  misc_feature (346)..(379): n is a, c, g, or t
ttgcgggcgattaaacactttctgcgtaactgggtggctgcttgtttatatattttcataatttatagagttaaattaatcctaacacctaaaatatatttacgtatcagatttccaactataaataaaatagtataatagnnnnnnnnnnnnnnnnnnnnnncactgacaactagtttgaaaattttaaagtattaacattgtaaaaaacttatgttgtaatttgattggaagttaaatttaaaaatatagtcttgagaatgaacgttttcggacttatcagttcatcttcagtgaactttaaagtatttgcaggctattacataataattgtaatccatttggnnnnnnnnnnnnnnnnnnnnnnnnnnnnnnnnnnccaattttaacagaagttttttacttcgatgttagcttattaacatttcccaagaagttcaaacacaatcgctagacagattttgatatgcgcattccttgttttggaaatctggtacgtgaacatctcatttgaaagctcaaatcatttgtacttaaaatatcttccttttgtgactggacaccataactttaaatacttcgtatacaaaacggattctttcggtcgtattactttttggaaagcacgcgtgctgagaataatcttcataatcaatgtatctgaaattccaaagactaatacgatcccggagaaataaaatattttcaaaattgtctccactcttttttaatttttaatgtttacctttgaatggagaaaagaggttcgat

SEQ ID NO: 18901 - DNA, 814 bp, Diabrotica virgifera
  misc_feature (713)..(732): n is a, c, g, or t
  misc_feature (735)..(759): n is a, c, g, or t
aaaaaaaatcgtagaattttatagtcaatgttatagttattctatctttcgtttagtaataacgatttttataatttaattagaaaacatcgaaaacaaaaattgaatttgtatagaagaataatagtcgtacttcaaaatatcttctataagtagacagaatgagatccattggacacaaaaagtatttgaaatgtttcagagttaattgcttactcaccactacaaacgaaagataaaattgtaaaaaaataatcagttaataataatatgtaataactttattatatcaatacgctatggcatagagcagggtgtaaagaaaaaggtctattacaacacatgcatactaccagtttgtacctacagcttggagatcgtagcccttaccagaaaatcttctaaaaaactataaacgatgtaaatggcaatggaacgagtcatgcttgagcaaccactgagagataagatcagatacaccgagatatgactaatgaaatggctctgggcctatcatatagccagatatgatgataacaggtggacacggagaattctagaattgagaccaagaaggattacaagaagcatgggacaacctcaaaaagtgatgggtagatgacataaaagcagtgacaggcaagcagtggaatagtttagcacaacatagagaaagataatggcaattttgagtgatctaccactccaggaannnnnnnnnnnnnnnnnnnnacnnnnnnnnnnnnnnnnnnnnnnnnnaagaacttttttttgcccgactttagttacggataattttttaccactatttttg

SEQ ID NO: 18902 - DNA, 833 bp, Diabrotica virgifera
  misc_feature (432)..(449): n is a, c, g, or t
  misc_feature (530)..(547): n is a, c, g, or t
gtttcacattgtttttgttgttcagagtgattaatacaattgtgacagtttaaattgttgcttcataatagagagaaaaatgattccgctggtacttctgttgattccgcatgggtctgggctaagaatggagatagatacgcattcatcgtgatggagtcactaactctaaagagattcatccactatctgatgaagtcattaaatgcatcaatggagaagaagccacgtagcagtgcgcgaagaaattttgttcatgactaatgatgggactatatcaatagagtgatggtgtgatgaccgtgacgaaaagaacgatatgaaacattggattgtcgaagaaacaaaagatgcaggaaaattaaagacgatagctgtagacaagggcgaaggcgaatccttctacccagatgaagtcagttccatggtccnnnnnnnnnnnnnnnnnncagcagaagtatacttaggaaagaacgtcaccaacgatgtcatcgcagtacctgcatatttcaatgactcagaacgtctannnnnnnnnnnnnnnnnnatcattgctggactccaggtattacgtattattaacgaacccactgctgctgccatcgcctatggattagagaaaaagggccaaggtgaaagaaacgtcctcatttacgatatgggtggaggtacttttgacgcatcaatcttaacacttgaagaaggaaacaatgaagtcaaatcaactgctggagacactcgattgggaggtgaagacttcaacaacagaatggtgaatcactatgttggagaataaaagaggaaaaaaaagaaggaccttatcacaaacaaac

SEQ ID NO: 18903 - DNA, 1069 bp, Diabrotica virgifera
  misc_feature (38)..(69): n is a, c, g, or t
  misc_feature (516)..(539): n is a, c, g, or t
acttcatgagctgcaacttttcttttactgcgttgatnnnnnnnnnnnnnnnnnnnnnnnnnnnnnnnnctagatacatttttgctaacaatattctgttcgatcaatactcttttaactatgtattggcgaaaaatcggttttttttgttgaacaataagcatttttactcataaataactcgaaaagtcttgagttgaccagttcggtggtgacactgaaaattacacggtatcgccttatttcaagttcatttactgggctataacacataagtttttgttacacatgtcgcatgtagtaattttttaaagggggccccatttacgattctgccggggggacccgacggattttgttacgccactgttgagcgagcctacactttctgaaggttttcagagtgcaggttggacgcgtttccgcacacacaacacctaaacctgtagctctggcgcggttatgttttgttatcgaaaaactacactttttaattttaatcaaaagattatacgnnnnnnnnnnnnnnnnnnnnnnnntcggacaaaaaagagggagcgatcgtcgagtttgacacccgcaagatgtcactctagcgcagtacagttttgttattacaaaacacttaattttcaattgaaagtattgataattaattacaaaagattgtcgatctcttgtccgacaaagttacagcctcgtttctttagtccgaccacgtaaatatgttaattatgacaggttatgttttgcgattacaaaatttcggacacgaatcacaagtgatagatttgagggcccttattcaaatatagcaatgtcggataaaaattgggtatcaaatagcccggcccataaattaatttcacttaattaagattaagaatccaaacgtccgcctatggtatatggtcaacaaaattgacatttttttcagttctcctagttgtttttacgccccaaccgcggccaaaacttgcgcttttgaaaaattttcagaaaagggggaaaaacttttttaaaacagaaaggagtttgaaaacccatttttttggggaattttttgggg

SEQ ID NO: 18904 - DNA, 983 bp, Diabrotica virgifera
  misc_feature (3)..(700): n is a, c, g, or t
  misc_feature (702)..(763): n is a, c, g, or t
  misc_feature (943)..(974): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnacctttagggataacagcgtaattttatttggagaggtcaaatcgataataaaaattgcgacctcgaatgttgaatttaagtttataaattggggtagcaactatattattaaatcttggtcgacttttaaaattttacctggatctgagtttaaaccggggggagcccaggttggtttnnnnnnnnnnnnnnnnnnnnnnnnnnnnnnnncaaaaggac

SEQ ID NO: 18905 - DNA, 980 bp, Diabrotica virgifera
ttcgatttcgtggagaaaatatcttcagatggagtgttaataagagtatacacaccattaggtaagaaggaacagggagaatttgccttagatgttgcaacaaaggttttgccttactataagcaatattttgatatcgcttacccgctaccaaaattggacttgattgctgtgggtagcttaggatttagtgccatggaaaattggggccttattacttatagagaaaatcgtgtattaattgatccccaaaactcatcaaattcaaccaagcagggagtggcgctggtcgttgcccatgagttagctcatcagtggtttggaaatttggtaactatgaagtggtggaccgatttatggttaaatgaaggatatgcaacttttatgcaatttcttaatacttcggctttatttcccgaatatgatgtctggtcgcagtttgtgaatacaacattcttgggggccttagaattggacagtcttaacagttcacatcccattgaagtaacggtaaacgatccttcagaagtaaatgaaatttttgacgccattacatataacaaaggagcttcagtcatcaggatgttggttcactttttaggaaatgatacattcaaagcaggtatgactttataccttaacagatataaatacggtaatactactactgaggatttatggaaagctttggaggaggcgagtaaggaacctgtttcagatattatgtcgacttggacgaaacagatgggatttccgttaattaaggtagacaccagatatgaatccggtgacatcatagtaaaactgtcccaagagaagtttatgtcgacaaattgtacatctccccgagaattcaaatggatggttccaatatctatctcatccagtcaaaatcttgatggtgaggtgactaagttacttcttaatacaaagtctactgaaattttagttcctggagttagggaaacagattggataaa

SEQ ID NO: 18906 - DNA, 188 bp, Diabrotica virgifera
  misc_feature (95)..(95): n is a, c, g, or t
ctcgctcgccctaatatttctaaagaagatacgacaacagacataattgtcttaaaaaagggattcaaacgattgaatgtttttcgcccttgaanaacttttttacatcgacaaaccaacatttgtgtttgctactggcgttttatattttacagaataataatatctatgtattacagaattttttt

SEQ ID NO: 18907 - DNA, 470 bp, Diabrotica virgifera
  misc_feature (99)..(117): n is a, c, g, or t
  misc_feature (153)..(171): n is a, c, g, or t
  misc_feature (207)..(225): n is a, c, g, or t
  misc_feature (386)..(386): n is a, c, g, or t
ctgataaccaaactgatgctcctcaaccaaatgatgataatactacagcagaaaatagtacagatggacaaacagatgctccacaaggtaacgaaaacnnnnnnnnnnnnnnnnnnnctgttgatgctgaccccgcccaaggtaatgacaatnnnnnnnnnnnnnnnnnnngtggtaatgccgaagctgcccaaggtagtgacaatnnnnnnnnnnnnnnnnnnnatggtaacgctgaccccgccgaaggtaatgaaaatggatctgctgcagagaacagtggtaatgctgatgcggctcaaggtaatgacaacggggcagctgcagaaaataatactaatgcagatacccaaaacgacgccgcacaaagttccgcaaatgatgcnaatgcagaaagtaatgctgatgcccaaatggtgctgcacaaggtaaacgacatggcgctgctgcagaaacactgaaaacgctga

SEQ ID NO: 18908 - DNA, 212 bp, Diabrotica virgifera
  misc_feature (3)..(129): n is a, c, g, or t
  misc_feature (131)..(210): n is a, c, g, or t
atnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 18909 - DNA, 766 bp, Diabrotica virgifera
  misc_feature (66)..(82): n is a, c, g, or t
  misc_feature (295)..(329): n is a, c, g, or t
ccgcaatctgtgtagtgtcgagtaagatttgctcttagatgcggtgaaaaagtaggctactactannnnnnnnnnnnnnnnnagtgggcctgttgcagcatttttgtcgtaactcgatacagatcgactttttttgtcaccgtcctgtttaaataaaattccaaaatggtgatatgtatagaaatagacgaaaacaacattcctcaaatacaacttggagagcacttaatgagactagatgcagaagaactcggacccaaagacaagaagagagcagaagaggagataagggaannnnnnnnnnnnnnnnnnnnnnnnnnnnnnnnnnntagagaattcattgaagcggaaccagactttgatgtacctttaaacgacgacacttttttgataaaattcctaaggccgtgtagatatataccagaaaatgcctttaaaataatgaaaaggttttactattttaaagtaaaatacccaaaatacggttttgatatcacaccggcatcaataagacaagtatttgacacagaagtattcaggtttttaccaacaaggacatcgaccggttgtagaattatgaccgtaagtttagatcactgggataccaagaaggtgagcatggaacaactgtttaaggccgtaatggtaagcatggaaatcgccatgttggagccaaagacacagttagggggcgtccatgtgattttagataccggaggtttgtccttaatgcacatttgtcagttttctccctccatagcaaaac

SEQ ID NO: 18910 - DNA, 615 bp, Diabrotica virgifera
  misc_feature (180)..(200): n is a, c, g, or t
  misc_feature (528)..(548): n is a, c, g, or t
caaaggcctcaagatgagtcatttaatcataaggtgcattttagcacttttcttatttcaagccatttcggcgtatagaaaaatatcagatgttattaatgagaaacgaagcataggatataaagaaggcacactagaaaagagaagcgatgatgactttaacctttggctatcgagggnnnnnnnnnnnnnnnnnnnnngaggtggtaaccatgatgatgtaagaaaaagaagcgatgacgacttcaacctgtggttatcgagagcaaacgaggaagaaagagaaagaggaggtaaccatgatgatgtcagaaaaagaagcgatgatgatttcaatctttggctatcgagggccaacgaggaagaaagagagaggggtggtaaccatgatgatgtaagaaaaagaagcgacgacgacttcaacctgtggctatcgagagccaacgaggaagaaagagagaggggtggtaaccatgatgatgtaagaaaaagaagtgacgatgactttaacctttggctatcgagggnnnnnnnnnnnnnnnnnnnnngaggtggtaaccatgatgatgtaagaaaaagaagcgatgacgacttcaacctgtggttatcgagagc

SEQ ID NO: 18911 - DNA, 230 bp, Diabrotica virgifera
  misc_feature (10)..(110): n is a, c, g, or t
ttacggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttcctcaaagggggcggctgaaaacacgaaaacgatggaagggcgtaaaaaaaccggggggttgaaatagaagcgggagaaggggaggaaacacaagaaccgctaaaagaaaaaggg

SEQ ID NO: 18912 - DNA, 789 bp, Diabrotica virgifera
  misc_feature (10)..(35): n is a, c, g, or t
  misc_feature (130)..(157): n is a, c, g, or t
  misc_feature (187)..(206): n is a, c, g, or t
  misc_feature (268)..(289): n is a, c, g, or t
  misc_feature (434)..(457): n is a, c, g, or t
  misc_feature (502)..(518): n is a, c, g, or t
  misc_feature (520)..(540): n is a, c, g, or t
  misc_feature (670)..(710): n is a, c, g, or t
gaaaaaccgnnnnnnnnnnnnnnnnnnnnnnnnnngttttctcataaaggttgtcacgaggtggacaataaaatcaaaactgtggaaacgtttcattcatctcaaaaagaaaaatctacaggtaaacacnnnnnnnnnnnnnnnnnnnnnnnnnnnncgaaagttaagactggacaaaaaccttatnnnnnnnnnnnnnnnnnnnngcagttttctcacaaatggtttttgaaaaggcatgtaagagtacatactggggaaaaaccannnnnnnnnnnnnnnnnnnnnntgcagttttctcagaaaaatagtttgaaaacacatttaacgctgcacactggagaaaaacgttacaactgtgaaatttgtttaaagcagttttctcacaaatggtttttgaaaatgcatataagagtacatactggggaaaatcnnnnnnnnnnnnnnnnnnnnnnnnctcagttttctcagaaaagtaatttgacaagacatttaagacaannnnnnnnnnnnnnnnngnnnnnnnnnnnnnnnnnnnnncagcaatttagtgaatcaagtactttgaaaatacatttgagagtacacactggggaaaatccttataagtgtgaaatttgtttcaaaaagttaaacaatgcaagtcgtttgaaaagccatttgagaatannnnnnnnnnnnnnnnnnnnnnnnnnnnnnnnnnnnnnnnnacatttttagtcagcaggttcttttaaaactacatttgagagtgcacactgtggaaaaatcctacaagtgtgaaatttg

SEQ ID NO: 18913 - DNA, 715 bp, Diabrotica virgifera
cgcccctctcgccccactctagcccgaaaggagatcccagatacaccgtggtaaggctaaggctttcccaaaataagatccctcaaaacatgaccacttgacccgcttcataagatacttagctgttatgacccacgcgataagagagcgcagacatgacctgcgatctaagatctgctaagaataaattgtacaggctgtgacaattttagtaaacctccacccatgccaattgatgttgttgtagcttccatcgaaactccacatgtccttaaggttttagccacagcatgggctgagcatctctctgaagattgccgcaagcgctcctacaagaactggtacaatagcatgaagaaggtatttaccatagcttccgcagaaatggagtgacgatttaggattacataccatcgaaaaggacttaaacaagattgttagatactgcaaagatgttagagtaattgctcatactcatatgtgattgctgaaacaacgacaaaagaaagcccgtattatggaaattccattgaatggtgggagggtagctgaccaagaaacttgggctatagaacatgatgaacagcctatccctattgccaacgtttttgctcaacatggactgattgatctgcataggtgttactaatgggcatggagacaaaagagttccttctcgatggcacacaaatacattgacccgttaagaccccaa

SEQ ID NO: 18914 - DNA, 821 bp, Diabrotica virgifera
  misc_feature (152)..(171): n is a, c, g, or t
  misc_feature (739)..(756): n is a, c, g, or t
gataaaaacacgcgttagtgctatactgggtggtgaatcatcaaacgggccataggagattcaatgtagaattctaaactgttgaattacttcttccctaaatattttacatcaaaagtcatgggaacatatttgtagaggattgaaatctnnnnnnnnnnnnnnnnnnnntggtttgcgatttgaacacattccggggttttgaaaaatataacacatttgccacagtaagtatgtatgtaaacgttaggccacacgttaatgtttaactgacagtgcgcacactattgactgaataaaacatctttattattaatactttctcctcaactgagggtatcttattaactttattgttttttaaacaataaatgataatataaaaatactgacagtttaaatatggttaatataattaattgtgaccgcccgcaaccattatacacattattgcactgtgtgtggcctaacgttggcgtgatactctgaaaaatgaattacatttttacaaaattttggaatgtgtgtaattcgtagaacaattttaacagtagttttcaatacagatttcattcctctgcaaatagtttctgatgtcttttgatgtttttgaattttgcattgagtttcctatggctagttttccaattaaccattcggaatatagctgattcttacactcaccggctcgaaacacggcaccctgataatttctgacgattgacctgttctttttttnnnnnnnnnnnnnnnnnntttgagaagcctttaacacgatttaccagaaattactaaagatagtttttgaaatctcttgtaaa

SEQ ID NO: 18915 - DNA, 1178 bp, Diabrotica virgifera
  misc_feature (859)..(926): n is a, c, g, or t
  misc_feature (930)..(952): n is a, c, g, or t
  misc_feature (959)..(973): n is a, c, g, or t
  misc_feature (975)..(997): n is a, c, g, or t
  misc_feature (1000)..(1027): n is a, c, g, or t
  misc_feature (1048)..(1073): n is a, c, g, or t
  misc_feature (1083)..(1103): n is a, c, g, or t
  misc_feature (1112)..(1153): n is a, c, g, or t
  misc_feature (1163)..(1177): n is a, c, g, or t
tttcgtccgaggaacaacagtttcagtgaatttaatccaggcacaaaaaagagaaaaaaacgaatgttcaaagtaaaagatatgaaaaaaattaagaaatccaaaacaatcatagaggataattcacaagacagtgacgaaatgtattctgatcatttatactgtaaacttagccctgataccatccagagtaatgatagcacggcaagtaaccctttaagtataaatactaaaagaactgtagatgaagctgaagttgacgtaataagtgcatcaagagatgtaaatagtgaaaagacgcagttaaaaaagaacataattagtcttattaaaaaattaagtgaagacaatttggaactttatgatacaaacacgttggctcaggttcagaactctttaagtgaatgttgttgttttttggggagttatgaaattgctgcggatggtgaatcattttctgatgacagtagtgatgcgaatcctcctaggatatctactagtccacccaaacttgtttggtttcccatgaaaaaggattaaaaggagtagtcaaatgtctgttaaataataaaaagatccaagtcaaagatgattccttatgttttcgtaaaaccgggttggcatacaatttattatgaaatgataatttttcggtttcatgacatctcttaacgcgacagttcctaaccccagaaatagccaccggcaattcgtaacgaactttcttaacggtataatccgtaaagccaacagcggtttttatcaaatttacaataactggatatattttgcatactctcctacccgaaagaaatagccctttttttaaaacccccttcttttaaattctttttcccannnnnnnnnnnnnnnnnnnnnnnnnnnnnnnnnnnnnnnnnnnnnnnnnnnnnnnnnnnnnnnnnnnncccnnnnnnnnnnnnnnnnnnnnnnncggggannnnnnnnnnnnnnnannnnnnnnnnnnnnnnnnnnnnnttnnnnnnnnnnnnnnnnnnnnnnnnnnnnggttatcccgggtgggggccnnnnnnnnnnnnnnnnnnnnnnnnnnctccggcgcnnnnnnnnnnnnnnnnnnnnnttccccccnnnnnnnnnnnnnnnnnnnnnnnnnnnnnnnnnnnnnnnnnntctcccaacnnnnnnnnnnnnnnng

SEQ ID NO: 18916 - DNA, 848 bp, Diabrotica virgifera
  misc_feature (11)..(53): n is a, c, g, or t
  misc_feature (404)..(422): n is a, c, g, or t
  misc_feature (483)..(500): n is a, c, g, or t
  misc_feature (655)..(681): n is a, c, g, or t
tttgcgtccgnnnnnnnnnnnnnnnnnnnnnnnnnnnnnnnnnnnnnnnnnnntttcctaaaccacattcaaatagcaaattctcaactataaacaaacgcacgtgttactattcaccgtatcattcgtcaagaggctgttaaatgtaatttattgccctaaatgaggcggattctcattttacaggtccaaactggtcagtctgcaaattcaaattgtaggtagcgtgttggtttttaagatacacttcaggacgaccctgtttagcttccatgcgcgtttgtttacagttgggaatctgtaaaatgaatggactgtagagactatgcgcggcccaaaaaaggacaactctaccttatcggtaaagtctacgagatgtgcacagtaaattgaaggtggaaatnnnnnnnnnnnnnnnnnnnatgtatgtctttgtactcactttatattgctcaaaaaattacggaatctggatttcaatgnnnnnnnnnnnnnnnnnnctcgtatcaaagttgctcgtgaagttaggcgtgttgatgacagttgcgattttggggtcgacacagagactatcagttcgtctgtctcagtatgtataaaaaataataaaacacttatcttagtgagttattgacgtggcctttgttaaaactgnnnnnnnnnnnnnnnnnnnnnnnnnnnccaaagtaggtcaagcattgacacgattgccatggtcataaaggtgataagtgtgtggttaaagtgatattgcacccgcgagaccaatggtaaaagtggcattatagcggtaaaaaatgaatatcttaactctccccccccccccaattattaccatagcatcaact

SEQ ID NO: 18917 - DNA, 873 bp, Diabrotica virgifera
aaaataataacaaatttgttattaatattgtgcaattatacaggaaaacgatgattttaagcagatcgaagcctgctcttcaaactgtcaatgactacactaaagaatctggaaaaagtaatgttaaaccatcatcaccctttgaggattatctgaaaaagagggattattcaggagctattactttattaaagttcaatcattttcctgaaagcaagaaagccacagtagatgagtggttagcattttgtgcatttcatagaggagattacaaaaaaaccttaagtatctacaaaaatcttttatctgttaatccagaaacggagaattatttagtaaatgcagcatgttgtttattctacttaggcatgtacgaagagtctaaagaacttttgcaaacagctcctcagagtggattaaagactagacttaacttccatctctcccataaattaagggacgaggcaactctaatggaatatcaccaacaacttcaggatattttagaagatcaacttagtttggcagcaattcattatttgagagctcattatcaagaagccattgacatttacaaaagattacttttacaaaatagagaaaacatcgctttgaacgtatatgtagcactttgctattacaaactggactattacgatgtttcacaagaggttcttggaatgtaccttaacagatatcctgattcggtgatagctactaatttaaaggcgtgtaacacttttcgtctttataacggatctgcagcagaaaatgagctcaaaaatataatagatccaagtaatcatgttggttttggatatgacttgttgaaacacaatatggtagtttttagggatggagagggagccatgc

SEQ ID NO: 18918 - DNA, 966 bp, Diabrotica virgifera
  misc_feature (935)..(935): n is a, c, g, or t
ggggatttggttagtatggatggcgtgtgaggatcaaatttggagattagacctcgtgttagtaaaaatgtgtgacttttgaattatggatcaccaaacctatctaggagtgtttgggaataaagaaggtattaatccaatggggtttacagcataacatcatcgtatcacacgccatccatgtgaaatcttaaataacacctcgaaacaccaagaggccaatctccatccataagtcactgggagtagttacttggggaacaagccttttgggggcattccagctccttttcgtattagcacttggacctacaggaggcatgatttttgcactatcctagtgctcatttccggggatgcgccagcaacctatttaggagtcgttcgggtttgtttgggaactaccagtgggtgacattagtaactattgtgtgtttatctcctatgttttattttaatgcactgtttattaattttgtttcagatttagtttacctagttatataacatatttgtatattatggtattaagttcccaaactcatgtatcattttgcggtactgtacgttgagctctgcgtatttgcccaaaaggtattacttctaatattttattgtttatttaggtcgatttcatgtcattatgtaaatttaggttgtattatttgcttgtttcccaaatattttctttattcgctttatttcgtttgttcggttaattcgtcgttactttatttcattgcatttgctcggttaatttaggtcattgtttcggtatttattttagcttcatttttataacttgtattaattcattttgcttaattcatcatgtattttctcttcgtcaggcttgtgcctatttatttatatcttagtcatattttttcgggttttaatttcagtgtacgtagcaagcgtactataaccattgngtagaaatctcatgtgagctgtaccctatat

SEQ ID NO: 18919 - DNA, 205 bp, Diabrotica virgifera
  misc_feature (2)..(33): n is a, c, g, or t
  misc_feature (35)..(88): n is a, c, g, or t
  misc_feature (90)..(135): n is a, c, g, or t
  misc_feature (137)..(156): n is a, c, g, or t
cnnnnnnnnnnnnnnnnnnnnnnnnnnnnnnnntnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnncnnnnnnnnnnnnnnnnnnnncaagaagaccctaataaggtttaacaaaataattaataaggtttttttg

SEQ ID NO: 18920 - DNA, 734 bp, Diabrotica virgifera
ggaagttttgttttttggttgatttgattgagtttattttttgtgagatataaaacatttaaaatggcccaatctctatttggttgggacctgctgtatagcagtgttgaaaaagatatacaaaataaccaggatatcttagtttgcctaactcatcttgtcctagtctcaaatggttttagatgcgttggtttgggtgagtctaaggtgttggatggtgacgaaaaaaagtccgaatcgctaccaaagcattggaacgaggatcaaaacaattattccataagatatgtatatcaaggaaaactgtacctcttaaaagcaaccaacctagatgatgcactaatggttaacttaatcagagttgatgaacggaccgtgtcatttttacagttaaacaaacgagatgttgccactaagtcaggcagtttagataacatgattccgaagcacaaggatattgttgatcaaataaaaactcaacttattgataaagttatagtttccaccaaatcaaaagagactggtgttcagactgaatgtcaaagtactagagacagagacagaagtactggattattaaactcaccagatcacagaacagagagaattgattttccgtatagagctccagtatatggacaagatgatttacatcccctgggcataagaccattgcctcgaatgcctcttggcggtggtgggggaggaatgctgttccaacctccaggtccttc

SEQ ID NO: 18921 - DNA, 474 bp, Diabrotica virgifera
  misc_feature (306)..(325): n is a, c, g, or t
  misc_feature (424)..(441): n is a, c, g, or t
  misc_feature (446)..(463): n is a, c, g, or t
tttcgtccgataactatgaaatacatagtagtttttgtggcgttcagttgcttagtttgtgtagtatttgcacaggagacaacatgtcctccaaattcgtactcagcttgtgctccttgctgtgctgacccatcttgccaagagagaaacccaatttgtgataaagaaaaagtttgctcattcatctgtagaccagattgtagatgcaatgagggatacattaaagatacagtcagtgaaaaatgcgtgcttccagagaattgtcccaaaagctaaggaagaaaatatttccgcaatatgtaaaannnnnnnnnnnnnnnnnnnntcaaaccacttcaagttattttacaatcctatgtacaacggttcctgcctgtgagttccgtcaaaaaaaaaaaatgatcccacctgggggtggaaaccnnnnnnnnnnnnnnnnnntcaannnnnnnnnnnnnnnnnncattctaaggt

SEQ ID NO: 18922 - DNA, 770 bp, Diabrotica virgifera
  misc_feature (11)..(33): n is a, c, g, or t
  misc_feature (85)..(103): n is a, c, g, or t
  misc_feature (364)..(383): n is a, c, g, or t
  misc_feature (643)..(643): n is a, c, g, or t
  misc_feature (673)..(673): n is a, c, g, or t
  misc_feature (720)..(720): n is a, c, g, or t
  misc_feature (725)..(725): n is a, c, g, or t
tactgtaatgnnnnnnnnnnnnnnnnnnnnnnngctactgaaagagcaacacgtgtaaacactgcccgtaaaaagactactgcgnnnnnnnnnnnnnnnnnnncgaattggaatagttcttcagaagcgaatacttcaaaagacaaaataattagtccaaataatccggaaaacgctcaagctccgttgaaagtgagtccaattagtattaggctcggagaggaccgaaataattttaaagtaactcctattagtatcaaactcgctgatgatcgcgcaaagtttaaaattatttcagactcatctaaacgcaaaagggaaagtagtgaaaataccgaaacaattacggtaacaaaacaaagcnnnnnnnnnnnnnnnnnnnnatcttcgagtgactttacgtccgacaaagaccaaactaatccaacattatttgaaactttaggattaaaacccagtcaaccttcatctgaacaaacaaatacttataagtgtaatatttgcttatcagtgcagaaaaacgcaaaggctcttaaacatcattatagagaacatttttgttgtagtttttgtaaaacaagatttagactagttgaacgtagaatatctcacgaaaagaaatgtactgtacgtcacgctttanatagtaaaccatatgtcaaattaactagangtgagttgataaacaaatatcccttacatagtggtaattctgtcatncatanaaatagtgtagattgtaacgaaagtatagtattatccgacgatga

SEQ ID NO: 18923 - DNA, 702 bp, Diabrotica virgifera
  misc_feature (313)..(330): n is a, c, g, or t
  misc_feature (339)..(356): n is a, c, g, or t
  misc_feature (589)..(606): n is a, c, g, or t
ggagtggcatccactcccagggtaaaagcgcaagtttgccatgtggcttttgtttcttgaggtatcctctagccactcgccaattttcatgaaaatcgatggaggctcaccgaaatcggaggtaatagttgattttcaccttcatacactgtactagaagtaggtcgtagaggtatactgaacctaatacgatccgttggcttttcgagcggtagtaagtgcataagggcacgttcacgcgacaagcgcttaacgctcgttaagcgcttgtcgtgtgaacctaccctaaaattccctaggtaattaaaacatnnnnnnnnnnnnnnnnnncaaatgtcnnnnnnnnnnnnnnnnnntttctacgagctccgtcattgtgaatattgtatatatgtttatagtgattaaacgctataaagagaatgtctgcgcatgtgaaatcctctagatttgtgataaaacccattggaaattttaattactacatatttgtcatggccattttagttttttgaatacaaaatgaaattaacttatttatttactatttaaaatccggctcgaaggaccagatgtacctacaatgcannnnnnnnnnnnnnnnnnaatataattcgattgccctatggccaaacttctcgatcgacgacgtggaataattccaagttatggagtaataatgatttattgtccgctaattta

SEQ ID NO: 18924 - DNA, 725 bp, Diabrotica virgifera
aactacggcgacatcggcgtgacctggcgcctggcccggcaattggtggcggaacacggttgtggggtgcgcctgtgggtcgatgacctgcgggcgttcgaacgcatgtgccccgagattgatgtgcaggtgcaccagcagtggcaagagggcgttgacgtgcgctactggccctccgactggccggcgaccgacgcggcagacgtggtgatcgccgcgttcgcctgccaattgccgcctgactatatggaagcgatggctacgcgcgaacgcacgccgctgtggatgaacctggattacctgagcgccgaggattgggtcgtgggttgccacggtttaccgtcggtgaaattcaaaggcgtgcaaaagtacttcttctttcccggattccgtcccggcaccggaggtttactgcgtgaggcggggctgctggagcagcgcgatgccttccagcgagacgccgctgcccggcagcagtttctgcaggcccttggggttttcccggccgccggcgcgcgactgatgtcgttgttcgcctatgaaaacaccgggctggccagttggctcgacgtgctggccgccgatgggcgcgccactcatctgctggtgccggaagggcggatcctcggtgacgtgcagcgttggctgggtgtcgagtcattgaaaacaggcgacgtgcaccggcgcgacgggttgaccgtgcaagtgctgccgttcgggcgcca

SEQ ID NO: 18925 - DNA, 715 bp, Diabrotica virgifera
  misc_feature (487)..(514): n is a, c, g, or t
  misc_feature (607)..(607): n is a, c, g, or t
aacatattgtagaagaccgtcaccgccaatacaaataaaataaaaatctttcaagttgttatagttgattcgctgatctgagacacaactgtctacgctacaatcacaataaaaatgcactatttagaaataaacaaaccaagacacgttgaatgttctaggagcgctcccaaatcatgatttgggagtgctcctcgtgcttgtttattttctaatgcatctttattgtgattgtagcgtagacggttgtgtctcaggttagcgaatcgacactaccaggatttttgctttgcgacttaagagatctatcccaggcaaccaaataacgttttcagaacgttgaaaagacgtcataattatcaccaaaccacgtcagtttgtcacgttttttcgacgtcgaaagtcacgtgaatatgccccaccataactgacgtcgtttttatcacgttttaaatacgtgatataaaaaacgtagtttttatctcgnnnnnnnnnnnnnnnnnnnnnnnnnnnnggattttaaaatacacaataataattattcgtgtgggcgttgttggtattgcaatttttcatttaactgttctaaatttagcttataggctanaagtaaaaccaaatggaagactataaaatgcatagaattacaataggtaccctcaatgcaacattatcgaatttttactttttatatacagtccatctaatttactta

SEQ ID NO: 18926 - DNA, 874 bp, Diabrotica virgifera
  misc_feature (684)..(684): n is a, c, g, or t
  misc_feature (735)..(735): n is a, c, g, or t
  misc_feature (754)..(754): n is a, c, g, or t
  misc_feature (803)..(803): n is a, c, g, or t
  misc_feature (846)..(846): n is a, c, g, or t
cggacgcgtggggtcctctgcctgttttgatggaatggatcctttggcgttaacgtgcgacaataataaatgtgtctgcagtgataattattatgaccgaggatctgactgtaggataaaatcagatgaacacaaagcatgcgcaataaacagagactgcgatcccactcaacaacatggactaatttgtcatctgggtatttgtacgaacccaaacaaattaggagacgatacaatgctgatgacagacgaagaaagttacgacgaatttggacctctcgaacaattgttgatccagaacaatgataaaagaactgatgaatgtgaaagggatttagattgcagttacatggcaaattctatatgtgatggtacaacaaaaaactgccgttgcaaaaatgggaattactttacttttgaaggcaactgtttaccaggattcagcgcttgtgatacgcagaacgatatctgtgcaaatgatcaaaaaaatagctattgctttgggaaaagtttgaatggaacccaaggcgtttgtatctgtaagccaggatatttcttttacaaaaaacagtgtgttcctgaacttggcgtaccagatcctgatttacagaaggatactgactgtaaaattcgaccaggaaaagtattcgatggtgcctgttattgcaaagactattggtttgnagatagaagcaatagaaattgtatttaaacaacgctgcagcagacctacangttgttaacgaacgactgntgtaaatgcatgggtccatactcgtactgcaactccagtattttgtgtncatgtagtaatccccagattttgacgaagagaacttttactgncatgccccagcctttgatgttgagtgct

SEQ ID NO: 18927 - DNA, 226 bp, Diabrotica virgifera
ttccgtccgaaatttctgtgtatattgcattgtttttcagtccgataaaaaagcgacttgacactaagcaaacgataccaaggctggaagatagactgctcagattttactaactgttgtctctctatcggactttaacactctcattagtactatcttataccggttttacgatacgtatcaccttgagaaggcgaggcccagctattatcatcaataatggtgc

SEQ ID NO: 18928 - DNA, 533 bp, Diabrotica virgifera
  misc_feature (405)..(417): n is a, c, g, or t
  misc_feature (420)..(436): n is a, c, g, or t
ctagttctagatcgcgggcggccgctcaaaaaataagataaacaaatataagaaaatttatcaacctgttttcaagtttgttttctagacagtaaaatatttggtatctatgcacacgaaactccgattttaaaagaacccatcttagcgacatgggttaagtaaatagtagcactaaaacagtattttgtacaaatctatgtgaatatcagataacacgaactaagtgtgacaatttgcactaactacctaaatatttcaaaggtacgccactgaatgaatttcgagcttcctaacgtttcgtcgctctgcagaatcgggtaacacaagccaaaaatacgtaatttcgcacgccacgcatcacatacttgaacgtcaagtaatactcaatagggaacttgcatnnnnnnnnnnnnncgnnnnnnnnnnnnnnnnncacaacagaacatgtaatttaaaacatatatcaaaggtaaaaaaagttttgttttggcttgcggttgggcccctaaagacgattaaaaaacttcaaa

SEQ ID NO: 18929 - DNA, 739 bp, Diabrotica virgifera
  misc_feature (20)..(20): n is a, c, g, or t
  misc_feature (449)..(449): n is a, c, g, or t
  misc_feature (469)..(469): n is a, c, g, or t
  misc_feature (582)..(601): n is a, c, g, or t
  misc_feature (691)..(708): n is a, c, g, or t
  misc_feature (712)..(736): n is a, c, g, or t
cttcataacggccgaccagncgagcaagggcagaaaacaccaaccttttctggaggacaccacgcagacaggaaaaagcaccgaggcacaacccgaagaagcaacaaagggcagagaagaatgcacgaaaaccacaaccggcgccgcggaccaagcaaacaccaaagaaagcccagcagcaacaccaaccagccccgccaggaaacaaagacggcagaaaacccaaacaaacggccgcgcagagaaggccaaagaaggagccaaggagcgagacgacgccacacaaaaccaagcgagggagggcaggaagaaaagagagaccgaaagacacgaccacccgcgaggcaacaagggacgcgggaccacgacccaccacagacgagagccgagccgacggagggacggcgaaggcaacgcaacggaaacaggcaacaaaaagagcaacaaanccaaagcaccacaccacganaaagccaagccacaggaacacagcagggaaagcagcgcgaaagagaaacgcaggacagaaaacaacccaagagccgcccccaggaaacaacggccaaagcaccaccgaacacnnnnnnnnnnnnnnnnnnnncgggaacgacaagggaccaggggcagacaacaacaaacaatcataaaacaagccccgccagccgagacgaagggttaaatgacgtcaaannnnnnnnnnnnnnnnnnttgnnnnnnnnnnnnnnnnnnnnnnnnnctt

SEQ ID NO: 18930 - DNA, 761 bp, Diabrotica virgifera
acaaatgggtgtactgatgttcctccaccatgagatggattaaattaacttctaaagaaattgattttgataaccactctttaacccctgctcggcgactcaattgaacgaccgaacgatgtctctctcctcatatgcaataagcacctgatcgatgagtagcactatttatgattcagaatattatctcctttacatcctctctgtactatcctataactgtatgctatttccatgaaataataaccttaaaggaacttctggcataccctgacactgttatccataacataatatgctatactccactctcaacacatctagaaattgataccgacacgaggattgccattaagaaaaaactgctgattatagatatactcttatattgtaccttgtatgtacaatcgttatcaaaaacccacattatagaaaaatcaaatacttttaagttcgatatgcacgactcctcataccactatattgatttttattatgtttactatgacctacaaccacgaaactctacaaataacatatatggaactaaatgaaatgtacgaagattgaaaagatgctatgcccactatatctcaaatatactatatgacatatttagagcatatcataaaaaacactctgagagtatatccttcatctccctgtatataagcgacaatcaacagaagatatgtaatataatatgcatctacttcattatgtcttgatactatagtatgctacttatgccatgcatctat

SEQ ID NO: 18931 - DNA, 509 bp, Diabrotica virgifera
  misc_feature (6)..(335): n is a, c, g, or t
  misc_feature (352)..(389): n is a, c, g, or t
gaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttacggataacagnnnnnnnnnnnnnnnnnnnnnnnnnnnnnnnnnnnnnntgcgacctcgatgttggattaaagcttataattggtgtagcaactatattattaagtctgatcgacttttaaaattttacctgatctagaatttaaaccggtgtaacacaggtcggcctc

SEQ ID NO: 18932 - DNA, 779 bp, Diabrotica virgifera
  misc_feature (13)..(38): n is a, c, g, or t
  misc_feature (85)..(106): n is a, c, g, or t
  misc_feature (272)..(286): n is a, c, g, or t
aaaagcctgaggnnnnnnnnnnnnnnnnnnnnnnnnnncgtctacgcccctacggaactgggagaaaactatgagctgaccaagnnnnnnnnnnnnnnnnnnnnnngtctaaaactggactgggcatacgggtacagaggaagagactgcagatccaatctatattttctgcccactggggaaatggtatattttgtggctgctttggtagttttatataatcccgaggaacagactcagaggcattatacagaacataccgatgatgtcannnnnnnnnnnnnnnaccccaacaagatggtcatagccacaggtcaaactgcaggccacaatggagttgaaaaaagagcccatatccgtgtttggaattcagtgtcactgtctactcaagcggttattggtatgaacgactttgaactgtcagtttgttgtctgtcttttggtaaggctgatggttcccttctagtagctatcgacgaggcacctgatcatatcatttccgtttgggactggcaaaaaggagagcatggatataaaattactgaaacaaagtgttcagtggacaccatcgtagctgctgagttccacccgctcgatagaaacaccatcgtcacgtgcggcaagtcccacatagccttctggtcattagatattaacggcaccctattcaagcgcatgggcatcttcgagagccgggataagcccagatacgttacttgcgtcagttttctgcagagtggggaagctataacgggcgattcccagcggaaactttggca

SEQ ID NO: 18933 - DNA, 717 bp, Diabrotica virgifera
  misc_feature (468)..(511): n is a, c, g, or t
agtacgagatgtctcacaaaaagctcagtgcaccccgtgatggatccatggtattctaccccacccagagatccctgagacaccgggaaagggtatgggttttcccaaaacatgataccctctaaacctgtccacttagcgaccttcatatgtcacgaagctggaatgacccacctgggatcagaagttaacacacctgtatcctcgatcaactagaaccaaattgcagaggatgtaccgattttggttactccacccatgaatagttggcggatggaggccgtatacatcaagactccacgtgatattatgactttagccactgtatgagctgagcatctctctgaagattgccggatgagcttctactagaactgaaacaaagaatttgacagaaggtcatttaccagatgcttcctactacatatagtgatggattcatgaaatagagtgcatcgattgggactnnnnnnnnnnnnnnnnnnnnnnnnnnnnnnnnnnnnnnnnnnnncatactcaaatgagattgatgcaacaacatcaaaagatggtcgcacttatatggaattcaattgaatgtgtgctgtgagtgacgaaaatatcttgtgctaaagaacaccttgatcagtctattcctattgccaacgtctatgctgcagatgacttgatggattgcattgatgttactagaggacatggaacgcatgtgttacttct

SEQ ID NO: 18934 - DNA, 934 bp, Diabrotica virgifera
  misc_feature (511)..(530): n is a, c, g, or t
  misc_feature (560)..(579): n is a, c, g, or t
  misc_feature (817)..(817): n is a, c, g, or t
gtttatgcttgcgtaaaaacaaaaattcgttttctccaggagaagttgaagttgaatatgataagcaaagacgtaatgctgtatttcaaagtggaattgacatatctgatcaaatacacttagaccataagacacaagacgaagaacaactcataagaaccgccatagcaaacaatgacttcatcaccaaaatcttatttggaaacatccttaagggtgtcattccggccatgtataaaaggaatataaaagctggcgatgtgattataaaagaaggcaacacaggttcccatatgtatgtctccataacaggaaaatttgaaatatccaatcaaaatttcatagatacctttgaagatgttagggtgttcggcgaactggctatcatctatgatgctaaaagattagcgactataaaagctctaacagatgcagaaatatgggttttggatgcagtcacctatcaacaagtgctgaggagatacaacgtgaaagaacaagaagaaagggnnnnnnnnnnnnnnnnnnnngatattcttaaaaacgctggagaaaaggtnnnnnnnnnnnnnnnnnnnncattaaaatctgaatcctttgttggagaaaaacctattgtaacagaaggggaaaaaggtgacaaattttatatcgtccgagcgggaaccgtcactgtaacaaagaaaggtgaagactttatccaaacgcatgggaaaggttactgcttcggtgagcgagctctactggaagaaacctgcagacaagctactgtcactgctaatcccccattggtggagtgtcttaccttatccagaanatccttctttgaacttacggaatatcttaaagttattccaccaaaattgtccgtaatagaaaaacctaacatatatcaggatattaaactcgatgatttaaaaatttgttttacgtt

SEQ ID NO: 18935 - DNA, 102 bp, Diabrotica virgifera
  misc_feature (6)..(101): n is a, c, g, or t
aaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 18936 - DNA, 361 bp, Diabrotica virgifera
atagatgttagaagtggacgcaaatatgtaattattagatggttaagaccccagctggaaggattgatttaggaaccccatactcctgagtatgagtttttgaacatgcaaaaggtcaaattattgcctctgaactaagtaactgaaccactccatcttatgtggaatgtcctgactactgacctgtcatcgaataggctgccaagagcaacgtacccatgaacccctggaactgaattttggaagccattcgaattattgagggtcgcttttgtgacagtgctgcacagactgagatgatacattggccatttgaatgagaaaatgatgcagctagaccacccgattatcagttgcatac

SEQ ID NO: 18937 - DNA, 904 bp, Diabrotica virgifera
aattgctcaggacagatatcgatggaaggacctggaagaggcctatgtataaaaatggacgccaaaagactgagaagaaataaataacaaatgagaggaagaagaagtgaagcagaaatcttgaaaagattgagaagaacaggaaaaggacgatgatttctatagtcatttactttcaccagattaattcgatagtctttccacttgtagtattctgacaatactcctttataatcgaaacacaatagactcaaacaatttgcttcatatagatgtagcaatgctttccgtagttcagtaaaacgatataatcttggtaaaagaagaataatgtagttggtcgaactttgaatcaatttttttacgcgtataatgttgtacggtgaaataaaagtataatacaatagatttgagtgcaaaaagtagactgatgtttctttacgcactggaacaagtgccgaatcttttaaaatataagttaggatatttttataccaataggtagcaaacagcagttgtagactgttatgaatattaaagttgtgaaaagaaggtaaatatggcggcaaacttagaggtagcttaaatttgttgggcatatcacaataaaatagatctttttattatcttgaaagataaacaataagctttaagtacttaagaaggtgatttctatgttggtgactagaattatcgtttagcgtaaattttttggtagatgagtcctagttttcttctattctataaaacagatttccaaaatgttctacagcatcttaatcagaaattacccggttttgatctaaaagagagatatgtttagctttatttgtacttaatacttcggcgatctgatcaattatcttattgcagacccttcttctacattccctgatgagtatct

SEQ ID NO: 18938 - DNA, 734 bp, Diabrotica virgifera
tttcgtccggcctcgcttttcgtatatcataaaagtacctacttaaatatgtcgcttaagacggattttcagaaaatctttaatcatttcggaaaaagtaaggaaaacgttactcatgatgtcgaaattatcgagaattggatcaaaacacggaatcatttgccgaaaataccagctgccacaacgattacttatttcttagcaaataactatttcagcatagagaacaccatacaatcgctagatatgtattactcagtgagaaaaattatgccagatatctatccaaataatcttcctttatcatcgactacatcggatttgaatgaagaagtgaccgcggtaccactaccaacgccgactccaaatttgcatagagagattttaaacgaagttgatggcaatcccgataagatagccgaggaccaacctatagaatcaatgattcatcttaatgaggtaaagatgggggaagatcttgcacttggacatatttatggtctggattacgatcatgataaactgggacatgtagggaaagctgccccacagatgtttccaaaaatggattttatctgggaggatatctgcgacgatcacagtaacgaaatgcatattaataatgctcctagtgtagctgatgctctaattacatttctgaggacatatctgtatagacgattaagagaccgagttttcgatcataattctctaaatgatctttaaaaagatgt

SEQ ID NO: 18939 - DNA, 872 bp, Diabrotica virgifera
  misc_feature (582)..(601): n is a, c, g, or t
aaggtctcgaaagagcatcagcatttgaatgaactcttccgactagttgtgtggtgtttcaagtcaatatctaaagattttcttacacaaaaaacactaccgaattagacggatgttaccgaccaacaatgctgttcaaaagttcacacgtgacaccactaacgattttaaataaaatgagcggttctaatttatataaactatttaacttaacaaaactaaactaactaatcacagtgctcctgacatatacctacaaaaatacattatcctagaacatcccgaacaggcacatctctattcgttgctaacattgtaggtatgttctagaatgccaaggtcactattccgaacgctgaaaaaggtatattctggagcgccacggtcattatttcgaacaacgcgaagattctcgtatatgcgtcatcttgctgccgaatagtgacacatacgggatacgtctaaagataagcaatacagtgtcgctgaaagtcaaagggttatcacacaagatgaagattacttcagttttattagatcagaaaattaccaagagagtatataagaaatggagtggagatnnnnnnnnnnnnnnnnnnnngcttaacaacaaaatgtagcaatacgcgacaactgaggaacaactgttgccaaacaatggaggaacaactgaaacagatataaataatagactaagaccgttgattgaaatattaatacgggctaagaccagatatatgtcaagaatagatctggctagggatatgctaaacaatgcatcggggtgtaacgtcgatatcaagtacggtggtctagctgtctttgtctgtcgtgcgagtgtgagcgtatctaccaagaggtgggaagtaatg

SEQ ID NO: 18940 - DNA, 843 bp, Diabrotica virgifera
  misc_feature (629)..(663): n is a, c, g, or t
  misc_feature (815)..(815): n is a, c, g, or t
gaaattaattattatcctccattgtcgttaaatgtctgttataatattccttttgactaaaataattgaagtgtccctttagtaggagagtatcagtaaggaaaagttatctagggtacctactttgcagtttatcatagaaacccccttttctgcttttggtttagaatttaggactatatataatatacttgatacaataattatttacgtcctgtaattaattttaggacaaatatatcctctcttgctatcttgtttatccacgtcgttatggaataaaatataattgcacagcgtttttaccctttttaccgattccttatattctgcagtgtacacaacatggcatttctggtgtaccttaagtcacatataaatattacgaataaaaaggtcgctttttaaaagtcgcgaagcttgcgaagttgtaaaaaattaaaccattttgacggtggaaaccattagcgaaaaaataatattcgcttcaacttacacatcatttggacactgaaactttgtaccgtaatatactaaccggatattcactagatataaattcaagttttcacctagaacagttttgtctggtgtggcaagaagtataaatattagcaagagataggaannnnnnnnnnnnnnnnnnnnnnnnnnnnnnnnnnnttccaccagcactccacagcaataacatacttcattatcgcataagttgctgtgatggccacaaaaacgttggttctatacccaaggtgtgatagaataaataacgaagaatcttagccacactcggactactataatattacttaaatgtnaacagtacgtctctatcagtaacacatc

SEQ ID NO: 18941 - DNA, 753 bp, Diabrotica virgifera
  misc_feature (2)..(752): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 18942 - DNA, 956 bp, Diabrotica virgifera
  misc_feature (345)..(370): n is a, c, g, or t
  misc_feature (405)..(418): n is a, c, g, or t
  misc_feature (421)..(435): n is a, c, g, or t
  misc_feature (654)..(671): n is a, c, g, or t
  misc_feature (896)..(896): n is a, c, g, or t
gtagcatcaaaatgttatccaaattgttaatatttgtatttgctgctgtttttgtcagtgctgaaatcaatagcacagaataaataacaacacagaagcgaatctgactgtcgtttccattgattttgttgggaccgaaatatttgaccttgtgcaccagttacagaatagaacttgatgttctaaggaatagaccattccaaattagaattccactgaagaagtttgaaaagccgagggatgcacttaacagaaatggactaaaggaaggattattagccaaatacaatagaaatgtcaatgacgatagcgccgtcgttttaactaactatttagatgctcaannnnnnnnnnnnnnnnnnnnnnnnnntcctgctcaaacctttaatgtaattttcgacactnnnnnnnnnnnnnnctnnnnnnnnnnnnnnnaatgtggatttttggaagttgcttgcttacttcataacaaatacgatgccgataaatcttctacctatgtgaaaaacgacaccagattcgcaattgcatatggttcaggggaagttgcaggacttatttcccaagatgttgttgattttgggggtttacaagctaaggatcaattatttgctgaagctacccaggaacccggtttagctttccttgtgnnnnnnnnnnnnnnnnnnttaggaatgggataccctgaaatttccgttaacggaattactccagtatttaattcactggttgaacaaggcgctgtgcaagaaccagtcttctccttttacttgaacagagaccctgatggagaagttggtggtgaattgttgcttggtggatcagacccaaactattacaaaggtgactttactttatgtagatgtttcagctaaaggctattggcaaagtgntatggacagtcttaaccgtggatcttccttaaactatgtttcaatggatgtcaaatatcg

SEQ ID NO: 18943 - DNA, 456 bp, Diabrotica virgifera
ggcaaaacccgcatcgtcacctttaccccaatcaagggcctgccttcggtgaactggtacctcggcctgtcggtggataaagacaaatccttcgccatgctcagtgaattccgcacctcggcgatcattgccacgatcatcgcggtggtcatcatcatcgccctgctgggcatgctgatccgcatcctcctgcagccattgcacatcatgacccgcgccatggaagacatcgccgacggcgagggcgacctgacccgccgcctgaccatccagaaccacgacgaattcggcgtactcggtaccgcgttcaatcgcttcgtggagcggattcacacctcgattcgcgaagtgtcctcggccaccgagcacgtcaatgaagtggccctgcgggtggtcagcgcctccaactcctcgatggttaattccgacgagcaggccaaccgcaccaacagcgta

SEQ ID NO: 18944 - DNA, 237 bp, Diabrotica virgifera; identical to SEQ ID NO: 9225
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t

SEQ ID NO: 18945 - DNA, 961 bp, Diabrotica virgifera
  misc_feature (73)..(101): n is a, c, g, or t
  misc_feature (103)..(115): n is a, c, g, or t
  misc_feature (887)..(887): n is a, c, g, or t
  misc_feature (898)..(899): n is a, c, g, or t
gaaaagaagaataacattagaaaacattcggtaacctcacttttgaggtgtgtcaataaattagtgtagttgnnnnnnnnnnnnnnnnnnnnnnnnnnnnngnnnnnnnnnnnnntcgttaatgctagaactgaatgaagctgttttaaaaaagacaacaaatctttcctttttgaatgacagggtgtctggatataactggaatgaaggattacattatgataaacttctgcaaagttacctaaaaagtggatttcaagctacaaattttggtctagctgttgaagaagttaataaaatgttggagtgtagaaagcagccaattcccgaagaaaagtttgtggataatgacgatgaatttacagttgttaagaatagttgtacaatatttttaggatatacttctaatttaatatctagtggattaagagaaactattaagtttttagttaagcaaaaaatggtagactgtatagtgaccactgctggtggtgttgaagaagatctcattaagtgtctcgctcctacttttgtaggcgactttcatttagatggcaaaactctaagagaatgcggcattaacaggattgggaacttattagtgccaaatgacaattattgtagttttgaaaattggattttaccaattttagatgagttgttgaaagaacagaaggatggtgtgctgtggactcccagtaaaattatagaaaggctaggaaaagaaattaatcatgaagatagtgtttattattgggcagccaagaataagattcccgtgttttgccctgcattgactgatggtagtcttggtgatatgatgttcatgcattctttcaaaaacccccgggcttgtagtggatattattgcagatttaagaagactnaatctaatggnncatgaatctgtacatacaggaatgatcattttaggaggtggccttattaaacatcacatctg

SEQ ID NO: 18946 - DNA, 938 bp, Diabrotica virgifera
  misc_feature (94)..(121): n is a, c, g, or t
  misc_feature (156)..(173): n is a, c, g, or t
  misc_feature (180)..(198): n is a, c, g, or t
  misc_feature (275)..(293): n is a, c, g, or t
  misc_feature (340)..(376): n is a, c, g, or t
  misc_feature (529)..(556): n is a, c, g, or t
  misc_feature (613)..(635): n is a, c, g, or t
  misc_feature (675)..(692): n is a, c, g, or t
  misc_feature (781)..(808): n is a, c, g, or t
aaaccttacaagtgtgagatttgtttgaagcagttttctcagaaagctaatttggaacaacatttggtggtgcacactaaagcaaaaccttatnnnnnnnnnnnnnnnnnnnnnnnnnnnngtcacgcaagtgttttgaaaatgcatttgagagtnnnnnnnnnnnnnnnnnnatacacnnnnnnnnnnnnnnnnnnnaaatttaatgaagcaggtaatttgaaatcgcatttgagggtgcacatcggaaatggagaaaaagtagaaaaatctcnnnnnnnnnnnnnnnnnnncaagcaatgtattacagcaagtgaattgaagatacatttgagaatannnnnnnnnnnnnnnnnnnnnnnnnnnnnnnnnnnnngtatgaagtttagtgtagcaagaagtttgaaaatacatttgagagtgcacactggggaaaaaccttacaagtgtgagatttgtttgaagcagttttctcagaaaggtaatttggaacaacatttggtggtgcacactaaagcaaaaccttatnnnnnnnnnnnnnnnnnnnnnnnnnnnngttacgcaagtgtcttgaaaatgcatttgagagtgcacactagggaaagatcttatnnnnnnnnnnnnnnnnnnnnnnnttttcctaatgcaggttcattgaaaccacatatgagagtnnnnnnnnnnnnnnnnnngtacacgtgtgagatttgtttgaagcagttttctcagaaaggtaatttggaacaacatttggtggtgcacactgaagaaaaaccttatnnnnnnnnnnnnnnnnnnnnnnnnnnnnatcggacaagtcatttgaaaacacatttgagagtgcacactggagagaaacctcacaagtgtgaaaatttgtcttaaagcaatttattcaagcaaataatttgaaaaaacattcgagagtgcacactggg

SEQ ID NO: 18947 - DNA, 801 bp, Diabrotica virgifera
ggaaattcccagggtgcgaccctcttgcgtccgtattcgggttagcacaactaactaactgtggtgtgtggatgtagtgtgtggtttttacataaaacagtgagattaggaagctggattagctggagtctgttcagattgtttgtgtaggtggttttgatgagtttagcgattggaaagtgacagtgtcaacggaaccaggcgatgggattacagcacgccttgtcaattttattgctaataaacatctttaatgcctatgggaagttaacaggagatcatatatgcctaacagaaaagctgtatttagctaatgtaacagagacttatttgaaaaatgtaattctgagaaactacaaatggtgtctaaattttccaccaagatgttcgttttacaccaataagcagatttctgctaccagagtcgtggaaaagaatcaaaccaaagtagttgaagaatgctgtgccaattttgtagaaaaagatgaacagtgtatatcttcatgtcctagctgtatcaatggaatatgtgaaaatggacattgcaattgtgtagctggcttcaaaggaaacagctgtgagctagtgtgcagtaatggcgaatggggtccaaattgtgcaagaacctgtgaatgtgacagccgctcttgtgactctattagcggagtttgtatggagcgaaggtctagtacattcacccgaaaactcccaagacatcgtctacagtatccacaactgtaactaaaataactaccgggcccgccccctccacagggcccaatatttacccaaattcgcaaa

SEQ ID NO: 18948 - DNA, 575 bp, Diabrotica virgifera
gctgatgtacatttataatatgtagactgtgtagaaggccgatacagggaaagtatagcatgatttactacaagaaacccgtagtccataagtgttggatacgttaggtaataaatagaacaagcaggatttcaagagaaacgagaaatggacttacttctcctttgcttacgtgtctactttgtataagatatagacttcagttgggagacgaagagtctgtgattggcaagtccgatcactccagacctaagcgtgtacccgacaggtccaatgttcttaggaagtaggataagatacggatagagttcagcgtacaccaacggaatgaagcagttgaccatactctgatggatatcattagaggaatactgaagagaattcgccgtatcgtattgactccgaatgaaataacatcacgtatactgaatcccccgagtaatgtataaaacctaccctcagacttctctgataccacagaaagaacttctcaaactgttaagacatagtataggtaatttaactccagacaaaagtatataacgacggggatgacttattatctatttacccgc

SEQ ID NO: 18949 - DNA, 269 bp, Diabrotica virgifera
ctgttttatttcttctctgtatattttattcatttcttttacctcgttaatcagttccttcttatctttcataatttcagctgcattctcgtgtattaattccttgataatttccttaaattgcataatttcttcattaggcatggtcatcctgatttatttgcccttatatcagcacgctgtagtgggggctgtctatatgtccagctgaagataacgtccacagaggttctctcgtcagaggttacttacctatacagattcgttgg

SEQ ID NO: 18950 - DNA, 446 bp, Diabrotica virgifera
atagacttcagaatagattaaatcaatgttttttataggttatataaattgaagtaactgaattctttagaatattaaaaaatgtgataaacacattcaaacccccaaaaaaacctataaaaactgttttttgatttttgaagttagcgtaccttacggaaaaatctgaaaaaattagaaatatagtgtttgataaaatacaccaaataaaaagaactacagctacagcagccatctccaaaaaatgatatatgctttttccccccaagaaatttatatttgactcttttttaaatgcattttgagggtttgctcagctcatacctacccatctattaaaaaagagatggatcttaaaaatgaggaaattattttgaaattttacaacatgttgcgtttcctcttacaaagtaaaaacgacacaatgaactattggatgttgggaa

SEQ ID NO: 18951 - DNA, 843 bp, Diabrotica virgifera
agaaactagttgtcatggcagccaataaaagtttcaattttgtttacaaatgtctgatttaaattttaatcatataattttaacatcaaattaaatatcaattgattttccacaacatggaaaacattgaaggaataaataaagaagaaaagatttcttctatcaaaaaaatgtgtataggtttacaaagtgaagacagaaaagtaagaaaacaaactttgattgatttagaaaagtttttaagtagcaaagaaaatgtattcagtaaccaggaattgcaaactatatttgttgatatacatatacacgttttaaatggcttaagagataaggccgagggtgtccgtgaacaaactattcattttttaaatgtttttctaatagataaacttccaataaatgactattacctgacgtatgtaattccaatactagtggaaagattaggatctgtggagattatagaggaatctgaagaaataaggcttcagctagttcagtttctaaatgccataatcgtaaagtactctaatactgcccagcttgtcccctttttaaatgattctattattatactagcagaaagtgttaaggataaatacccagctataaaagaacttagctgccgaacaataataaatctttctattgcattacctagagatttccacaaacaagccgaatcattagtaaaacctgtgctaacatgtttttctcatcagagatataaagtcaggatagaagcaataaaatctattggggaaattattatgcatagcagttataaagctctggatgaagctgtaggacctcttgctgagaactatttgaccagattcctat

SEQ ID NO: 18952 - DNA, 320 bp, Diabrotica virgifera
ttgcgatcctggcgattggatacgtcaggcagcaagatactggcccctttcctagagaatcgcgccatctatcataattacaacataaattgttcactatggaagagtgtgaaagcattttgcttcaaaaggaactttggaaacgatgggaagagaatattaatggtagaatgcaatatattggtgatatcactgaggatatacaaccatagataaatatgaagtggcacttgtattgcgacatcgagatctaatgtggagagtgtagtctttaccagcaccagcgtttgatactgaaacgaaaagggatgggagaaaac

SEQ ID NO: 18953 - DNA, 390 bp, Diabrotica virgifera
caggttattgaccgatttttggagaagaccctcaaagttggtaccaagaatggatccaagcgatatggttcggacagttctttgacttcttcgtcatcgaaaagtagcacctggagttgcagttccaaaaatgcctgcaacaacatcttaaaataaggctcttagttacgcataaccctggaataagattatggtgtccaaagtggcccaatgaaaaaatttttgctgttgtgaaatgaagaatcattcgtgaagaacgtttttgcgttttgcctttgacgatttgaaaaaaaatcattcgcagtcaaaaacaagctgatatgcttcaagattattttatttaccgtgtaaataaacactacatgaataaaaataaagaaattgtttctt

SEQ ID NO: 18954 - DNA, 896 bp, Diabrotica virgifera
cttagaacagagatcgcaaatcagcactctaaatcgacgattttcgactctaattggagtcatcatcagagaggcgtaggtttgctgctctctgccccaagtgacgaaactccaaagagcttatccacgcattgcaactgtcgtctatggagtaggtgtctagctacatctggcaactgaaagtcaaagtttttaacctaatagaaatattaaaaatattcctaaaagatatttagttgaaaacttattggaccattttcctggtaacacctccatggcttctaaaaattgcaagccagatggatgctgaagcgaagaagacaagagggaattcaaaaacttacaattcacgaccccgtctgttcagctggtaaatcccaacgaaaatggacctagttacttaaaggagtaaaactaatataaaatgaaataaaaatgtataccatttttattcagttgcaatgcgaaggcaaaactgtcttatttttcacttagaacagagagcgcaaaccagcactctaaatcgacgattttcgactctatttggagtcatcatcaaagaggcataggtttgctgctctctgctccaagtgtcgaaactccgagaacttatccccgcattgcaactgacgtttatgaagtaggtgtctagcgacatctgacaactaaaagtcaaagttttcaacctaatagaaatattaaaaatattgagaaatattaaaaatattcctaaaagatatttaattgaaaacttactggatcattttcctggtaacacctccatggcttctaaaaattgcaagccggatggatgctaaagcgaagaagattgcagctgattttgcaagggaagataaaagcaaagaaactcgggggatcgaaggacgtcatgcctg

SEQ ID NO: 18955 - DNA, 1200 bp, Diabrotica virgifera
  misc_feature (198)..(216): n is a, c, g, or t
  misc_feature (481)..(503): n is a, c, g, or t
  misc_feature (961)..(983): n is a, c, g, or t
  misc_feature (1031)..(1102): n is a, c, g, or t
  misc_feature (1113)..(1169): n is a, c, g, or t
  misc_feature (1176)..(1198): n is a, c, g, or t
gagtgataatttagtgatacagtcaaaatgactatatacttatcagtatgttgtatgatagttactgtaagatgtctaccagaacccatcacacaaataccaggatatacacaactatctgagcaacaggttaagcacctccaaaataggggttttggttccacgataaaaacttttggaccaacagaagctaatagnnnnnnnnnnnnnnnnnnntacgaagatgatgaaatcgatagtgaagcagagtccagtcaagatcgtgctcccacatatgccaatcaaaactatccagtacccataaaagcaacgctccaacctataaaagcgactttacaaccaaacaatataaactatccaattcctgtaaggacttcagttagtaaaggttatcctacgcctgttccagaaaaaagattccaacaacagaagcagtaccttcgaaggggggaagaactgcaggccatcaataaactagagnnnnnnnnnnnnnnnnnnnnnnngccagacagactttctttactattgccccaatctaaatttacttgtagtggaaggaacactggatattacgcagatgaagatctaggatgtgaggtgtttcattattgtcaagaaaactctaagcattcatggatttgccccgaaggatttactttccaccaggtacatttgatttgcatgcctccaggaggagacaacatttgcgagaaatcatccgactaccattttgttaatgatttcttatacaaaccagtaaatcttgaggaataccagcaaaaacctaatataacattaaggtattcggataaatattaccccgaacagaataaaacaaagtataatgaagacgacgatgctccagtgcaacatcaacactcgatttctgtaactggaccacacgctttccatatggtttcacccaacaactttgaaaacctcaaaaagttttacggatttnnnnnnnnnnnnnnnnnnnnnnnctcccaccaagaaccgcccggccccccgccagcccttcttcccccaannnnnnnnnnnnnnnnnnnnnnnnnnnnnnnnnnnnnnnnnnnnnnnnnnnnnnnnnnnnnnnnnnnnnnnnccccccaaaannnnnnnnnnnnnnnnnnnnnnnnnnnnnnnnnnnnnnnnnnnnnnnnnnnnnnnnngggacannnnnnnnnnnnnnnnnnnnnnncc

SEQ ID NO: 18956 - DNA, 230 bp, Diabrotica virgifera
ttttggagttgtccgccagcggaaagctcaccgatcaatggcttgtgttcgccggctacagctacctgaaaagcgaactggtggacccaggcttgaacggccgtaacggcgtcgtcagtgccggctcaaacaaaggcaaccagatgcccaacacgccgaagaacaccttcagcctgtggacaacctatgacgtgacaccgaagctcaccctcggaggcggcgcgttctat

SEQ ID NO: 18957 - DNA, 1100 bp, Diabrotica virgifera
  misc_feature (16)..(39): n is a, c, g, or t
  misc_feature (255)..(278): n is a, c, g, or t
  misc_feature (291)..(308): n is a, c, g, or t
  misc_feature (342)..(364): n is a, c, g, or t
  misc_feature (590)..(610): n is a, c, g, or t
  misc_feature (689)..(708): n is a, c, g, or t
  misc_feature (773)..(822): n is a, c, g, or t
  misc_feature (949)..(949): n is a, c, g, or t
  misc_feature (988)..(1026): n is a, c, g, or t
tatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnnngtgtaaatttaaccttcttccctcacattttttaggataataggaatacctcgacgaataacgatatcctgatgtattatataatgaaaaattgaatcttctattgattcctaatttctttattggnggattattcttaattttattatttgagaagttttttctnnnnnnnnnnnnnnnnnnnnnnnnnnnnnnnnnnnnnnncttcaatgaaagaataaaaatttaacccccccccctgaaccccaaaattttttgaattggccaaaattttttct

SEQ ID NO: 18958 - DNA, 74 bp, Diabrotica virgifera
  misc_feature (3)..(60): n is a, c, g, or t
gcnnnnnnnnnnnnnnnnnnnnnnnnnnnnnnnnnnnnnnnnnnnnnnnnnnnnnnnnnngatcccattttttt

SEQ ID NO: 18959 - DNA, 454 bp, Diabrotica virgifera
cattctttcctaagtatgtcaccaacgttgtgagtcattgaaatatgcaagcacagagatgaccttcatggatgcgcatcagaagcagccacgctcgccaaatcttcttctctcgtggcaaccccaccgacgaagtcaacctcgaaaccgaattgggatagatccgtgatgatgcaccatatgaaacaaaaactgctatatacaaacctcttgatctccgtgacaatgacctcggagaataccactggagtagggacaaatctgccatcgacaacatcaattaaataatcacacctgaactgatcagatcatgtcagaagataccgcacaagcaagacgagcactatgtcatgttcaaactcaatggtaccgtagacaaattcccctagaggaactaccctcgcttggatgtgacattattcctgtacaaagcccctacccgcccacaaaacag

SEQ ID NO: 18960 - DNA, 488 bp, Diabrotica virgifera
cccttctgcgtccggcttgtatgcagtgcaacaaggttggttgcatttagcaatttcacgtgacttgtgctcaaggattaggacttctttgcgaagaagccggaaactatttggataacgttaaatattgtggctattgccaacatcattacagtaaactgaaaaaaggtggtaacgtcaaaacgattcctccctacaaaccagttgccaacgaggcacacaactccgactccaactccgagaaggaaccggagggaggcccttcgaactccaaaatcggagtctccccaccctcgtccggcaaacggaaagccatccaaggaggcagcaaagcgccggcgacaaaaaactccgggaaaaacactaactcccaacaacaacagaaaaccgtccacaacaataataaagctagtgacaaaactaaagtgacagtgaaaggtagtgggaaaagcgaggaggctcctcccgctgataatacggaatcgacc

SEQ ID NO: 18961 - DNA, 837 bp, Diabrotica virgifera
  misc_feature (96)..(113): n is a, c, g, or t
  misc_feature (474)..(490): n is a, c, g, or t
  misc_feature (637)..(637): n is a, c, g, or t
  misc_feature (804)..(821): n is a, c, g, or t
acttcatgaagcagatgctaagcttaaagatgcaggacacaatattcaaagcgcatttgagaatactacgaaaagtgcaaacgactttgctaaccnnnnnnnnnnnnnnnnnnagggtggactccaacaatttggtcagagcatagacaacaaactagcagagacggggaaattgttccagaataagatgcaggactcagctaatttcttagataatacacgacacgatttgaagcaagaagccgaagaaagtaataaaagaatgcacgcggatttggacgatgcggcagatgctgctaaaaatatatttggaaagggattattctctaaaaaataaagatattcttcagggaaaatcaagtgagagatgtgttatggtcaattaaaaataggtccaagatgttatatttgttgttaattttataagatgtttgtgttagtatacgctacattatttattttttacacagcttnnnnnnnnnnnnnnnnntaaacaaaacaggttgcaagcaaaatggcctttgtgaatcaggtcatcgatcgattatggccctaaaaagaatatctagtattgctaaaatgtaagaaaaaaaatccagaaatgtataaatagttttaaataataattacttacggngatatagcactaattttatcaaataagtttagtctgtttaaacaacttcatgtaacaagaggccatttggttaaatgctagagctttatcgcattcttattaataataaaaaactgctatccagcatatcccatagagaaagttattgctatatttacattacagcnnnnnnnnnnnnnnnnnncagatctatgtaccta

SEQ ID NO: 18962 - DNA, 221 bp, Diabrotica virgifera
atcacacacgtcgctcattccatccattccaatattttataaaaaatgaactatattttagtaacgagaggtgttattaatgccgtagggaaaggcgttatacctaacttatttggagctatattaccatgatgtgggatcgatcagacatccagaaacatccaccctatacagcaatgaggatgctggaaaattgtaaccttatgaagatgacgaactat

SEQ ID NO: 18963 - DNA, 912 bp, Diabrotica virgifera
  misc_feature (2)..(909): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtg

SEQ ID NO: 18964 - DNA, 581 bp, Diabrotica virgifera
aacagctagaaaaaaacggacgaagaccgctggatataagaccgctctaacggatttcttacgggaaactaccggctccaatcctgttctacatattctcgaatctcatatactatcgaaacgacaaggaagaagatcatgatgaaacgagaagtgggcttttgccgagatgcccacggatccaaaggctccagaagatcatgatgatatgaccagtaccgtccctaagccaacaccattctgggcttatcttgcaaagttgtctgactgcgcggatgcttatcgagctccccctgttgtatgtaacatgaagatacacaatatgaaaaatcctgaatacggcagtaggaggagaccctttagcgaaagagcctggatatatcgccatctactcacctaacattgattggaagcactttcccttcacgaccccctgaatgatctacactatggacgatacagggatcatctctaatgtataatgatatgcgaacaggtatagtgtgcatgaatactggctggcgaccacatcgcatggatgctctgggcgattgcaggccagaaccgaggagatcttcaga

SEQ ID NO: 18965 - DNA, 907 bp, Diabrotica virgifera
gcccataccattccggaaaagaagtggtttatggaaccaggcgttatcattctactgggaggtgtactgccgtttgccagtatcttcatagaaatgtacttcatcttcacgtctttttgggcctacaaaatatactatgtatatggttttatgctgttagttttcattatattaatgattgtaacagtttgtgtgaccattgtttgcacttacttccttcttaatgctgaagactatcgctggcaatggacttctttcctggctgctgcttctacgtccgcttatgtatacgtatacgccatatactacttcttcttcaaaactaagatgtatggactattccagacaaccttttactttggttacatggcgctcttcagtggagctctgggcattatgtgtggtactgtaggatacattggaacgagtatatttgtaaggaaaatatactctattgttaaaattgactgatgttgttgtgaccatttttgtaaataggtgcatttttcgttatttaactgttcacaatgtctttcacattaaacgatgtttttacttttatttgataataaagttcctataaatgcttaacgtgtagttcagtgtatgataggttaagtttcttatcgaatataaaactgtgtagagtatcagtaaatattgtgttaaatgtaaactctgacctgtatatagtccatcagataccatacgaaaacgaggaagtagaggctagtgattttctgaccatttgggggaactttgtatcccataattttcataatctttttttattgggaaagacattccctttacaggcgagtatgcctatgctaaaataaagttaatgaaaagtagggaaactggtcttttcttatgggatggaaaaaattgaatttaactccccctt

SEQ ID NO: 18966 - DNA, 133 bp, Diabrotica virgifera
tcttcacagtcttcttcgtctatacgctgaagcgtcgtatcttcgtggggatcccccatatctttcggaaccacgctagctaaagtcttaatactaaatacttacatcgctcgttcgcgcgtttgttgagttt

SEQ ID NO: 18967 - DNA, 829 bp, Diabrotica virgifera
  misc_feature (758)..(758): n is a, c, g, or t
gaatatggaaaaccagcatacctgtgctttgtatatttaaaaagtgcttttgacagggtgaggcgaaatgttatcttaaatttattacaagctgaacaaatagaccaccagataataaggctaattaaggaaattaacaagaacaacaagaccagagttataatgtcgacaggagaaacagaacgcatagaactaaaaggaggaatccgccaaggagactcgctcagcccattgttattcaatatgatgatgaataaaataattcacgaagtcagaaaacgacatggataccacatgggagcgcataaaatcacgatactatgctatgccgatgatgcagtactaattgctgataacgaggatgacctacaaaggcagctccacactttcaatatcacagcaaataaatttaatatgagaatatcggtagaaaaaactaaatgtatagtgataaataaagagccgcgtagatgcaagttagaaatagacggcaaaattgtagaacaagtaatgaaattcaattacctaggagtagagatcactagtgacaggaatataagaacacaagcgacaaaagcggcaagagtaagtggttgcctccgagaaaccatatggagaaacaaatatctgaccacggaaagcaaaataaaagtatacaagacaacagtaagacctatcctaacatatgcagcggagacaaggaccgatacaagaaagacgaaacaacaaatcaacaatatcgaaatgaaagtattaangatcatagcgggcatatcattaagagacagacaaagcaactgaagtatacgagaacgttgcaaaattcaaa

SEQ ID NO: 18968 - DNA, 760 bp, Diabrotica virgifera
  misc_feature (36)..(54): n is a, c, g, or t
  misc_feature (467)..(485): n is a, c, g, or t
  misc_feature (546)..(546): n is a, c, g, or t
gaagaaatcatccgagaaaatcacatcgatgaaatnnnnnnnnnnnnnnnnnnntatgaaagcattactgacagcaatactgaagaatctctagacagtaaaactaaagaaacttacacagaatttttataccacagcaaaacagagagcaactattacgagaagtatacagaagtcgtatccaaaaacacagaaatcagtaacagagaaaaagatacggaaacagttcctgctgagatagtgaagaatctgaagagtcagtttcttaaaggagatgcagaactagtgtctgctgtatccaaaaaggaaatagaggatgttagtcagttgaaaatggtcaatattataaagcaaattaataagtttgagcttaaggataatggagaagcagctgacgatgatagcaccgtaactgaaacttacacagaaaccaccacgatccagtccgatacacccgaggagaaggnnnnnnnnnnnnnnnnnnntaaaaaatcgaggaaggaggaaaaggaaaacatttcagtgaatggcgatttagtgaacggngattattgctataatgtgaatgttagaaacttgtgtagaagttttggagacttaacaaaaatccccgacgacactagaagcaaatcatcatctatatggaatactgggcgatctaagtctttatcggatgtcttgctttcatctaacaaaaaaaaatatcgagaatgtcttctccggagtatctgtaaggccactgaaagaaaagtttacatct

SEQ ID NO: 18969 - DNA, 240 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(237): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnatc

SEQ ID NO: 18970 - DNA, 1105 bp, Diabrotica virgifera
  misc_feature (1034)..(1063): n is a, c, g, or t
  misc_feature (1077)..(1097): n is a, c, g, or t
taaaaatatgtatattacaattggtcaacgtcgatagatttaaacattgttcataaaaaaattattatctataacatacctaacacattgtaacaaaacatttcgttcatgcctaatttcattttgtaaaagtttttctaacaatgtaactttcctttttctgaaactgtacggaaatttatctttactatgactcacatgaggtttcgtacttctaaaatggtctttgttatgatttttatttctatatggttgtcgtttccttttacgagtacaattggaaatttctacttcatttttatctatcacagcatcttcatttttctgtttttgatttttgacttctgttggaggttctccatcactatctgggtatttgccttcaattttaggttcttgtttattagctggtgtcgcttttacaattgtggcacttgtttcttcagcttcagattcgctatcactcatatatgctcccattagagcactaagagcaccatttaatttcatttccatcggtttggatggcccactactccattcttcatcgtcatagtcgctgagctccttttctttttttcccttcgatggcagaggtacctttaaagggaaacacatttccattccaatcagctttttcgtctattagagatacaggttgcttctctttaacaaatgaacgcttttgttttttctttggaagttgcttcttggtttttacagcttttggcaatcgatgtttatcctttccaaatccaatggcgttcttttttatcctttctcctcttttcaacatggcttcctgtttaatctgcttttcataaaattctcctttactgagaataatcttcttcctaccttccacccactttaatataattttctggagaatttaaatttctaattcctgccataaaaaccggaaacaattgtggcattaaaaatgggccttccccaacctttttttcattaagcccaaaaatgaacttcccgctaaaataacaaattttgggttggagaaatatggttttgcnnnnnnnnnnnnnnnnnnnnnnnnnnnnnntaacaacattctcnnnnnnnnnnnnnnnnnnnnncttttttc

SEQ ID NO: 18971 - DNA, 374 bp, Diabrotica virgifera
  misc_feature (225)..(239): n is a, c, g, or t
cggtccctttaacgtccgaatcttaagatgctacgaaattttcgcccctttatggcgatgatagagatgtggaaaatcatagttggggagttcgcacgccactaataccgtagacccatttctttttaacatgttcgcgagagggaacttcgaggacgtccaagacttcaaaatgcccccacacgatgacatggcatggaaatagacaactgcagagtatttgcnnnnnnnnnnnnnnnaatacgctgcaaaagggaacggcacatgaacaatgtccatacattgacacggttaaaatctctctaatgaatccagaacgaaacaatagaaaaaaaattcctgaccgtgagaaatgttcaacatgcttttaagaa

SEQ ID NO: 18972 - DNA, 855 bp, Diabrotica virgifera
  misc_feature (519)..(519): n is a, c, g, or t
  misc_feature (533)..(533): n is a, c, g, or t
tacattttgaaaaagcatatcttattcaaaaataatcctagaattttttataatacaccatttttaagtaaacagaataagctttctttttattatatagtctctacctaaatgtagaaaaaaaagttatagtgggaaatttggggaataatcgtgaaaaatataaaggctcgttggaagtataaagtcttgaaagggataacctctttagaagaagtcgtacaacattgtacagtagaacattttgagggtgattgatttctgttcctcttacatgtaccattgcatgtgcctgaagttacgtggaagagagttacagaacgatatttgcgagataacaaggagcattgcccggaattgctgtgagtggcgagctttgaaaggtcatatttcgagggctgtgggtcctaatggtctctgccaagcaccattttaaagacaaaatgtgtgagttttttttctgtgaagcaatgtctatacctgtgtccccgtggacaggggttgtgggacaaagacganattctttcttttgngtttctttgtgctttttctttgaatgtattttgtagaaagggtatctttgatttgagagttatatttggatgggaaattaaccaggaacaattattgtgtagacgtgtttgtgccgggggtgcgtggaactcatcctgatgtgacctgtgcccggggactggttcacccatttctcgggaacgcacccctttgaatggtggcactccgcggttttttcatgtatggaggttcattgagcatatgaaataataaagtcccgttaacgttgtagttcccttctaaagtaataatcattagcctataaccagatttcatctgggt

SEQ ID NO: 18973 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18974 - DNA, 920 bp, Diabrotica virgifera
  misc_feature (13)..(36): n is a, c, g, or t
  misc_feature (114)..(133): n is a, c, g, or t
  misc_feature (855)..(855): n is a, c, g, or t
cacatgtatttgnnnnnnnnnnnnnnnnnnnnnnnncctcttttgagtttaaattacatttaaaaactttacaaaacttttagtaattttataaacctacaaatcttaatttannnnnnnnnnnnnnnnnnnngtttctaacctgtctataataacctgactttttataactggaaaggttaactgcactagatccttcctttgctttagtgttagtggtacatccttggatccatgattttcgttagcactagctagtgtagcgtacactcaactacactcgagggtactacactagaaaacaaagaaacggacctattattagtggtttgtggtgtgctcctctctctacagtcacacagtcctgctcgcgcttattgtctttaaaatcgccgattatgactaggagccataacatttgtgcagctagaaattgttgtaataacgctgaaaaaagttgtatcagcttttttcttttccgagagatgttaaaagctatggaatttaaagctgaaattcaggaacagttcgttgaacataaccaaatatacgaagagggcaatccatccacgtcaagagattttaatgccgtgaaaagtgaaataaaaattgaaattaaaaaagagtttgatgaatgtgaccaaatatatgcagataatcagctatcaacatatacagatcttggtgatttaaagaatgaactggaggaagatatctcaggtttttctgagaataatacaacggaaatagcacattcatgtaataaacaacaagagaaacaagaccctgacgaacaaacattaaaacatattatttcttctgaaagattttcttgcaaaaataatgtagtggaanaagattgacaaaaagatctttacaaatggtgacattttgtttttaagaaagtttccccccaaaaa

SEQ ID NO: 18975 - DNA, 962 bp, Diabrotica virgifera
ccttaataaaaacaaatgtgtcattgctgctaagtcagtcaagtacttggggcatatcatcactacttctggggttaaaatagatcctgaacgggtcagagcaattagagaattcccagaaccagaaaataaaacagaacttttaagattattaggtatgattaattttgcgggtaaatatattaaaaacaaatctgaaattttagaacctttaacatctcttctaaaaaaggactcagtattcttatggggacctgctcaaattcaagctctaaatactctaaaaaaatgtttagaaagttccccaaatttatcatattttgatgcgaacaaaactattgttgtaaattcagactctagttgttttggcataggaacttgtctgatgtaagaaaatctagataaatctcgcgaaatagtggcattttcatctcgattattaagtcaagtagagggtagatacgcgcagatagaaaaagaagccctggcaattacgtgggcagctgaaaagtttgctgattatataacaggggtcaaagatttgatttttgaaacagactcaaaaccccttgttcaaattttacagacgaaaaatgtggatgaattatctcctaggttgcagcggtttcggatgagattaatgcgttacaattataaagtagtttacatcccaggaaaacagttggttgtgtcagacgcactaagtcgaagtcccataaaaaattctgtacctagtaatgatgagttgacaggtattgaagtcgaggggtatgttaaatcggtaatccgtaatttacccataaaagatcggtttataaagcaaataatcgaggaaacaagcaatgaccctgttttacaaataataaaacatatacgttgacttcatggccagaaaagtctaaaattcctgtgcatgttttgccatattttcaattcagatatgatatatcattttgtgaaaa

SEQ ID NO: 18976 - DNA, 867 bp, Diabrotica virgifera
  misc_feature (121)..(157): n is a, c, g, or t
  misc_feature (683)..(683): n is a, c, g, or t
  misc_feature (767)..(767): n is a, c, g, or t
  misc_feature (776)..(778): n is a, c, g, or t
ggaaagtagtaagtaaaaatgaatttaatctttaaataaaagacaaataaactgtccgaaagtatatttatttcattgaaatcatatttagaagtataacttcttacgtgcgtacaaagtnnnnnnnnnnnnnnnnnnnnnnnnnnnnnnnnnnnnngcttttcttgcaatttcgatgcgtgtcctgatttctctaccttggtcgttgttttctgttacccatgttcccagatatttgtagttattcactctttctacttgttttccctcgatatctagccttctttctcttccattaagaagattcaatagaaatttttttctgtagagaaaaagtcaggtttgaaagggttaaaaacaagtttcacacttgtacggttttctccaatatgcactctcaaatgtattttcaaagaacctgtccgagaaaactgcttaaaacaaattttcacacttgtaagatttttttccagtgtgtactctcaaatgtgttttcaaattacttgcttgattaaactgctttaaacaaatttcacacttgtaaggttttactccagtatgtattctcaaatgggttttcaaatcacttgcttgactaaattgcttaaaacaaatttcacacttgtgaggtgtttctccagtatgcactctcaaatgtctttttaacttacctacttcactanattgcttaagacaaatttcacacttgtgaggtttttgtccagtatgcactctcgaatgtacttttaaactacctgctccactanactgcttannnacaatttcacacttgtaaggttttactccagtatgtattctcaaatgtgttttcaaatcgcttgcttgactaaattgcttaaaacaaat

SEQ ID NO: 18977 - DNA, 432 bp, Diabrotica virgifera
  misc_feature (60)..(82): n is a, c, g, or t
aaaaggtgcgatcgtgttcgaaccgatgttttatttttagaactgcacttcttgcggttnnnnnnnnnnnnnnnnnnnnnnngccgtggccggtggtttccgatgcacatgttctcggtgttttggtgggaggcacccctgctagttgtggggccgctctatcgagggtcctgtctcgaccattagatatgatgccctagagcttgttttcagtcccgaaatggtcaggtttgacaggtgccattagatgcttctagacttggtgtgctttctccacagtcagtgtctcgtcggtgtatttttctgagatggtggccgacaaagctgcgtttctcgctgttgccgctggtacggtggttctacagcgtgcgtcgcaaatgcgttgcggattaagttgcgtggttaaagtgcgtttactggactgtctccctt

SEQ ID NO: 18978 - DNA, 201 bp, Diabrotica virgifera
  misc_feature (4)..(37): n is a, c, g, or t
  misc_feature (48)..(70): n is a, c, g, or t
cccnnnnnnnnnnnnnnnnnnnnnnnnnnnnnnnnnngcctttcgtannnnnnnnnnnnnnnnnnnnnnngatagaattccaactgggtcacggggggttaaaattttatctgggaaaatttaaaagtgtaacagaattaaaaatatatgtggttaaacaaattttaatttttatctcccattcgcgggggggatttttat

SEQ ID NO: 18979 - DNA, 341 bp, Diabrotica virgifera
attacttgccttattaaaaattgagatgttacataaaatttgtcaacgtcgcgagtagcttctacagtgaaactatccacataaatagccaagcggttgtcgatcttctgaacgctctatgccatactttgaaatcttctaccgcgcgcagtatgctcgcgtctattcgtattctggttcacctgtacgaataaaagcatcaaaaagtcaattctacatgttttgcgaaattagaaaaatgtcaaataacttatatttctgcggatcgtccctaccgattcgtctatagtatagccctcgtccctcgaacgaactgcctacttcttgtccccttttttttt

SEQ ID NO: 18980 - DNA, 212 bp, Diabrotica virgifera
  misc_feature (16)..(77): n is a, c, g, or t
  misc_feature (79)..(91): n is a, c, g, or t
  misc_feature (96)..(133): n is a, c, g, or t
aaacaatcaaaatggnnnnnnnnnnnnnnnnnnnnnnnnnnnnnnnnnnnnnnnnnnnnnnnnnnnnnnnnnnnnnnannnnnnnnnnnnnaattnnnnnnnnnnnnnnnnnnnnnnnnnnnnnnnnnnnnnngttcttaaaaagaagcccaagaaatgggtaaaggttcattaaaatatggctgggtactcgacaaacttaagggcgaaga

SEQ ID NO: 18981 - DNA, 483 bp, Diabrotica virgifera
  misc_feature (44)..(65): n is a, c, g, or t
  misc_feature (203)..(221): n is a, c, g, or t
attgttaactcgcattaaccacgaggaagtggttcaagcacttnnnnnnnnnnnnnnnnnnnnnnggaaccagaggatattcctggggaagtgtggaaggcgtcaggagagataggaagaagttggctaacacgtttatttaatagaattatggaagttacgacaagtgctaaacgatggagaagcagtatatttgtacctgnnnnnnnnnnnnnnnnnnntaatgaacaaactacagggtaataaaactacttagtcacatcatcaaaatatgggagagccacaatcattttagttgttgtacaaagattaatttaacattttctctggaagtattaatttggaaagataatatgcctcattggtgttgtgttttgaagcgtgaaatcgcaaagcaatcgcgataaagctagcttcttaccacttaccctcagcgctacattctaagcccacaactggacacccaatttaactaaataaggt

SEQ ID NO: 18982 - DNA, 567 bp, Diabrotica virgifera
  misc_feature (337)..(354): n is a, c, g, or t
  misc_feature (546)..(566): n is a, c, g, or t
ggaatatatgtgtcttcagagggacaaagtatatattcccaattatagctatatagagtataacaataataaaagcgaagtattcatttcttattgttatactctatatagctataattgggaatatatgtgtcttcagagggacaaagtatatatttttagtgaagaaagaagctttggggtacttccagacaataatcgagtacctatcactaaaaaaccactgccctcttacataagtgctcagaaagaatatttcttggtttaattcttcttcttgtaaaagtagtttgttcgaaatgttagtgatttgatttagtttcgaatttgtagtagnnnnnnnnnnnnnnnnnntgtgtttgatagtaacattccaaaaccaagttctaaattgtgtaaacgaaaattgtctaacgaattcttgtacaataattagctaaaatgttgatggttattacagtttttgtgtaattgtaaatgagttggagaaaaacttaaatttcatagatattgtctcatctaactatttatagataattaaaatcnnnnnnnnnnnnnnnnnnnnnc

SEQ ID NO: 18983 - DNA, 199 bp, Diabrotica virgifera
  misc_feature (134)..(152): n is a, c, g, or t
aataattgacctggcagtacaattttagcgatagttgtcccgccctaagactgggagagactgctatatttatgcgcgcaggaaatatgatacatccacaccggaatcattgctcccattcactgctgaagaannnnnnnnnnnnnnnnnnncattacgatgtcatacccaatcgaacaaattgagcaagaggaatacg

SEQ ID NO: 18984 - DNA, 317 bp, Diabrotica virgifera
  misc_feature (5)..(118): n is a, c, g, or t
  misc_feature (125)..(162): n is a, c, g, or t
  misc_feature (203)..(220): n is a, c, g, or t
  misc_feature (228)..(250): n is a, c, g, or t
  misc_feature (280)..(311): n is a, c, g, or t
ccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaaagtttataattggtgtaannnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 18985 - DNA, 877 bp, Diabrotica virgifera
  misc_feature (700)..(719): n is a, c, g, or t
  misc_feature (820)..(820): n is a, c, g, or t
actaaatttcttcttttctagatgttatgaaatttagtaactaacgaaggggaattagttttagctacaaaaagtaacgaaaacgataaagagaaaaattttcctgaaagttcgcaaaaatcgaaaaattagcgtgtaccaaaaatagagtcagagcgcacgctaaattatgacgtcactggcttgatgaagtttcgttcgcgtgcatctaactttttgattcgcgcacaagccggcgtgtacatagacacagtgaataaaaacagcagtaacaaaggcttaactactaatgttgcaggcccaacgttaaaggtaacaaagattgttaccaagcaccttcgggaatatagtatagttagcaccagaaacaacagtagaagaatagcttacagtgtgctagccacgtctaaatatctagatcgaggctctaaaatgtcctgtacagaaaatggtagtttccaagataatagtaacaaaatttcgtcaacttcgtaaacgaagaaggtgcggaaattttggaccattcatccgtttcattttaaaaagcaaatggcacactgacacaaaactttatctagcactatatataaactgtgttgtatacaaatagtattcaccattaagtaaaatataaacttatattgatacccaagttaaaacatgaacaacaaatatataattactgaggtagtttacatcnnnnnnnnnnnnnnnnnnnnggttaccttagatcggacaagtaatagaaatacgtggacgcttcaagaacattcggcaaaattttaacgaaatatttgtcttacgccaatactgggacaanaagtcccaaatactgaacaaaaaactataaataaattcactttgtgattttgggaaa

SEQ ID NO: 18986 - DNA, 126 bp, Diabrotica virgifera
ccttaaggataacagcggaattttattggagaggtcaaatccattataaagattgccacctccatggtggattaaaggttataaatggtggaacaactatattaataaggctggtccacttttaaa

SEQ ID NO: 18987 - DNA, 798 bp, Diabrotica virgifera
agataatttacaatttacaatgaacctgcaatcactctttcaagattttaatccaagtaagtttgttgtacatacttgccttctagtatttaccattctcttcgccttaaaactagataatcacatccactggtccttttggactgtttttactccaatttgggtatggaaggtcttagtaataatgggagcaacggtggggagctatgtctggtggaggtatccacatttcaggttagaaggtgaagcctacgtacactataaatcgatgttaatatctttagcattacatttaatattgttaatgtttgaacttttggtttgtgacaaactcgaatcagcaagacacctgtggattttagtatttattcctttaatttttatatcaattgttagtatagctgtttgtatttgggctgtgaaacatgacagatcatttgagcttgagttattctgcgctgtcaatgttttacagttcatatttcttgccttaagattagatggatttatatcatggtcctgggaggtggtatttgttcctctttggattgttatgtgtctttcattggttggtgttttatatacaatcatttttgctgccattttgttaagaactccagaagttaacgctcaacaaagaagaagtagttttatttctgctgttggttatacatttctagttattcctatacttgtatttcaagtattattagctgataaactagacgacgatattcggttatcgtatgtagcagttgccagcccactttttgtatcttttatcactcttattttaat

SEQ ID NO: 18988 - DNA, 774 bp, Diabrotica virgifera
  misc_feature (57)..(96): n is a, c, g, or t
  misc_feature (98)..(111): n is a, c, g, or t
  misc_feature (120)..(147): n is a, c, g, or t
  misc_feature (240)..(261): n is a, c, g, or t
  misc_feature (270)..(288): n is a, c, g, or t
  misc_feature (689)..(716): n is a, c, g, or t
atacgactcgaaacatttattttattcatattctcacttattttaacataacaaagnnnnnnnnnnnnnnnnnnnnnnnnnnnnnnnnnnnnnnnngnnnnnnnnnnnnnnagtgagacnnnnnnnnnnnnnnnnnnnnnnnnnnnngattctttgtacctggtgtgtctgggagtattaaatgacaattatatagttattattctcgaatatatcatagctaacaaattaaaatttctnnnnnnnnnnnnnnnnnnnnnngaatcttgnnnnnnnnnnnnnnnnnnncattttacatataccccattttctactaaataaatccaacttcatttatcaacaatatattcataactaaacatttttatattcttagtatgacatattatgacggatgagcttaaccacctgattctactataatttaattcccatctctctctcaaccattatgagttgtcttatcccaaaagatgttctcatttatttctatctattatgatttttcttttgtctatgcttttcatgaacatacaaacttagattatccatatgtagtactgccgccactattagcacgatctatgtgcatatctacgaaaactatctaagcatactataggaattctacaacgtttatttccacctgtttattcagctcatgtctttccgtatcagatatatcacgnnnnnnnnnnnnnnnnnnnnnnnnnnnnatcgcgatagtttgaccgtgctaaggaaccatagtcattagatgtttttattgaaagc

SEQ ID NO: 18989 - DNA, 303 bp, Diabrotica virgifera
  misc_feature (7)..(30): n is a, c, g, or t
  misc_feature (57)..(57): n is a, c, g, or t
  misc_feature (63)..(76): n is a, c, g, or t
  misc_feature (79)..(101): n is a, c, g, or t
  misc_feature (109)..(130): n is a, c, g, or t
  misc_feature (163)..(190): n is a, c, g, or t
  misc_feature (200)..(302): n is a, c, g, or t
taacagnnnnnnnnnnnnnnnnnnnnnnnntcgataatgaagattgcgacctcgatngtggannnnnnnnnnnnnnggnnnnnnnnnnnnnnnnnnnnnnntgttcgannnnnnnnnnnnnnnnnnnnnnagtttaaacgggtgtgagccaggtggtttctannnnnnnnnnnnnnnnnnnnnnnnnnnngaaaaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 18990 - DNA, 169 bp, Diabrotica virgifera
  misc_feature (2)..(28): n is a, c, g, or t
  misc_feature (31)..(164): n is a, c, g, or t
gnnnnnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtg

SEQ ID NO: 18991 - DNA, 822 bp, Diabrotica virgifera
  misc_feature (521)..(541): n is a, c, g, or t
  misc_feature (569)..(588): n is a, c, g, or t
  misc_feature (624)..(734): n is a, c, g, or t
  misc_feature (739)..(756): n is a, c, g, or t
  misc_feature (758)..(771): n is a, c, g, or t
actgaatagatccacgtcacatggaccacaaaaccacttagcacatatgaagaaattattagaatatgtagaaataggtgttaaagaaggagcaaaactcgaatacggtggaaagagagttaataggaaaggatatttctttgaaccgaccgttttaagtcacgttgaagatcatatgttcatagctaaagaagaatcatttggacctataatggttgtaagcagattcagcaatggtgatatggatggtgtcttgaaaagagccaatacgacggagtatggtctagcttcaggtgtattcaccaaagatatatccaaagctttaaggttcgctgagaaaattgaggccggaacagtcttcgtaaatacgtataacaaaacagatgtagcagcaccttttggaggattcaagcagtccggatttggtaaagatttaggaagagaagcattgaacgaatatctgaaaacaaaatgtgttaccatcgaatattaagataaaatttcctgtatcaacctacttnnnnnnnnnnnnnnnnnnnnngtattatataaaactttttatactttgnnnnnnnnnnnnnnnnnnnnagttatttaaggaataaaattgtgatattttcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgnnnnnnnnnnnnnnnnnntnnnnnnnnnnnnnngagcatataaaacccaaaggtgaaaaacaaaatttggggggggccgcccta

SEQ ID NO: 18992 - DNA, 238 bp, Diabrotica virgifera
  misc_feature (7)..(44): n is a, c, g, or t
  misc_feature (64)..(77): n is a, c, g, or t
  misc_feature (80)..(97): n is a, c, g, or t
  misc_feature (111)..(133): n is a, c, g, or t
  misc_feature (171)..(195): n is a, c, g, or t
  misc_feature (209)..(237): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnntaagtctgttcgannnnnnnnnnnnnnnnnnnnnnnagtttaaaaccggtggtgagccagggtgggtttctatnnnnnnnnnnnnnnnnnnnnnnnnngtaacgaaaagacnnnnnnnnnnnnnnnnnnnnnnnnnnnnnc

SEQ ID NO: 18993 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (179)..(179): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagcccaggtggtttctatcttttaattattantatattttagtacgaaaggac

SEQ ID NO: 18994 - DNA, 741 bp, Diabrotica virgifera
  misc_feature (6)..(28): n is a, c, g, or t
  misc_feature (219)..(292): n is a, c, g, or t
  misc_feature (297)..(363): n is a, c, g, or t
  misc_feature (381)..(399): n is a, c, g, or t
  misc_feature (408)..(422): n is a, c, g, or t
  misc_feature (424)..(440): n is a, c, g, or t
  misc_feature (443)..(462): n is a, c, g, or t
  misc_feature (477)..(497): n is a, c, g, or t
  misc_feature (632)..(632): n is a, c, g, or t
  misc_feature (635)..(684): n is a, c, g, or t
  misc_feature (689)..(732): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattanacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnaaataaaaa

SEQ ID NO: 18995 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 18996 - DNA, 165 bp, Diabrotica virgifera
  misc_feature (28)..(45): n is a, c, g, or t
  misc_feature (49)..(68): n is a, c, g, or t
  misc_feature (80)..(146): n is a, c, g, or t
acattatggcaaaaactaactgtatacnnnnnnnnnnnnnnnnnnaggnnnnnnnnnnnnnnnnnnnngttgaaagcccnnnnnnnnnnnnnnnnnnnnnnnnnnnnnnnnnnnnnnnnnnnnnnnnnnnnnnnnnnnnnnnnnnngcctagttctaaatcgcga

SEQ ID NO: 18997 - DNA, 844 bp, Diabrotica virgifera
  misc_feature (103)..(123): n is a, c, g, or t
atttataggacattctgatagcagatacccagacccaatacacgaaacttatttattgatagcatttggaatttgagtttaatttgaagtggaacaattaagnnnnnnnnnnnnnnnnnnnnntttttcataatatttgtttattttgtgaataattttggattcttagtataagaatgactattttccaagttttccatagtttttgaatatctatttaaataacaataaatgacgtcaaatatgttctttgttagagtattcttgagaaatatgaacgatactcttcacttccacattatacattttatttgcaaaatgtttagcttatggtatcctatttccggttttattatgtttgatgatattcaaagtcagaaactaagggtttgctcactacggagagcgaggatacaatgcattgctctctgtagtgagcacaactttagattaaaaagcattggtcacaagtataatggtcaaacaaactcaacaagaagtcctgttagattaaacataatgtaaaaccaaagtaaaccatcatgtaactagagcatttaacattcacaaaggacatgtaaggcagtttcctcatcaatttcgtatttcctacaccgtgggtcagggaagacacgtcaatctctggcactttgtcataatacctttgtaccattcgctgtttgtttcctgcggtctcaacgaagaccaacagttgataggtttaggatttcttctagttcaatcctctgttggctagtgaatagtgaattcgcgcctcctatcacttagtacaatgcaatggcataggaggtgtatggcagtctattaaattattgagtttgac

SEQ ID NO: 18998 - DNA, 233 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (166)..(190): n is a, c, g, or t
  misc_feature (198)..(229): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagcccagttgtttctatcnnnnnnnnnnnnnnnnnnnnnnnnngaaaggannnnnnnnnnnnnnnnnnnnnnnnnnnnnnnntatt

SEQ ID NO: 18999 - DNA, 820 bp, Diabrotica virgifera
  misc_feature (6)..(48): n is a, c, g, or t
  misc_feature (76)..(105): n is a, c, g, or t
  misc_feature (126)..(149): n is a, c, g, or t
  misc_feature (153)..(176): n is a, c, g, or t
  misc_feature (188)..(210): n is a, c, g, or t
  misc_feature (341)..(370): n is a, c, g, or t
  misc_feature (401)..(420): n is a, c, g, or t
  misc_feature (564)..(586): n is a, c, g, or t
  misc_feature (616)..(647): n is a, c, g, or t
  misc_feature (653)..(684): n is a, c, g, or t
  misc_feature (771)..(805): n is a, c, g, or t
aaaggnnnnnnnnnnnnnnnnnnnnnnnnnnnnnnnnnnnnnnnnnnnggggggaaagggggccccccgggggggnnnnnnnnnnnnnnnnnnnnnnnnnnnnnnaaaaaccaaaccttgggcccnnnnnnnnnnnnnnnnnnnnnnnncttnnnnnnnnnnnnnnnnnnnnnnnnaaaaaacccaannnnnnnnnnnnnnnnnnnnnnnatttttgggccccccgggaaaaatcccttttaaacccccccggcgccaccccccaacccccaagggggcccattcccttaagggccccccggggggccccggggggcccattttccccccgggcttttacnnnnnnnnnnnnnnnnnnnnnnnnnnnnnnaaccccggggggggaattccccccccccaannnnnnnnnnnnnnnnnnnnaaagggcccgggccccgccccggcccccccggggggggaaaaccaaaccccccaaccccccccccggaaattttccctttccctttcccccaaccgggaaaggcccggcccaaaccgggggcccaaaaaccccaaaaaccccannnnnnnnnnnnnnnnnnnnnnntccccccctcccctcccccataaaaacccnnnnnnnnnnnnnnnnnnnnnnnnnnnnnnnnaccccnnnnnnnnnnnnnnnnnnnnnnnnnnnnnnnnggccccccgcgccccccccacaaaaaaaagggtttggggccccccgggggggagggactctttttggggggggaaaccctttaaccnnnnnnnnnnnnnnnnnnnnnnnnnnnnnnnnnnnaaaaaggggcaaaaa

SEQ ID NO: 19000 - DNA, 856 bp, Diabrotica virgifera
  misc_feature (2)..(735): n is a, c, g, or t
  misc_feature (751)..(751): n is a, c, g, or t
  misc_feature (756)..(821): n is a, c, g, or t
  misc_feature (832)..(832): n is a, c, g, or t
  misc_feature (836)..(836): n is a, c, g, or t
  misc_feature (840)..(840): n is a, c, g, or t
  misc_feature (843)..(843): n is a, c, g, or t
  misc_feature (845)..(845): n is a, c, g, or t
  misc_feature (847)..(849): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaagcttaaattnttttnnnnnnnnnnnnnnnnnnnnnnnnnnnnnnnnnnnnnnnnnnnnnnnnnnnnnnnnnnnnnnnnnnttatataatanattnattntantngnnngtgataa

SEQ ID NO: 19001 - DNA, 621 bp, Diabrotica virgifera
  misc_feature (71)..(88): n is a, c, g, or t
gcccggaattcccgggcccctccacgcgcccgagttaacttgaatcaacaagatatatatttcgtacgagnnnnnnnnnnnnnnnnnnactgttatatagaaactatgagcgagccaatagactatactaataaaagaagaacccactttatgcaccgacagtggcaccgatctgtcgaaaagccagttattatattgctctcagttgcacgctctggagaattcacctattttgatctatctatcgaaaactaaggttgtgaagtaatgactgggtcctgaaaggtcttacgtaggagacgaagcccaattctcacgagatatactcagcttatattctcccatcagactcgcaattttcaattgttgtatagataagaaaagaaatcttaatcattcattcaacaaggaactcgtaagacccccagaatatttacctgataagtcggctgaaacaccttcctctcttaaggaacgcatggatgcattgccacatataatgattgaaacttactataactgatccatgtgagtaacaattcaacttatcctattcatgtatggatctggtcgtcgcgctgacatagcgtagccttctggagaagttctatacgtaactgt

SEQ ID NO: 19002 - DNA, 341 bp, Diabrotica virgifera
tttttctgattttttgtttatttaaaccatacaatgtattgttataaaaaaaatacctaatatattaggctaaaagtaacaaaaaactaaactgttaattaaacttttagaaatggtttaacaacggcataaagttcttcacattctgtttcaaatgaattatttccattgacaaaggctacctcgggatcggacatattcttatacgcagaaataacattgtttcgaaattctgaagaagacttcaataaatcctcttgagcagtaaactcttttcttcgagacagtctttgtaatctgacggattcgtcgacatcaaggaaaatacaaacatctggttt

SEQ ID NO: 19003 - DNA, 739 bp, Diabrotica virgifera
  misc_feature (139)..(168): n is a, c, g, or t
  misc_feature (223)..(244): n is a, c, g, or t
  misc_feature (252)..(288): n is a, c, g, or t
  misc_feature (345)..(362): n is a, c, g, or t
  misc_feature (460)..(475): n is a, c, g, or t
  misc_feature (477)..(498): n is a, c, g, or t
  misc_feature (501)..(515): n is a, c, g, or t
  misc_feature (529)..(548): n is a, c, g, or t
  misc_feature (597)..(621): n is a, c, g, or t
  misc_feature (644)..(729): n is a, c, g, or t
atttattctaaacataataaacatattttttagtaaaagcaacgaaaaactttatttaatgatagtctcttagtatcgtgagacaatattttattcttataccagaaccatttattttttgtaccctgtgcctccggcnnnnnnnnnnnnnnnnnnnnnnnnnnnnnntctcgaatttccaaagagctagaaaattaaaattcttattgtaacataaacatcnnnnnnnnnnnnnnnnnnnnnncatgttcnnnnnnnnnnnnnnnnnnnnnnnnnnnnnnnnnnnnncctaaattcatttattaacaactataccttataattccatatctttctatcatcacnnnnnnnnnnnnnnnnnnctgcgcttacccataaacttctattaaaattcacctcctaaataagaattacgctccaaaatcttcatattttacaatatgttcttatttattcttcnnnnnnnnnnnnnnnncnnnnnnnnnnnnnnnnnnnnnnccnnnnnnnnnnnnnnnctcactttagtacnnnnnnnnnnnnnnnnnnnngacaattgtctatttaccaaaaatatatcggtctaatacaggactcccnnnnnnnnnnnnnnnnnnnnnnnnncaaaacatgtcttcttgtgttannnnnnnnnnnnnnnnnnnnnnnnnnnnnnnnnnnnnnnnnnnnnnnnnnnnnnnnnnnnnnnnnnnnnnnnnnnnnnnnnnnnnnattgagagct

SEQ ID NO: 19004 - DNA, 55 bp, Diabrotica virgifera
  misc_feature (38)..(54): n is a, c, g, or t
gttatttaattgcggtgatagaaaataaattaaactgnnnnnnnnnnnnnnnnng

SEQ ID NO: 19005 - DNA, 909 bp, Diabrotica virgifera
  misc_feature (789)..(789): n is a, c, g, or t
  misc_feature (791)..(791): n is a, c, g, or t
  misc_feature (828)..(828): n is a, c, g, or t
actcgtagcccatcggacttgcgcagcatcaactgatcttccgtcttgtactcaccgtccaatggatcaaagatcccatttcattcagttcaaatcgttttttggtcagggcctctgttcccagttcaagctttctgacagcgcagcacctgatcttctcgtctactgcgccgatgaacttgagaagcgcgcccaaagtaatgaatctctagagctgtacaatttgtattgcgctactccaccagcaaatcaactgttagcgctggttaagaagatcgaagaaaatccccatgacatcggtctatcggagttcagtcctgtcgcaattgcgggcgtttttaagaagtatttacgggaattaccagatcctttgatcccggtgcagtggtacgacaagttcctagaagcagcgagaaaaagaaacgatcaggaatgtacgactttattgaaacagttggtggaagagctacctcctcatcacaagtccactcttagattcattatgggtcacttatgcagaatatgccaactagagtatgctagaggaaacaagagtcctccaactgtattaatccaagtgatgtgtcacattttattgagaccgccatgggaacgaattatgctcaaataaggcatggcagttgcactacaagtcaccttgcccgacctcaatggcgccatcgaagctgggctcgctgtcggcgctgatccctctctggaagactccgtgaagctcccagtagtcaccgggggtgacttggcaactgcgtctagattcgctgcatcttngngcgttttccaccttccaacagagatctgcagaagttntgaaatatatgttaatgcgtctgtcgttgcagtgtcttgtggtctttgtaggcgagtaggggaagcctcagacgtgactgg

SEQ ID NO: 19006 - DNA, 862 bp, Diabrotica virgifera
  misc_feature (716)..(716): n is a, c, g, or t
  misc_feature (806)..(806): n is a, c, g, or t
  misc_feature (838)..(838): n is a, c, g, or t
actagtcctagtgtcttccgcaccaccaaagtccagattgcctccgggtcctgctcggttgcacgttcaagaaagaggattctgcctaactacgggagttccgcccagagtggctggtcagtggcttattagtaatttaaggagatatggggtagttgaggggcgattctgcttcgaagggggttcaaggtgtataaagggtgaagggttgtacgtactacttaccgatcagggagaagagatcacgaccactttgaaggcggcttctgtagggaatttgcattcttcaaggagaaggcctgtttcaagaaatatgtcagtgatggacagtcctcgtagaggacctatgcgcgcaacaggaggaataggattagaattaagcgaatcgtcccttatttcacgggcggattctccttacaccgatatggagagcaattatggctgtggtgatagtatatcaaatgatggttggggacccccgcctatagaaagatgcatgagttgtatcagcaaactcggtgcaatgtccaggtcctcgactgcaactgtaacaatgggagccccgccatgttgggagcacacttgtgatcgccattcaatcagcagcagctctgacagcagcggatggagtcaagcagttaccaaaccaccagctagaccaccaaagcctggagtaacatcaccttcagcaaagaagcctgctgctctacttcctncaccgtcctatgataactacgacattcctaagataccctttccagtggaaacccaagctgatgagcattacgatactcctcgcaaactanaggaatgcattcaaggattttgtttttgatancgttcacaaaccatgtggttgtgt

SEQ ID NO: 19007 - DNA, 477 bp, Diabrotica virgifera
  misc_feature (255)..(273): n is a, c, g, or t
gtcgaaccagatgtttatatatcattaatataagaagcagcttttttatgcaccgtgtgtggcaccgatttttgatatatcaattgtttatgatttcagttgcacctcttgtatgaattacctcatctttgctgtttctaccgaaaagtaaggttttgaagtaattttttggtactgaaaaggtcttcggtttgaagatataatgctgaatttatcagaaatatacttagcttatattataccatcacactcgcnnnnnnnnnnnnnnnnnnngttatgataagaaattcttatcgttcatgcctacaaggaattcttaattaccccctgtaataatttaactgatcagttggctgaagcatcttcctatctcaaggactgcagttatttattgccatatataatgattgatactttctataactcatccatgtgagtaaaaatttaacttatcctctcttttgtattcgatcttgt

SEQ ID NO: 19008 - DNA, 859 bp, Diabrotica virgifera
  misc_feature (541)..(561): n is a, c, g, or t
  misc_feature (763)..(763): n is a, c, g, or t
  misc_feature (798)..(798): n is a, c, g, or t
  misc_feature (820)..(820): n is a, c, g, or t
agaaatgagtaagttgaagcaagatcttgaaaagcttactaatgatatgaaaaatttgtcgtctgaagttgagttagtaaaacaggaaaatgttgaattaaaaaaggaaattcaatcgtttaaatcaatccaaacaaacttagtaaatccagaaaaagaagaggatgttatttatgaagtgatggatcgacaaaataggacatctaatattattgtctttaatataaatgaatcgaataaaccgactcaagcagatcgtactaaagaagacagtgaaacaataacaaacattttgaaggacttcccagtggactcaaataatttaaaattgtttaggttgggtaagtttgataacaaaaaaactcgtcccatcaaagttatcctccaatcaagtgaagatgccctaaaggtcctaaaaaataaagcatcaataaacattcctggaatcaagatttttgctgatcaaaccaaaagacaaagagattattattttactgtaaagaatcaacttgatgaattgattagagcaggtgacttaacnnnnnnnnnnnnnnnnnnnnncaataggcctaccattgtccctaaatttataaataataaaccaaatactgttagcaattcaacttcaattgatgaaaaaaactaaatgcagaccctaatttactttttaataccgatattatatatttaaatgcacaaagcgttttaaaaaatattgatcaaataagaacaagcattgcaaactataacccaaaattaattntgttaagtgaagcaagaacccacgcagatatatantgataagagatcatgatagaanatttataatgtattagatgtgattcaatagtaggtacac

SEQ ID NO: 19009 - DNA, 380 bp, Diabrotica virgifera
cggagaatatcgcagggaataaaatcttttttggtaaaggagagaaatcctgattaaaagagagcaaatgcagattgggagagaatttttctgttttccaatagaccatattattattatggccattcgtgcatcgaagtagtgtaaagtattgattatatatatatctaatactaatgcctacgcagatgcaaaataggtcgaattctccatctggacaaaagatcatctgcaacatatttctttagcaaggcaatgcgaatcgaagatgatctcaaccatattttgaataaaaatagcctaacaatacctacctgctgtagagtttctagcattgcactgtattttataacataagtagtaaatagtattatggaaga

SEQ ID NO: 19010 - DNA, 888 bp, Diabrotica virgifera
  misc_feature (692)..(692): n is a, c, g, or t
cgacatttttgtgtcatcacttagagcatatcgaaagataataaagttaatcacagaaatggctacgagaaatctatgtttatgtatgcttatttggatgccactctttgagggcatagttggcgacgtcgcctttggcattgcacaaattcctggtggtaaggcaacagtagaagatttgaaaaaagggaaatacttacttaacatggaagaaaataatcatggcggcgtaataccaactccactttttactattacaggggtggacaacactgattgtcctaatttgaatgttgaatttactcaaggcatgaagtttaagttttcgattaatgaaagttgtatattctatgctgaacagacatttgactacgaatcgaatgaaagatcatacaatttcagaatttcaaagtccgtaaatgacgagatagatattgcattcagtatcaaaaatatcgatgatgaacctccacaattaggaacgtttaaatgcaactttaatgaacaattagactatagtcttgatgacacaccatgcaatactacattgcatgatcccgacggatggctggcacaagagaaaattttaatattcatcgacactaaggatgaagatatattcgcaattgatttgcgaaagcctctaccaaatgatactgagacagacacctacgtttttatgtatctcttanagcaacttaattatgaggataccaatttttatcagtttacagtgcaagcaaatgattctggaggtaatctttcacccacagaaagtgctgtggtaaatgttatcaacattagaagtagacctccaaaatggtcaaaaataacattatttgatcaatttgacgaactgaccgaacaagattacgatatacaagcttt

SEQ ID NO: 19011 - DNA, 91 bp, Diabrotica virgifera
  misc_feature (10)..(80): n is a, c, g, or t
gtaaaaagcnnnnnnnnnnnnnnnnnnnnnnnnnnnnnnnnnnnnnnnnnnnnnnnnnnnnnnnnnnnnnnnnnnnnnnnaattatttata

SEQ ID NO: 19012 - DNA, 882 bp, Diabrotica virgifera
  misc_feature (701)..(720): n is a, c, g, or t
  misc_feature (818)..(818): n is a, c, g, or t
gttcataacagttaatcatttattgtttgacttaacaaaaagtagacctagagtgaccaccattaaatgtaatggtcagttaacaaatgtagtgttcacaaattatgaaaaaaacctattactccttatgttgccagacaacagagtctcaaaacaagaaatattgttgttaaataatgaaataattagattattaaaattctgctatgaaactattgacaaatgcttcataactgaaaaatacctcccacaagtagaccacttcttttcgaaattttttgcaagaactcttagtagtggtttgtggagcacagctcaacaatctctggctttggaaaacctagaatcaaaagcaaaagaagtcagcccctgtcagtttgaggacttgatgcctgttgcacccactttgtgtctgcctgacgaggctcagcttcagatagatgatgccttatcagaattggaggcaagtgattatagagactggaatgaagacccattggactgtcaaagactgttcacagttctgggcagtgccctctttcattcaggatacctgttggcttcacattttattcacgaagatttgatagatgtcttttgtttctgtaaacaacaaggattgtttcatttatcaaggacagaacctataaaatcacttgttctttggaaggaggtatttccatcatcttgcaacaaattgnnnnnnnnnnnnnnnnnnnntcctgaaggaagaaggtatttgctaatagtggaaagtggaaaagatctgttagcggtaataatggaagctgggggttgtacagaaccatctgaagaanacatgggtcctgatgcattctacgtagaagaagcgcaagctactttagcccacatccaagaatt

SEQ ID NO: 19013 - DNA, 781 bp, Diabrotica virgifera
  misc_feature (2)..(50): n is a, c, g, or t
  misc_feature (52)..(165): n is a, c, g, or t
  misc_feature (176)..(287): n is a, c, g, or t
  misc_feature (289)..(492): n is a, c, g, or t
  misc_feature (494)..(539): n is a, c, g, or t
  misc_feature (541)..(555): n is a, c, g, or t
  misc_feature (557)..(668): n is a, c, g, or t
  misc_feature (698)..(721): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnncnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgaagggctggatgaataaaaaaacgnnnnnnnnnnnnnnnnnnnnnnnncttatctgtacgctagaaagcttagatgtttttagaagacgagacgaccctatagagttt

SEQ ID NO: 19014 - DNA, 199 bp, Diabrotica virgifera; identical to SEQ ID NO: 8259
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (196)..(196): n is a, c, g, or t

SEQ ID NO: 19015 - DNA, 895 bp, Diabrotica virgifera
cttaacagacacggaggttgtagtagaaaatgttaccgcaccgttaaatttgacaactcctcctcaattaactgacaatacaggttttgctgattggtggctaaccccagtttttgtgagtgaaaacacttctttctacttcattgctttaaacatggtgatggtaattattatgaatatcaggtcgtcttcgttttatgcgtgggctataacagcatcaacaaaaatgcacaatatgatgtttgagaacatagtttacagcccaatgaggtttttcaatataaatccttctggaagaattctgaataggttttccaaagacatcggtgctttagatgaagttttaccaatgactatcatggatactcttggaattggtcttgaggttgttgcgatatgtttcgtactaggtagtttaacctactggataatgatacctactatccttatagggatactgttctatgtaatgaaggtcgtatttttagaaactagtcgagatgttaagagagtggaatcagtaaaccgaagtcctatctatactcatctaacagctacacttcaaggattgactactataagagcattcaaagctgaaggaatactcaaaaatgagtttgatagttatcaaaataatcatagcgcagcatttttcatgtatcttgcatccactaggacctttggtttctggctggactttatatgtgtaatatacactgccttagtactattgtcgttgattttcattgaaagtgaaacatttggaggaaatatgggtcttgccctcacgcaaaccttagctttgacgggaatgtttcagtgggggatgcgacaatggtctgaactagaaaacaaatgacctcagtggaaagggtccaagaatacgctgacttaa

SEQ ID NO: 19016 - DNA, 828 bp, Diabrotica virgifera
  misc_feature (718)..(718): n is a, c, g, or t
  misc_feature (757)..(757): n is a, c, g, or t
  misc_feature (790)..(790): n is a, c, g, or t
tattacatattccaaatatttaaacgaaaacgaattattaaaatattatggagcagcaatgaccgaccaattaacaaaattataaaacacaataaaataacgtaagaatggagcggactaattctacaattcaaaaaaggggataccagaaaactacagaagtatcaatttattaaatactaccctaaaacttacaactaaaattttataaaacctaatgaatcagaggataagtttagcagatgaacgatagggttctcgtactgaaagatcgtgtacagatgcaatattcgttataaagcaaattactgagaaatcattagtgtataatagagcagcatttttctctgtctgattgagttgaagaaatcatttgacagagtaagacttaaagatgtaatccatcttctgtataatagagaagttcccctagatatcataaaaactattgaaaacatctaccaaaacaacaaaatggagtcagaatagatggacaacttacagaacctatagacataggcagcggaatacagagaaagatctgtattccactcttcaatttaatcatggatgaaatcatcaaaagcgttaacaaaggaggaggctgcagaacaataaacaaagaagtaaaaatagtctcttacgcagacgacgcattagtgtcgcccaagatgacgatagtcggcaaatattagttcacagatttaacaaacaggcncaaggaatttcataggacaatttcatatcagaaaactanaaaatagtaatcagtaaagaactaatcagatgncaaaaatagaaattgatagcatcatattgaataagtaa

SEQ ID NO: 19017 - DNA, 817 bp, Diabrotica virgifera
  misc_feature (34)..(85): n is a, c, g, or t
  misc_feature (135)..(164): n is a, c, g, or t
  misc_feature (190)..(239): n is a, c, g, or t
  misc_feature (241)..(278): n is a, c, g, or t
  misc_feature (312)..(332): n is a, c, g, or t
  misc_feature (344)..(365): n is a, c, g, or t
  misc_feature (367)..(398): n is a, c, g, or t
  misc_feature (409)..(442): n is a, c, g, or t
  misc_feature (444)..(464): n is a, c, g, or t
  misc_feature (509)..(534): n is a, c, g, or t
  misc_feature (601)..(653): n is a, c, g, or t
aaatggtattcgcttttatctatatctactttgnnnnnnnnnnnnnnnnnnnnnnnnnnnnnnnnnnnnnnnnnnnnnnnnnnnnctgatatcattcctatcccctatttttagggatgacctcaaaaataaccnnnnnnnnnnnnnnnnnnnnnnnnnnnnnngtattgaccatgaattctcatattcnnnnnnnnnnnnnnnnnnnnnnnnnnnnnnnnnnnnnnnnnnnnnnnnnngnnnnnnnnnnnnnnnnnnnnnnnnnnnnnnnnnnnnnngataatgatgatactattaggattaaaaaatcgnnnnnnnnnnnnnnnnnnnnncgtttactaacnnnnnnnnnnnnnnnnnnnnnngnnnnnnnnnnnnnnnnnnnnnnnnnnnnnnnncatataaagannnnnnnnnnnnnnnnnnnnnnnnnnnnnnnnnnannnnnnnnnnnnnnnnnnnnnccataatcattatgtcttctattgcaggctggaatgaagcgctgnnnnnnnnnnnnnnnnnnnnnnnnnngtttataacgacttttatttctacgtgaacaagcttttttttctaatcgaccacaagaccctatacnnnnnnnnnnnnnnnnnnnnnnnnnnnnnnnnnnnnnnnnnnnnnnnnnnnnncacatttatttaatggaggtgaccacgaaatacgtgtgactcctcttatattattatattacttactaatacttcgatccgatttgtgtgactataataataccttaccttaaggataacagcggaattttattgtggagttcatatcgataatatagattgcg

SEQ ID NO: 19018 - DNA, 435 bp, Diabrotica virgifera
  misc_feature (10)..(59): n is a, c, g, or t
  misc_feature (74)..(126): n is a, c, g, or t
  misc_feature (148)..(162): n is a, c, g, or t
  misc_feature (164)..(176): n is a, c, g, or t
  misc_feature (181)..(218): n is a, c, g, or t
  misc_feature (224)..(246): n is a, c, g, or t
  misc_feature (276)..(311): n is a, c, g, or t
  misc_feature (365)..(391): n is a, c, g, or t
atgtaattgnnnnnnnnnnnnnnnnnnnnnnnnnnnnnnnnnnnnnnnnnnnnnnnnnnctagattgaatatcnnnnnnnnnnnnnnnnnnnnnnnnnnnnnnnnnnnnnnnnnnnnnnnnnnnnngtgaagaatatataagaggtgnnnnnnnnnnnnnnngnnnnnnnnnnnnngttgnnnnnnnnnnnnnnnnnnnnnnnnnnnnnnnnnnnnnncctaannnnnnnnnnnnnnnnnnnnnnngagatgggttaggtttagtttcttattgtnnnnnnnnnnnnnnnnnnnnnnnnnnnnnnnnnnnngctggtatattaactgctttatctaatcgaattggtgatgtagcattattgacnnnnnnnnnnnnnnnnnnnnnnnnnnncagatgaaatattatttgatatttagatggaataaaaaccgata

SEQ ID NO: 19019 - DNA, 94 bp, Diabrotica virgifera
  misc_feature (2)..(83): n is a, c, g, or t
  misc_feature (89)..(89): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnaaattnattcc

SEQ ID NO: 19020 - DNA, 949 bp, Diabrotica virgifera
  misc_feature (747)..(747): n is a, c, g, or t
gattgtttttgttcaaagtgaataatacaatagggcttctaataattcctgaaaaacacctaattttaccataatttgttattaacaattaaacgcaccacattggggcttccagaccacttccattggattcagcaacccaaaaaacctataataccaccatcaaatcgcggcgacctaaaagtgcccacgggaccccctgtgttgcggctagactaatatagatacagctgtaaaacatggtagatgctgaggaaaaaaagagatacaatgtgctggaaaacgtgcttaaagatataaatcaaaaatacatttcgtttcctgaagaaatgaggaaaagaaacaataaaattcttcttgagcttttggacgccttaattccaaaaatgaaggaaaagaatactctttttaagcaactgtatttcaccacattttttggaggtagcttctatgatggcttaagagtcggcgcaccagacgaattcgatttggatttgcttatgactctgccaaagatgcttaacatagatttaaatgttagtaacattccaggcttcgttcatgtgaagataactaaccttttagaacttttcaatcaacctcacttaaaggaacgctttaacggtttggaaaaattagtagataaccaacaccatcttgataatctgaaggttcgtcagtggatggaacgtatagtgacgctgaccataaacgattttccccaagagaagggctcccatgtcatanacattaaaagtggcaagtttttggcgaaatttagcaaagcaggtccagcctttacactgaaaagtaatggacgagtcggaaaggataatgtcgttttagacatagacttggtaccctgttttagatttgcgcaagataatgggctaagagtccgttcagacccaatccactccagcaaagtcaaccttcttcatttgtgcca

SEQ ID NO: 19021 - DNA, 136 bp, Diabrotica virgifera
  misc_feature (81)..(103): n is a, c, g, or t
  misc_feature (111)..(133): n is a, c, g, or t
taacagcgtaattttattggagaagtcaaatcgataataaagattgcgacctcgatgttggattaaagtttataattgggnnnnnnnnnnnnnnnnnnnnnnntgttcgannnnnnnnnnnnnnnnnnnnnnnagt

SEQ ID NO: 19022 - DNA, 913 bp, Diabrotica virgifera
  misc_feature (779)..(779): n is a, c, g, or t
  misc_feature (840)..(840): n is a, c, g, or t
  misc_feature (867)..(867): n is a, c, g, or t
  misc_feature (875)..(875): n is a, c, g, or t
ggattctaaataatagcttaaataatagaaatccgtcattacaacagattgtaacttacatcaaaaatattgtggcttggagtacaatcgaacagatatggcacctgtaatagaaaagttagtagaaggttttaaagttgcagaaggtccccattgggacaataaaaagcagtgtttgtattttgtggatattactgagagcactatttgtaaatatgttccatccacgaagaaatttactaaagccaaaattggtgactacaacgtttcgctcataataccagtaaaagacaaaaacaacgaatttgtagtgactttgaacaattctgtagctgtagttgaatgggatggagaaagtccaaatgtcagttcagtgaaaaatttgtatgaagtcgaggctggaactaatagtgcaataaatgatggaaaatgtgataaaatgggaagactctgggcaggaactataggtggaagtcctaaaacaattgatgaaattaagcctgggataggaacattatacagcttctctaataatacaacaacgccacatttaactaaagttggtatatccaacggcatggcatttgatcacaaacggggaaaaatgtattatatagactcacttagctttaaagttgatcaatatgattttgatataatcgaaggcaaaatatcgaatatgaaaactatctttacaattacaaatcaagaatatctatgcgatggtatgacattggatgccgatggaaatatatggttggctgtgtttgggtcttcanaggtatatcaaatagatgcttccaaaccagaaacagttttgagggttgtagaacttcctgncgcacagataacttctgtagcatttgnaggactanatttggatgaactatacgtcacttctgcccttttactg

SEQ ID NO: 19023 - DNA, 679 bp, Diabrotica virgifera
  misc_feature (590)..(613): n is a, c, g, or t
gtagaagtgaaaattaaaattgataaagtttaatcacttttaaaacaaaaatttgtagtgtattttcaacaaaataaggaaaaatgacgtatgttactggtgggcaggtacaacaaaatccacctatatttacaaggatttctaagttttttgatggagtaatacattttgtcatgaacttcttcttaacattgattccaattgaatataatgcccagagcagctcaagtggttctagttcctctaggggcagtactcttggtcgtggaggaggtggaggtggagggggtggatggggcggaagacctggacctggaggtggtggaaatggtggcgccagatttagaacaatgagggacatcaatcctccaactgtaggtggttgtgcaggtggatcatgtgggatgtaaaatgtatcctaaagtcaaatggggtttccctaatattataaattctagttttatgtgaatcgcaattatattatatgtataaaggtctatttttatgttagatttactatggttctgatttattatagttaataaaagtaatttatatgtgattggaagaaaataccttcccaaaatcannnnnnnnnnnnnnnnnnnnnnnnaaacttttttcacttatttgcataagtgaaaatgtaaatttgcatatttgctgtgatcagtggggg

SEQ ID NO: 19024 - DNA, 919 bp, Diabrotica virgifera
  misc_feature (795)..(816): n is a, c, g, or t
  misc_feature (855)..(856): n is a, c, g, or t
  misc_feature (894)..(894): n is a, c, g, or t
gacaaaaatgtataccctattatatattattgtgctattcacaatagcgcttaaatcagtgaatacatcagggcataaggacttttttaaaaagcccccattcaaagatttctacggaaaactagacgcgaatatcagggttggcgacgcaggtgagccgctcatattgacagatcttatcaaaaatggcgatattatatgggccaaggaaaaagctaaagtgacagattttatgccagaagttagcagttatgctggatatttcagggttgacgaaacttataattcaaatttgttcttctggttctttccgtctcagaacgatcctgcaaatgatccagttatcctttggttacagggaggcccaggtgccacttctatgtttgggttgtttcaggaacatggcccgtttgagtttaatgaaaaaggtgagcttggcctaagaaatacatcttggaaccttcaacattcggtcatttacatcgatcaaccagctggtaccggctggagctttactaataaaggatacgcccaaaaccaaaccaaagtaggcgatgatctctactcagctcttgttcaattcttcactttatttgacgaataccagagtcatcccttcataatcactggggaatcctatgctggcaagtacattccagccattgcccatgctattgacaaatataatccttcagcttcagtacgcattaacctccaaggattggcaattggcaatggtttgactgatcccaagtatcaagtcaagtatgcggattatttgtataaacatggccnnnnnnnnnnnnnnnnnnnnnntaatctggagaagacagaaaatcaaagtaagatattttnngtactcataaattatacatcatcatacatacatcatancaacatcatcatcaactcgtacgcg

SEQ ID NO: 19025 - DNA, 923 bp, Diabrotica virgifera
  misc_feature (810)..(810): n is a, c, g, or t
  misc_feature (826)..(826): n is a, c, g, or t
  misc_feature (854)..(854): n is a, c, g, or t
  misc_feature (863)..(863): n is a, c, g, or t
  misc_feature (884)..(884): n is a, c, g, or t
ggtaaaaattatactccaactagtaggtggaaaaaatgtttttcaggaagtgaaatattctcctatagcattctatggtgatcaatctagagatgaaatcaaaagaccagatactttatatttatatttcacaatcatgacagtaataattgatggattcgatggctgaaattcgatggcccaaatggctgaaacgggataggagcacccagtacagaaaacgagatattatagctgtttatcttaaagtatgtcattcagaattacattatagattagataatatagaatttgacatcctagattctaaagtaagaactgaagtagataatataatagacaaaaaatttaatacacagtgtaaaaaactaaataatctaattggcaatagtaaaaaacttaatactcatacaagaaatttttcacatcatagttttttcaatagatttataaacttaacagatactgaattcaataatagtgagatagaacttttagataaaggattcaaacacaacttgcctcaacataataatcaaaaaaatttagaatattgaggtgtagaatggtgaagtagtgttaaacaaaactgctaagaacatagagaaaagtatcattgcaaaatctattaccgatgtatgtagtgaaactaataactcctgttacaaagaaaactaaatagccgtttcaattaaaaataaatcaataaaacatgacataatattttcaaaagcagacaaaggtaacgctactattgctattgacaaaagagactataataacaaaacaatataatttttaactaaccanaacagtacaccactanacaaagatcccacagaaaaataccgaanacaaattanactagccatttgaaattcaanaatcatactaaatccaacagaaacagaataccttaatat

SEQ ID NO: 19026 - DNA, 915 bp, Diabrotica virgifera
  misc_feature (831)..(831): n is a, c, g, or t
  misc_feature (852)..(852): n is a, c, g, or t
atggctataacgagcaaacaatttatataattttaaaccaaaaactccataagaaagccctgaaattagtctatccaccaccacagaaagaacccagtaccttctgctctatcacatatactggcaagataacaacaaaaatagccagatacataaaaaagaaaggaataacaccagctttcagaactaataacaacttaagccaatatattaagaacaataagagccgaaagagaaaacaactacagagtggtgtttacaaactaacttgtgatgactgtccgaaaacttacatcggtcaaactggcagaacctttgacaaacggatagcagaacacaaaagggctttcaacaatagaaaaacagacacttctacatacgcacttcaccttctagatcataatcattcttttaatgaacagtttcaaattctgcatattcaaaataaaggccataagctatctttattagaatctatggaaattaataaattgaaaaatacagatataattctgaatgaccaacgcgtgacaaacagctccccactcctcaatctcttcagttggagactttaaaaaggcaaacccatagtggtctaaatcgcttgagaggggcactctgacgaaacagctgtagtcgcgtagttgtgatgagttttgtggaagtatagaaaacaaacgtcttcagtattttattgttagatattcttaggtgttgttgtctaccttcagactcgcatgttgattcgattttgtgcactccatatattttgttttactttcatttatatatagaccaaatgtagttatccccgtttcagttctatagctntttcgcttaatatcctttttngtgcgctattatggcaagatcttgtataaatacagcccgtcatatttaattttctaacaacag

SEQ ID NO: 19027 - DNA, 874 bp, Diabrotica virgifera
catttaatataataacagcatcgacattagaaataattattattaattcatgttcataattcacgtaattcgaaatgttttatgtaaagacgcctactataataaccaccttgagttctaataaaattttatgtcaattttaaccacaactttagaaagaggtgaaatattatttgtcaatagtaaactaaagccggcctctcacgatactgcagcgtcatttaattttgtcgaattcgactaattgacaacaattttgatcgtgtgtgactcgtgcatccaacaaaaccgttacaattttaccacagagaaacttttttctatgctgcaatactgcagaattgataatatcatcgacgattgtgtcgaaccacgccgcagtattgtgagtggccggctttacggaaactacaaaccagtaaagccggctacttatggtaataagtctctaataataataataaatgtcattaagtcaaaaatatcaattttgtaatagaaatcgactgattttcacataaattttgaaattaactattaaattcaattgctttccatcgctttttatccatttttttaacgtactaaaaaatttagtcaaaatcgatatttttgacctaagacctttttactttttagttgttttgttaaatattgtgatgaattttgtctgcactttattgacaaaagtcatgcatatttatacgcatataaacaagttataataagtatggaaacattttattaatcaaagacagatacactcaagaattttacataaagatccattgaaaattcacggtcagccaacaccaaacggaaaattaatcacttaattacaaaagtattttgtagtcctagtatcctttaaatc

SEQ ID NO: 19028 - DNA, 809 bp, Diabrotica virgifera
  misc_feature (3)..(45): n is a, c, g, or t
  misc_feature (53)..(165): n is a, c, g, or t
  misc_feature (175)..(609): n is a, c, g, or t
  misc_feature (611)..(658): n is a, c, g, or t
  misc_feature (664)..(664): n is a, c, g, or t
  misc_feature (668)..(668): n is a, c, g, or t
  misc_feature (670)..(774): n is a, c, g, or t
  misc_feature (779)..(779): n is a, c, g, or t
  misc_feature (787)..(787): n is a, c, g, or t
ccnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnngctggnatgnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataanattattantaagtttttttagtataaaatt

SEQ ID NO: 19029 - DNA, 816 bp, Diabrotica virgifera
  misc_feature (14)..(32): n is a, c, g, or t
  misc_feature (42)..(85): n is a, c, g, or t
  misc_feature (111)..(128): n is a, c, g, or t
  misc_feature (146)..(177): n is a, c, g, or t
  misc_feature (189)..(228): n is a, c, g, or t
  misc_feature (232)..(262): n is a, c, g, or t
  misc_feature (275)..(389): n is a, c, g, or t
  misc_feature (391)..(412): n is a, c, g, or t
  misc_feature (414)..(439): n is a, c, g, or t
  misc_feature (550)..(570): n is a, c, g, or t
  misc_feature (572)..(685): n is a, c, g, or t
  misc_feature (688)..(719): n is a, c, g, or t
  misc_feature (728)..(740): n is a, c, g, or t
  misc_feature (742)..(807): n is a, c, g, or t
atttttatcttatnnnnnnnnnnnnnnnnnnnctttctctcnnnnnnnnnnnnnnnnnnnnnnnnnnnnnnnnnnnnnnnnnnnnccgtgagagaatatctttatttctcnnnnnnnnnnnnnnnnnncatctctttcgtacctcnnnnnnnnnnnnnnnnnnnnnnnnnnnnnnnntcatttatctcnnnnnnnnnnnnnnnnnnnnnnnnnnnnnnnnnnnnnnnnatcnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnncnnnnnnnnnnnnnnnnnnnnnnnnnncaggattcaaaatatttctcatcattttcaaaataacggttatctcacttctctttctcatcatcatctcatctaatctttctcactcttctcatcaaatttttctcatcnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnngcccactgnnnnnnnnnnnnnannnnnnnnnnnnnnnnnnnnnnnnnnnnnnnnnnnnnnnnnnnnnnnnnnnnnnnnnnnnnnnnnngaagggttg

SEQ ID NO: 19030 - DNA, 768 bp, Diabrotica virgifera
  misc_feature (707)..(707): n is a, c, g, or t
  misc_feature (754)..(767): n is a, c, g, or t
acggcgtttgcgggtgtaaaattattattaggaatacataaaatcaactgtaattaaatggaaatggaaataaagcaagaaattaacgaggaaacgtgtaaaatagaaatagagtataatgatttggatgagttgaaatgtgaaattcaagatgaatccaataggcaaagtactcatgatgcatattctttagatttgaagaattgtcctataactactgagatagaacaacatggaaataaacttaatccatttgaaaaaagccaagaagctgaaaaaggttagtataatagtgacatatccagggttcaaaatacaagtgaaccaagtccactttaactaaatttgagttacagaagtttaaagttaacgcttcataacaaaattagctattacctgttaacatttttaaaagtatgtatttcatttaaaaaggtcaatggataacttaggcatttactttgcttttgttggccccagccccaaacaacttctactggaacaaattgaatgtcattaccctaaaaaatacaaatatggacttgcatcacttgtattctgaaccatcaatatttattatttatggtccttgggcccacattaccccacatagaattattatttatgaccacaccccccaaactttttgtacttgttagttgggtggactctgacaaatttggagcttggtgcattatggtagtggnggcgtttgtttgtcaagctgtcacgaagttgtcaattttatgcaagnnnnnnnnnnnnnnc

SEQ ID NO: 19031 - DNA, 215 bp, Diabrotica virgifera
  misc_feature (2)..(21): n is a, c, g, or t
  misc_feature (74)..(156): n is a, c, g, or t
  misc_feature (169)..(214): n is a, c, g, or t
cnnnnnnnnnnnnnnnnnnnngaacaacaaacaaacacaaaacacaacatttttgtgggtgggggtgttgttgnnnnnnnnnnnnnnnnnnnnnnnnnnnnnnnnnnnnnnnnnnnnnnnnnnnnnnnnnnnnnnnnnnnnnnnnnnnnnnnnnnngggcgggggcgannnnnnnnnnnnnnnnnnnnnnnnnnnnnnnnnnnnnnnnnnnnnnc

SEQ ID NO: 19032 - DNA, 708 bp, Diabrotica virgifera
  misc_feature (2)..(63): n is a, c, g, or t
  misc_feature (70)..(182): n is a, c, g, or t
  misc_feature (193)..(372): n is a, c, g, or t
  misc_feature (374)..(386): n is a, c, g, or t
  misc_feature (449)..(571): n is a, c, g, or t
  misc_feature (573)..(705): n is a, c, g, or t
cnnnnnnnnnnnnnnnnnnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnngttattatcttatcttttcatcatcattattaatcttttcatctttttcatcaaattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 19033 - DNA, 287 bp, Diabrotica virgifera
  misc_feature (2)..(257): n is a, c, g, or t
  misc_feature (263)..(286): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttannnnnnnnnnnnnnnnnnnnnnnnc

SEQ ID NO: 19034 - DNA, 822 bp, Diabrotica virgifera
  misc_feature (161)..(195): n is a, c, g, or t
  misc_feature (787)..(788): n is a, c, g, or t
  misc_feature (800)..(801): n is a, c, g, or t
cataaataatattcatgttaattcatatttttattttctttcgcagtcagcctctcctttccccttttcatataacttctaatcgcttcctccgtttttttgtttggcaaaataccacttttgtcagctgcagctaaaattgaaaaataaacactataagnnnnnnnnnnnnnnnnnnnnnnnnnnnnnnnnnnnaactactggctatcgattgtcttgttacattacagttttattacatttttagtcagtgtttactatattatattgctgaaaatatatgattatatatccttccggtagggatctatgagggagtatcattgagccacatgcccttatcacttgtcgtactgctccatcacataggctgatcagccttatgaattttaaactgacgtgttagcctttttgttttcctttcaacgggctggggatttaactcacattcatcaaggcaaagtgatgtgtggccaaccgttcgtcctgctatgctacccttcataattagctataacaaatcgtatttatcatttctaagtatgtgcccaaaatatgctgttttcctccttttaatggtggtcaaaggttctctgtctcctccggtttttgcaacaccatttcgttcgtaatatgatcagtccatggtattttcaaaatttttctaagaaaacacatctcaaatctcaaaagtctccaactctataattatgtcgacattagcagtccaagcttcagtacctttaaagaagaatagagtagagtggacattttatcactcgatatnnagagtgcaattnngagtttttggtactcatactt

SEQ ID NO: 19035 - DNA, 881 bp, Diabrotica virgifera
  misc_feature (2)..(35): n is a, c, g, or t
  misc_feature (37)..(853): n is a, c, g, or t
  misc_feature (865)..(865): n is a, c, g, or t
  misc_feature (873)..(875): n is a, c, g, or t
gnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaatttatntaatttgnnngtgata

SEQ ID NO: 19036 - DNA, 720 bp, Diabrotica virgifera
  misc_feature (468)..(484): n is a, c, g, or t
  misc_feature (487)..(499): n is a, c, g, or t
  misc_feature (625)..(643): n is a, c, g, or t
tattcataaatataactttctcgtgtaatacattcaaagattaaaactggagcaaaaatccacaaaaaggtagattgaaaacagcgacatcaaaaacggttgagaattatttcaaaaactacaagaatccttaacgaagcggcattttcaaggtgttgggatcgaacatttgagaatgaattcattaaacatttttcttttactaaaaacaagctgatgtattcgacacaaaaacgtcacgtccatggaaatagtaggcacgaagaggtaaagtcaaccgcgcatggaccacagatacaccgatcatgcgcaatgagccaccgtatcggtggatcgtcacatgggaaggtgtcaaaaccatccatgcgcgtctagctcaaaacatttttgtgtcaaatacacgagtatgtagggttttctgaagtgtacatttttttcataaaaactagagagactcaattaacgagnnnnnnnnnnnnnnnnnccnnnnnnnnnnnnnattcctgttatttgacgttcttaatggcaattcatgtcgtcaattattattgacgtttcattctgggagtccaaatgaccaacgggaaaacttgaaatgtagctgctattttaaacgatttcttcnnnnnnnnnnnnnnnnnnntttttaagctgcctaagcagttaaagcacagttgataccatgggtgatacaattaggttttaaagcaatcaaaatat

SEQ ID NO: 19037 - DNA, 854 bp, Diabrotica virgifera
  misc_feature (22)..(48): n is a, c, g, or t
  misc_feature (760)..(760): n is a, c, g, or t
  misc_feature (834)..(834): n is a, c, g, or t
cgtccggaaaatacaaatacannnnnnnnnnnnnnnnnnnnnnnnnnnagttacagtattctgattctggcaaatgccttctattaaaattgaccacgttgttagttttagcagcgaagatcctgttcataatgcaagcaatattttgtcaacagacacatctaagaagtggaaatgccaaacatctggagagaaacaagcaattgttgttttacaacttgaaaaagctagtcaaataacagctatagatataggaaatgaacactccgcttatgttgaggttcttgtttctcgctctggaaacaatgatgatttcaaggtccttctggtcacttcagccttcatgactcctttggagtccagacaaagtcagaatatcaataaagtgaggatgttcaccaaagaccaattatccaaacctgaatgtgatgaaaaatgggatcgagtgaaaattgtatgtactcaaccttttaacagacatgttcaatttggactttcttttgtatcattgcattcaaacgtaagtaaggagagtgaatcaaacagtcagttatctataggaaaatttaccatcagacctgaatcaccagacaacctatccattggtgcattgtttgccaaaagaaaagaactgaaacaggatgaaaaaccaacagcggcagctgctatacgggatgctgcatcatcttcgtctttagctatgtatggttctccaacatgtaaaccgaaattaaaaaataaagatccagactgtacagcnaagaaaaaagcccctcaacaagacgcagacttgtcgaaaccgacaaacagaaacagagacgcacttttttatancagtgacgatgaagaaaata

SEQ ID NO: 19038 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19039 - DNA, 135 bp, Diabrotica virgifera
  misc_feature (7)..(44): n is a, c, g, or t
  misc_feature (64)..(77): n is a, c, g, or t
  misc_feature (80)..(102): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaaaattttacctgatctgagt

SEQ ID NO: 19040 - DNA, 534 bp, Diabrotica virgifera
gtcacccgtaaatatctaagaagtattgggtaaagaacacgcttattcttctaaccctcctccaccacctcctcctggtacggccttcccacggaagaaggatactgatcctgcacatagacctccggaggtgacagaaaatcctgtaccagtagaagagattctttcaaagtgtaaaaatgttttccacacgtgctttgaaggtgctagagttgtgcttacaagaggtcataggaatcacttccagatatcccacacaagaaatacgagctctgttactcccagtggatatagatttgtagctacatatgtgggaacaatacagatatcaccatgagagccatatcctatatcgccgggtgatattgatccctcaggaaatctgaatgacactattatacaccaaattcagtcaaatcttcgagcaaaatttggagcacaggtacagaactaaaaatttcaagtatgtcagctaacaatgaattatagggggtctgattataccgctagttgatcagtagacaatcctgatcg

SEQ ID NO: 19041 - DNA, 755 bp, Diabrotica virgifera
  misc_feature (585)..(585): n is a, c, g, or t
aaattgaagaccgcgatcgtcgtgggtgaaccggctgtcaaaaccacacgcgggccggagaagggccctctctgttgtttacgtgatacataacaatttcgttcaatgcctcatttcatttcaaaactcgttgggactgaaaaaatgaaatccggttgaagttttgatatgtttagtgccagtgattgtgcaagactttaaacacagtgattttttttaattgttactcgaactatttaaaaaatggttgggaaggttgattattcaagtgtgccaacttcggcagacttagaaaacaactcgaaccaaaagaaatacacagtgaaccaaaacggtaaacaaggcgttgtgataccgagatccctctgcgccctaatgggcgatcggtgccttactattagctatactagtaggtctaatagtattcttcttagttcctagggattgtcatgcgacgaaatcccctcaagcattaacacatcaaccgccacagagcgctagcgtactgaatattaatagtaggggtagtagtagtaataatgatgacactaaggctgaaacgacgattgcaccgatagtgacganagtggaggttgaacaaaggctgccaaggagtatagaacctacacattatcgattacgaatattgccgcattttcaaaattctacgagtgagggttcagtgactatgactctgaaacgtttagaagacacgaatgaaatcatctttcacagcagaagcattttaatcgatg

SEQ ID NO: 19042 - DNA, 857 bp, Diabrotica virgifera
  misc_feature (3)..(658): n is a, c, g, or t
  misc_feature (665)..(702): n is a, c, g, or t
  misc_feature (722)..(735): n is a, c, g, or t
  misc_feature (738)..(760): n is a, c, g, or t
  misc_feature (768)..(790): n is a, c, g, or t
  misc_feature (820)..(851): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 19043 - DNA, 836 bp, Diabrotica virgifera
acaaggacctaccaaaaacaccaacaaagccttctgacttaaaagttactgaacatgacataaagccagacagtgacaaagtaacgcctgtcacaccaactaaaccctctgacctaaaagttgctgatcgtgacaagaaaccagacagtgggaaagtgactcctgtcgcagataagaaagagccagcttctcctgttaaacatacctttattaagattactgataaagatgacgatctaggtagtccaaaggcatctcctgtgaaagacgaagatacgccaaaatcacctattgttgatacaactgtagaacataaacctacaacggacaaaatagatcacaaagaaataccaaaaacaccaacaaagccctctgacttgaaagttactgaacatgacaagaaacccgacagtgaggaagtaacatctgtgacacccactaaaccctctgaattaaaagttgctgaacatgacataaagccagacagtgacaaagtaacgcctgccacaccaactaaaccctctgacctaaaagttgctgatcgtgacaagacacccgacagtgagaaagtaatgcctgtcacagataagcaagagccagcttctcctgttaaacataccgctagtaagattactgataaagatcacgatctagttagtccaaaggcatctcctgtgaaacacgaagatacgccaaaatcacctattgttgatacaactgtagaacacaaacttacaactgaaaaaatagatcacaaggaaataccaaaaacaccacacaaaagctgtctgacttaaaagttactaaacatgacataaagccagacagtgacaaag

SEQ ID NO: 19044 - DNA, 929 bp, Diabrotica virgifera
  misc_feature (845)..(864): n is a, c, g, or t
  misc_feature (898)..(898): n is a, c, g, or t
gttgtttttaaccaattcggcattatcgtacacggaacaagatgttgattactacgagatgctgctaaacaaagcaataaaggactcgaaaacctaccaacctgacactagtgcagttaaataccaagctttacgatcaagtccaccagaagattgtggagtagagtatgatttcattattgtcggagcaggatctactggaactctattagcaaaccgtctatctgaaatttctggatggaaaattttgctcctggaagctggtgactatgggaataatattaccgacgttactgggatcagttacaaagctttaatgatgagcgattataactggggattttacagtattccacaaagaaattcttgtttaggatttcacgaaaatagatgtcctcatattcgcggaagaggtgttggtggttcatcattactaaatgctcttgtgtatacgagaggaaatagagaggattatgacaaatggtgctctatgggcaataagggatggtgttacaaagatgttttgccttatttcttaaaaacagaaaggtttcgctggaccgatcctaattctcccgttgagcgtgactatcacaattttagttctacaggattactatcagtagaaataccgatgcctagatcagcacacagcaagatatttctagaagcaaatgaacaaatgggctatataaaccgagatgtaaacggtagaggacaagttggggtcagcagttggcaggcaaatacctacaaaggaagacgacaagaatggaggaagtgcttttattataccatttcaatatagacgcaatttaagagttttaacacaaagctatgtcacnnnnnnnnnnnnnnnnnnnngaacagctacaggagtattatatctgcgtaacgnggtactatacaaagccagagctaaaagagag

SEQ ID NO: 19045 - DNA, 117 bp, Diabrotica virgifera
cacgatgaagtcgtatcatctttgccttgttttttacataaaattcttctcatattatataatatctctatcacgagataaatctatctttttacaatataactttgttctacaata

SEQ ID NO: 19046 - DNA, 904 bp, Diabrotica virgifera
  misc_feature (39)..(63): n is a, c, g, or t
  misc_feature (403)..(448): n is a, c, g, or t
  misc_feature (551)..(568): n is a, c, g, or t
  misc_feature (729)..(729): n is a, c, g, or t
  misc_feature (878)..(893): n is a, c, g, or t
caatcgatgaaaagccctatttgttcttgttgttagaannnnnnnnnnnnnnnnnnnnnnnnntttacaatttcaagataaacattactgaaacataatataaaatcatgtctaataccactgaagtaaaacaagaagttgctgagatgacttgcaaaagagagatagctaatgaagtagatgtaattacccaggattcttttaaaattgaaattaagcaggaagctaccacagaagctacaaatgatgatacatttgattatttagacgttaagaaatgttccatcaaagccgaaatagaacaagatgatggtttctcctgtaaagatatgaaaacggatgtcagtagcctatttacaaatcatgatagaaatgacagtactttcaaccaatatgtaacttnnnnnnnnnnnnnnnnnnnnnnnnnnnnnnnnnnnnnnnnnnnnnncaagaaatcatttccaaacagttatcgtttagagcatatgtcaatacacactggagaaacacgttttgcatgtgaaatttgcaccaaacaattttcaaccaannnnnnnnnnnnnnnnnntttgaaagtgcatactaatgagaaaccatttaaatgtgaaatttgcacgaaacagttttcaataaacacatatttaaaaacacatttgaaagtgcatactaatgagaaaccatttaaatgtgaaatttgcaccaaacagttttcaatgaaagggtcattanaaacacatatgagagtgcatactggtgaaaaagcatttgaatgtgaaatttgcaccaaaaagttatcaacgaaacaagtggtaaagtcgcatatgagtgtgcatactggtgaaaaacatttgactgtcaaatttgcaccaaacattttnnnnnnnnnnnnnnnnaaatcgcacat

SEQ ID NO: 19047 - DNA, 216 bp, Diabrotica virgifera; identical to SEQ ID NO: 10770
  misc_feature (6)..(28): n is a, c, g, or t

SEQ ID NO: 19048 - DNA, 65 bp, Diabrotica virgifera
gttccaaatttttttgatgattaagaataaattaccttagggagaaacagcggagttttattgga

SEQ ID NO: 19049 - DNA, 872 bp, Diabrotica virgifera
  misc_feature (546)..(569): n is a, c, g, or t
  misc_feature (726)..(754): n is a, c, g, or t
cagagctccacaatgacaggtacatacgccggtcagtttgccatggaaggctttttaaacctacaatgggctagatggaagagggttctgtttactcgtaccatagccattattccaacattctgtttggcatttttcagtaatattaacgatttgacaaacatgaacgatatactaaacgccatcatgagtcttcagttacctttcgccaccatcccaaccattgcgttcaccagcaatccacagattatgggagaattcgtaaatggaattccgaacaaagtagctgccattctgctgagcatcgtagtaattatgataaacacgtacttcgttataaacacagtggatgaattgcaactaacctggccccttttggtcgtagtcgtaatcgttggcatcttttatttgttgttctgtttttatctcgtgatacacatgagcatatctatgggaagcactaacttattaaggtataacttcgtgaacaaatatatcatgggccccgtagacgccactttggatattagtcccatcggttatgcnnnnnnnnnnnnnnnnnnnnnnnnagaataaatcttctttgttatgtaggtactgtgtgtgtagaagtagatagtttgtgtttacagtgtgccttataaccataagtaatgtcacaaaatagattaatatatttctatgcgaataatgagagagaatttataagacagggatcttatcctnnnnnnnnnnnnnnnnnnnnnnnnnnnnntagatgtaaatacatattcccaacaacccaaaatataatttatgaactgattacaatgatatttagtggtagttatagcaaatactattgactgatacatccaactccacagaaatct

SEQ ID NO: 19050 - DNA, 173 bp, Diabrotica virgifera
  misc_feature (2)..(169): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctat

SEQ ID NO: 19051 - DNA, 754 bp, Diabrotica virgifera
  misc_feature (248)..(266): n is a, c, g, or t
  misc_feature (372)..(389): n is a, c, g, or t
gtgaaaacattcttcatttagtacgttgacccgctacatcataaagtaatggcaagtgcaatcgacttatctgataaccaagaagctaaaaaattcgccgaagaagaactaaacgaaacggacgaaactagggtaaattctttggaggagcttaaacgatggttacaagaagaagaacctcagctacacgctcgattagaagaccagtatctgctggcgtttttgagagggtccaaattcaacatggnnnnnnnnnnnnnnnnnnnaaagaattactacaagatgaggagggatgttcccgagtggttttcgaatcgggatccagagttgaatcagatgcaagaattaatcaaattgggttgttttgtgccnnnnnnnnnnnnnnnnnntaacagattagttgtaattatccgaacagctgcccataatcccagcatacatacccaggatgacgtttttaaagccggtaccatgatgatggatgtagctgctatggaaaatgttatttcttcacacctttatggagtaactgctattcttgacatgactggacagagttttacccatgttagacaattgacgcccaggataatcggaaaggctgagaattgttggcagaattaccatatcagtgccaagcatcttgagttcatgaatgcgccgaccgccggtcacgtagttatatccataatcaaaatctttctgaacagaaacaaaaagaaagataaggactcatttaccaggccactgaaag

SEQ ID NO: 19052 - DNA, 632 bp, Diabrotica virgifera
  misc_feature (578)..(596): n is a, c, g, or t
gaaacgaatcagagtgccaagtgggccatttttggtaagcagaactggcgctgtgggatgaaccaaacgttgagttaaagcgccaaaatcgacgcttatgggataccatgaaaggcgttggtaacttaagacagcaggacggtggccatggaagtcggaatccgccaaggagtgtgtaacaactcacctgccgaagttactagccctgaaaatggatggcgctaaagcgtcgtgcttatactcaaccgtcagcggcatgtgcggttcgttaatagcgactatgaagccctgacgagtaggagggtcgcggtggtgtgcgcagaagggctagtcgtgaggctgtctggagccgccatcggtgcagatcttggtggtagtagcaaatactccagcgaggccctggaggactgacgtggagaagggtttcgtgtgaacagccgttgcacacgagtcagtcgatcctaagccctaggcgaaagccgatgttgatgtggtgtagacagtacatgggtaaccattaacattgctcccgccatcaccgaacttctcagctacagaatccaagtgtacaccaaccnnnnnnnnnnnnnnnnnnngtaatatgtttgagtagaattgtgatataaagttta

SEQ ID NO: 19053 - DNA, 928 bp, Diabrotica virgifera
  misc_feature (161)..(190): n is a, c, g, or t
  misc_feature (325)..(343): n is a, c, g, or t
aacatttcgtatttcgacaacgacgtccgatgtggaagtagaaaccataataaagttattttttcaagtaaattgtggcttatttccccattaaaatagttacaataattacaaaaatgccacaaagaaatagctttttcacaaacaaataagtattttgnnnnnnnnnnnnnnnnnnnnnnnnnnnnnnctttaacttaagattataacttaattcttgttttctatttctgatgtttttatttatttacattcaatattaatctgttttcttgtataatctacttcgcaataattatgtgatacattggacttaaactgaatnnnnnnnnnnnnnnnnnnngggcaacattgtcaacttagatctctgatgtagataatgaagagcaacggtatctacagttggaaaaatgaaagaatagggcttttcatcggttgtcatttgtttcgagcttctgtcatgtgtcacgtggtattgatgtgtctgcgtcatatgtctttggtttgtattgttgtatgtaccttagacaaggaaaaaaagagaggacgggtaacactcatttaacacacacgttccaaaagtgaagccggtttttggtttgtttgtcaccagaaacatggcggtcacgtcaaaaataacaatgggttgccagtggtgggtgttcgttgaaggttaaaatttcataaaaaataaagtaaataatcatctaaaattcgtaataaaaacatatgtatgacttgaaacatatgtacgtaatatgagaaacttaataaaacatttaccgtacacaaattcttcatttaaatacatttcatgtttttatttaaatactcaatgcataacaataccccaaagatacgtcgatgatcaaaatctctggtgtcagtttggcttcacttttggtcataggattactcgtcctctctc

SEQ ID NO: 19054 - DNA, 582 bp, Diabrotica virgifera
  misc_feature (22)..(45): n is a, c, g, or t
  misc_feature (554)..(575): n is a, c, g, or t
gggaaacccccgggaagggggnnnnnnnnnnnnnnnnnnnnnnnncccggagggggcgggtaatttcttcccggggcccgggggggggccccccggggccccccaggggttggattcctaaccttgcaagatgggggccccccccctttctgggaattttcgggacaaaaccccgcgggggggggccccccgggaaaacccccggtccggggccaaaagccccccccgggaaagggggccctttggaacccccaaagggggtccccgtggggggcccggcgcatggggggccccctaaaacggggccttagggggggccgggggtgggggaccccggccccggcgcccccccccctttgggggggccccaaaaacgggttggttttcccccgccctcaccaaccaagaaaaaacggggggggccatttagggggggggaaacccagggaaatttttgaattaataaagaacccggaatccaccggcgcaaaggggaaaaaactataagaaagcacgcaaaaccccggaggggcgcgggttattttttttcccgnnnnnnnnnnnnnnnnnnnnnngggggcc

SEQ ID NO: 19055 - DNA, 764 bp, Diabrotica virgifera
  misc_feature (601)..(618): n is a, c, g, or t
  misc_feature (650)..(650): n is a, c, g, or t
  misc_feature (685)..(700): n is a, c, g, or t
  misc_feature (715)..(717): n is a, c, g, or t
  misc_feature (740)..(740): n is a, c, g, or t
actaaacattgcagataaaccgagattaaacattacatttcaacacgtaaaagagttcaagatattagttccaatagtgatcaaaattactggagtacaagaaacaaaatgactaataaaatattggacgttatacctcaaaggtatgttcttggagttatgggtttcttggcaaccactaacacatatgcgcttagggttgtgatgaatattgccattacacaaatgactcttcaacaagcagctacacaggtggatcctaatgcatgtcccggtgatgacggaagtacaagtggtaatagtacaactcaaataaatgatccggtatatgactggagcgaaagtaccaaagggctaattcttagttcatttttctatggctacataattactcatttacctggtggaatgttagctgaaaagtttggtggtaaacatattttaggtgtcggaattttaataggagcaataatgacagtcttaacaccttggattctcactgcaactgatggtaattggaaagtattgatccttacaagaatttttgttggatttggacagggtaccagtaatccagcaattaattcacttctcgcaaaannnnnnnnnnnnnnnnnnagagcaacaattggtaccttggtgtatggtgngagtcaaatgggtacaattatttgtagtgccatgnnnnnnnnnnnnnnnngttacaaatcatggnnncgtcggtgttctatctcttttgnaggattaggtattttatggtatat

SEQ ID NO: 19056 - DNA, 919 bp, Diabrotica virgifera
  misc_feature (728)..(728): n is a, c, g, or t
  misc_feature (799)..(799): n is a, c, g, or t
  misc_feature (809)..(829): n is a, c, g, or t
  misc_feature (840)..(840): n is a, c, g, or t
gacaatcaaaagaaagtgagagaaggtttttacaaaatgtgtgacataattaaaccatccgacaagtctaggaactttgttactcatcggtgatctctggtgcaataatattgtgttcaaagacgatcaaagctcgtgtcttctattggacttgcagatggttagatatagtagtccagtatatgatgtttgtatcgtactggcactgaatacagatcaagatactaggagagaatatagcaaaaggcttttggatgattactatacagatctaaaagataatctaagtaagtgtggcattaatatcgaggatgttttgagctatgagcaattcatggaggaattcaaccaatttactcctgcttcactcatgcgttcgttatctttgttatctatagtgctaccacctagagaaaaaatgaatgaatttataaaagatcctgatgatgctcagaagattatagttggtgatcgcagtggtgttataaatgtgttttgggatgtactggaagaaagattaggaggattgctcgaagacctttatgtttgttttaataataaataatctttaacattctgtgtgtaatcattttaggggagtgcatatagattttcacttcggaaaaaatcaaacaagatagagctttttgtaatttcattaagaaatgtttaataaacaacatatcaaaaaattctactcgagaagtgggtgcttcattttttattanacaaatgaactacgaaattagatgttttttttaaataactccaaaagtataaattttacaaaattaagaanaaattcagannnnnnnnnnnnnnnnnnnnnatataaagaanttttctaaaattaaatctgtatcttctatattttttatttatacgctagagtcacccctctcacaaacattggcgcact

SEQ ID NO: 19057 - DNA, 907 bp, Diabrotica virgifera
  misc_feature (261)..(278): n is a, c, g, or t
  misc_feature (470)..(488): n is a, c, g, or t
  misc_feature (574)..(595): n is a, c, g, or t
gtggaactcgccctaatattattatagcctgtgcccagggactgattcacccatttctcgggagcgcacccctttgaatggtagcactccgcggttttttcataataggtatatggagattcattgaccatatgaagtggtaaagccccgttaacgttgtggttcctttctatagtacaacgtttcccaaccggtgggtcgcgacccaccagtgggtcgcgggcggatttcaggtgggtcgtggcgtagatcttacagtannnnnnnnnnnnnnnnnnatataatcatggatgagggatgggtcgcgaatatgaaaaaacatcagaaggtgggtcgccagacataaaaggttgggaaccactgctatagtacataatcaatagcctatttattgtgattttagtataggcatgtggtaaacataatctcagatattgctcatcgcactcgtatttttggactaaacttgnnnnnnnnnnnnnnnnnnngacttgaatattgaatatatttattacaaaattagcaaatttactagaagcagcaaaatatatggaaacgaaaaattgcagatccnnnnnnnnnnnnnnnnnnnnnncttaaataatttgcatgtatgtgaaacttaatatacttgcgtctgttatactacaccatccaataataccacttctaacagcgtatttaatatattttactcagctcagcacgtctacaataatattataacaaaatcgcatatgcagagtaagttaaaaataagaaaacgcctaacactaaagataaatcattcacaattcacacacacgtcttaataataatgacccattttttaagatgtaaacaaaataaattcgttttacaaatatccttagaaactctttctgtgaagaaagacttcttttttttt

SEQ ID NO: 19058 - DNA, 89 bp, Diabrotica virgifera
  misc_feature (3)..(79): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnattatataat

SEQ ID NO: 19059 - DNA, 717 bp, Diabrotica virgifera
  misc_feature (41)..(714): n is a, c, g, or t
gaaaaatattctctcacaatactaattaactatcattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 19060 - DNA, 954 bp, Diabrotica virgifera
ctccgtatctatgaataaatcgtggttgttttgttgtagttgacgacacccgagtgtgaccgtgaattgctaatattggagtcgctgactttggagttttcaaagcgagtggcctgcgttgcagcgtcaatgtctcctgtttatgtgatgtggacaatgcatgtagacagtgtttgtttgggacttataaaaattaaatcatatggattgctcttgtttttgatgctgatataaattctgtatgacgttcttaagccaggatattttgccctctcatcagatgtcctaactactcaagttttcatcttttgacagttaatattattcccgctccatttcctatcattctagttacttccacgtttgacattctttgaatccatgatattcgtaggaattttcagtatcaccaaaattcaaaggcggccaacttattcagatgcacttgttttggtgtccacgcttccaagtcataagaagagtagaggaaatgtaacatcgaagcatccttatgcgtatttttaaccatatatcccgacaacaaagagacttcttaagtttaatcagtgatgcacgtgctttttcaatcttaatttctttggtttggtctacatttgatgttgcccttttttctaagtatttgtaggtatccacactctcaattacattcattaatcaattgcatgtttgcatctgatgattaagtcatgactatgcatttaattttcttccaaactcatctttagccaattttcttccattttagtccattttcttcaagttcatgacagcattcattcaggcgttgcattacgttctgtaaatcatttgtgttatccgtaatgattactggaatcggcgattgcagccattttttagggaattgtggcaagcctgatatattattagaaaaaacatcaataaccttctttctcgaggagttttaaaaattca

SEQ ID NO: 19061 - DNA, 887 bp, Diabrotica virgifera
atttatttcaaggcacaggaacaagttttacattgggggtgctattatctcgggatctattttattaaccaaatatgcccagtataagcttagggaatggcaagaaagggaaaccaaggagttcttcgacagaaaccgcaaacaaaaccattttgagagcatagaaagaaccaaaagccaaacattttctaattttgccgtggctctattagatttaatttcagatacagtaaacacagatgaaattattgaacgtcttaagacaaatccagaaaacaaagttgaactatggaacaatttaaaggtattggtcatgacaaaagtagcagtcactgtctattccttagtaatgttagctgttactttgaacatacaacttatgataattggtggatatttatataaggatcccaatagtatacccacagatgtccaagaaaagtatttggcacattgtcaaaattttattaatgaaggggttaagaagttagctaaacttattgacaatgaggttcaaaaatatgttggtaatatggaattaacaaagcagctaaaacttggagatatagaaaatttaaactggtctgtacaagtagctttatcttcacaaagggatggtccaattgaatcttttaaaagctttatattttctacagaagaaactagtggtgatagcattatatatgacaatatgttaagagacactgcagacttcctagatagtgaagaagtaaagtcactcactacccgttgtatcaatcaaggattcattttactgggagaccagctggcagaattgtatacaaaaggtaacatggctggagatgccagtaatagcgacgaatcatttaaaaatccttttgaattacagaaaacctctagctaag

SEQ ID NO: 19062 - DNA, 680 bp, Diabrotica virgifera
attcagaaaagcaaaaactacatttttttactcgttaatttttggatatcactaataaatttgaatttatttaaaaaaagcatagaatagagaaatagaaatagaaatatgttttattgtcactgaaaattttacaattttgtggacaaagcttacatacagtcaaaaaatatcagtaaacaaataacaaatacaatttactagaattagataaatcgtcaaatatcagtatacaggagactccctctataacgagaactgaaattgcggactaattacctcgttataagcggatttcgttatatcagacaacaataatattgtgcataccaccactactaaaatgttttaatgcctcttacatagtttattaggtgtcgatggtcgacttcaacaatgaaacgtagccatcgtaaattgtaaaattcaatattggccgatagataaatagacaggaagtttattacaatttattacagcagtggcctcggtaagcccaaagctgttgggcgttacttcatacatgcagttagggtatttatttatagccatcacccacgcccaaaacaggtaacgaaacatattcttcgatttcatttttccctcggtataaccaaatatgcctccgttatagaggcgcgttagatcaaaaggattttctgggacctccagcggtcccc

SEQ ID NO: 19063 - DNA, 329 bp, Diabrotica virgifera
  misc_feature (2)..(141): n is a, c, g, or t
  misc_feature (143)..(206): n is a, c, g, or t
  misc_feature (208)..(226): n is a, c, g, or t
  misc_feature (231)..(268): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnngnnnnnnnnnnnnnnnnnnnctgcnnnnnnnnnnnnnnnnnnnnnnnnnnnnnnnnnnnnnncgtcaaatttttttaaagaccacaagcccctataaagctttacatatattaataacttttt

SEQ ID NO: 19064 - DNA, 50 bp, Diabrotica virgifera
  misc_feature (7)..(45): n is a, c, g, or t
gtctccnnnnnnnnnnnnnnnnnnnnnnnnnnnnnnnnnnnnnnntgacc

SEQ ID NO: 19065 - DNA, 871 bp, Diabrotica virgifera
gaaattatattatctagaaaaaatatggaatcaagtgacgaggatcatggcatcatattgaggataaaaccaagtgattatccttctgggtatttaaaaaccactgcaaaattcggtcaaccgtatctgccgggaggatgggacttggaagacgaaaaaacatccagagctcccggtcctcactgtttcgcctactggatagcttcttcccataataatgacgttatacattcaagatgccttgccgttcagccaacatggatgaccgacaatagaaacatattaggaactcgaaatatcgaagatttaatgataccagggactcataactcaggagcaaatactgccggaggaacatttcaagagaagttcattttgaatcaagatcgtgacatatggactcaattagtttttggaattaggtatttggatttcaggataggatactatggagctgaaggatttttcctaaaccacgacaaattcaaaatccaggaagtccgaccgctattccgacagattcgaaaattcttggaagcttcaccggatgagatcgtgattttggatttccacaggtttccccacccctcccagttcccacctcatttgcatactcaattcatcgaaattgtgaatgaagatctgggagatttggcggtacctgtgttcaatggacgcaagggaccgacgttaaacgagatctgggctactaataagagtttgattgttgcttataataatcagcaggttgtggaagctgcaagagatcttaatttggtcgatagaaaaccctggctatggtatcccctttcccaaattttgggcagataccaagtctcctgccaaaactgaaaaaatatatggagacgtc

SEQ ID NO: 19066 - DNA, 234 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(192): n is a, c, g, or t
  misc_feature (201)..(231): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnacgaaaggnnnnnnnnnnnnnnnnnnnnnnnnnnnnnnngat

SEQ ID NO: 19067 - DNA, 751 bp, Diabrotica virgifera
  misc_feature (8)..(490): n is a, c, g, or t
  misc_feature (497)..(534): n is a, c, g, or t
  misc_feature (554)..(567): n is a, c, g, or t
  misc_feature (570)..(592): n is a, c, g, or t
  misc_feature (600)..(622): n is a, c, g, or t
  misc_feature (652)..(683): n is a, c, g, or t
  misc_feature (690)..(726): n is a, c, g, or t
aaatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattacgctgattaaaaccaatattg

SEQ ID NO: 19068 - DNA, 98 bp, Diabrotica virgifera
  misc_feature (29)..(56): n is a, c, g, or t
acccttagggataacagcgtaatttttannnnnnnnnnnnnnnnnnnnnnnnnnnntgccgaccctccaagctggattaaagcctatatttggcgtag

SEQ ID NO: 19069 - DNA, 894 bp, Diabrotica virgifera
  misc_feature (423)..(442): n is a, c, g, or t
  misc_feature (621)..(643): n is a, c, g, or t
  misc_feature (723)..(723): n is a, c, g, or t
  misc_feature (846)..(869): n is a, c, g, or t
gattgaaaaaggcaagccggttcctcgtgctagtttttaatgaaaattcaatgtcattttcataacaaaattaataaagggcagtgaggaaaagtgtatatcaaataatatagtatttgaaattaagaccacagcaatttcgctgacttgaaaacaaatgaagatgtcaaaattttgaagttttcaatattttcataaaaaatattcgcaaatattaatttcatacacaaacattaataataccctgcatttcgctgacttgaaaacaaatgaagatgtcaaaattttgaagttttcaatattttcataaaaaatattcgcaaatattaatttcatacacaaacattaataataccctgcatttcttagttttccggtaccagtactatttaatttatacattttggatataagttcgtatgnnnnnnnnnnnnnnnnnnnncagtcaacaatgttaagaattcggcagatatctaaagtattggctgtagccccactgaaatttacttctatgagacatctagcacactcaccattcaagggaatcctaacaagagcaagcctatgtagtagtataagaacttattcaagcaaaaatgatgattgtaaagatgatcctannnnnnnnnnnnnnnnnnnnnnnccttcaattaaagattgtaagcatcctaatttaatgagtgagatacctgacccaaaatgtgactggaaggaaaaggatanagctgcaagggatagaaacaaaaagctgctcatctttggattattactaactgcatttacgataggagtactattttggcttaatccatttcatgtagaggaaagtgaagcaaaaagttgagnnnnnnnnnnnnnnnnnnnnnnnncttataaaacatccactacattcaa

SEQ ID NO: 19070 - DNA, 959 bp, Diabrotica virgifera
  misc_feature (84)..(101): n is a, c, g, or t
  misc_feature (608)..(632): n is a, c, g, or t
  misc_feature (861)..(861): n is a, c, g, or t
  misc_feature (903)..(920): n is a, c, g, or t
cttgatccaaaaaatttaaattcagtaattaaacgacctaaaaatgttttaatccccaccttagaagatgtaacatacaatttnnnnnnnnnnnnnnnnnncactgtattagacttgaaagaagggttttggcaaattcctctagataaaaaatccagtgatctgtgtacgttttcaactccatatggatgctggaaatttttaaggcttccatatggattaaatatggctccagaatattttcaatatattaatacaaaaaatttctcagatattccgggagtacttgtttactttgatgatatactcatagctgctgaaaatgagcaggatcacgacttaatattgtcaaaagtgatgactagggctaggaatttaggtgtcaaatttaatgttaataaagtgcaatttaaagttggacaagttaaatatcttggtcacatgttttcagcaaatggcatggaaattgatacagaacgcataagagcaatttcagctattaaaaatccagctaataagaagcaattacagagcatattaggcatgacaaactttctctcgaaatttgtaaataatctatctgaattaacgtcccccttaagggaacnnnnnnnnnnnnnnnnnnnnnnnnngtggctacccattcacacagaaacacttaaaaaaattaaacaaagaataacagaggcaccagtgctagctaacttttcagaacaaaaggaaatcacaattgagacagatgccagtcaaagtggattaggatgctgtctgttacaagaaaacaggcctgttttttatgcctcgagaagtttaaccaactcagaatcaaattttgcacaaatagaaaaagaattactttgnaattgtatttgccacaactaaatttcataattttatatatgnnnnnnnnnnnnnnnnnncacagatcataaacctctcgttagtatttttgaacaaaa

SEQ ID NO: 19071 - DNA, 866 bp, Diabrotica virgifera
  misc_feature (5)..(31): n is a, c, g, or t
actgnnnnnnnnnnnnnnnnnnnnnnnnnnnaacattttattgattcactcgtacgaaatgaaccgaaaactacttgtctgtgaattaaacgaagaaaaaaggactcgaggtcttatgactaacatcagatgaactctaactggtttcttccactatataccatggaaagtcagacaacacacttctgaataatcacacgacacaaaactgggaacacagaaaggaaatttagaccctcgaggctttctctccgacttgtgaccaggttcctggacgtgaaaaaggacttttccatgaaaattaaacttcggatcaaaaaaattttagtccggactgtgtgaaactggtaacatctgttcccaggagcgtcacacaaaagctgctgaattagttgatacccgaggaaatgttgccaggaaatgaagttgaatcatgtgattgataacaaggagaccaactcacatactcacttgcaggtggtactggatcagggatgggtactctccttatctcaaaaatccgcgaagaatacccagacagaattatgcacacgtactcagtagacccctcacccaaagtatcagataccgtaccacaaccatacaatgccacaactttcaccacgtcaatttgcccagaaaacacacatgaaacctactggtattgataatggaagctctctatgacgtttgcttccataactttgaaagtcacaaccacccacaatatgaagaattaatcccatgtggaatcctcacaagggccggggtaacaacctgtttaagcttccaacgaaagtgaatgctgacttttaaaaaatggctggcaaactggtctccttcccccgcccccccccttcttcctg

SEQ ID NO: 19072 - DNA, 202 bp, Diabrotica virgifera
  misc_feature (10)..(30): n is a, c, g, or t
  misc_feature (80)..(92): n is a, c, g, or t
  misc_feature (94)..(107): n is a, c, g, or t
  misc_feature (121)..(163): n is a, c, g, or t
caaaaaagcnnnnnnnnnnnnnnnnnnnnngcaaaccccataggggtttataaaattttccaacagttctttttagcatnnnnnnnnnnnnncnnnnnnnnnnnnnncaatttggggggcnnnnnnnnnnnnnnnnnnnnnnnnnnnnnnnnnnnnnnnnnnntcaattaataaatctactgggccccactcattttttttt

SEQ ID NO: 19073 - DNA, 79 bp, Diabrotica virgifera
  misc_feature (8)..(69): n is a, c, g, or t
cgggggtnnnnnnnnnnnnnnnnnnnnnnnnnnnnnnnnnnnnnnnnnnnnnnnnnnnnnnnnnnnnnnttttttttga

SEQ ID NO: 19074 - DNA, 816 bp, Diabrotica virgifera
  misc_feature (3)..(699): n is a, c, g, or t
  misc_feature (701)..(739): n is a, c, g, or t
  misc_feature (743)..(804): n is a, c, g, or t
ctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnngtgnnnnnnnnnnnnnnnnnnnnnnnnnnnnnnnnnnnnnnnnnnnnnnnnnnnnnnnnnnnnnntcccaatttttt

SEQ ID NO: 19075 - DNA, 924 bp, Diabrotica virgifera
  misc_feature (98)..(125): n is a, c, g, or t
  misc_feature (172)..(193): n is a, c, g, or t
  misc_feature (274)..(291): n is a, c, g, or t
  misc_feature (317)..(342): n is a, c, g, or t
  misc_feature (659)..(676): n is a, c, g, or t
aaaaaaaaaaagaatgtgtgtgtactttgtacgcacgtaagaagttagctatacttcgattatagattgcaacgaaattaatatgtactttaaacagnnnnnnnnnnnnnnnnnnnnnnnnnnnnctaattttaatacttactactttccaaaaaatttttaaaacaatacnnnnnnnnnnnnnnnnnnnnnncacacaaacacattgaaaaatgccacaaagaaatgatttctgaacaataattgttgacaaaaattttaactaaatattttnnnnnnnnnnnnnnnnnncaaatatacttacaatcataaaatgnnnnnnnnnnnnnnnnnnnnnnnnnnttgcatagggattcgaacccgcgtttattctggggcttaggatttgaagtcgaagcctctactcattttgccacctacacgtacttgtcatgtgcgatgataggccaactgaacggtttactatttgacagttctgaatttaatcaaattagtttgatgtttgtggaaataaaatattaaaatgcaacaaaacagagtaagaaaacaatatattagatgaagattgctagaaattttgttggtaatcaatttatgtaaatcaaagcattacctgctagataggtacatacattttccaaataggtaattacctgtgnnnnnnnnnnnnnnnnnnctgaaacatttacaataattacgtacctgttgcttttaaaaactatttaaaaagtcactagaattatgaacttgcttttttctctatgctcacaacaataaaaactaatatacacaacatttgtttacctataaccgacatattgaacaattattgacaggtcattgtaattaccccatcagagcacgtataacttttcagctgcgcccaggaccaaggcttttgatgaattcgcgcacatataaaat

SEQ ID NO: 19076 - DNA, 744 bp, Diabrotica virgifera
  misc_feature (3)..(738): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggg

SEQ ID NO: 19077 - DNA, 936 bp, Diabrotica virgifera
  misc_feature (233)..(256): n is a, c, g, or t
  misc_feature (269)..(286): n is a, c, g, or t
  misc_feature (320)..(342): n is a, c, g, or t
  misc_feature (568)..(588): n is a, c, g, or t
  misc_feature (667)..(686): n is a, c, g, or t
  misc_feature (751)..(799): n is a, c, g, or t
ggtatttcttcaattttaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccctcttccctcaacattttttaggattaataggaatacctcgacgatattcagattatccctgaggatttatattatgaaatattggatcttctattggatccctaattttctttaattggggg

SEQ ID NO: 19078 - DNA, 886 bp, Diabrotica virgifera
  misc_feature (3)..(609): n is a, c, g, or t
  misc_feature (616)..(653): n is a, c, g, or t
  misc_feature (673)..(686): n is a, c, g, or t
  misc_feature (689)..(711): n is a, c, g, or t
  misc_feature (719)..(741): n is a, c, g, or t
  misc_feature (771)..(802): n is a, c, g, or t
  misc_feature (809)..(867): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggtggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnncggccgctcaaaaggatcc

SEQ ID NO: 19079 - DNA, 253 bp, Diabrotica virgifera
  misc_feature (2)..(39): n is a, c, g, or t
  misc_feature (50)..(72): n is a, c, g, or t
  misc_feature (82)..(102): n is a, c, g, or t
  misc_feature (104)..(117): n is a, c, g, or t
  misc_feature (120)..(136): n is a, c, g, or t
  misc_feature (149)..(180): n is a, c, g, or t
gnnnnnnnnnnnnnnnnnnnnnnnnnnnnnnnnnnnnnncttttttagcnnnnnnnnnnnnnnnnnnnnnnncttcatttannnnnnnnnnnnnnnnnnnnncnnnnnnnnnnnnnncannnnnnnnnnnnnnnnncaattttttggannnnnnnnnnnnnnnnnnnnnnnnnnnnnnnncgcttaagggaacaaaagcgcaactttttaatggacagagtccaactcccatcaaaaaaaaattgctatacct

SEQ ID NO: 19080 - DNA, 132 bp, Diabrotica virgifera
  misc_feature (3)..(50): n is a, c, g, or t
  misc_feature (67)..(90): n is a, c, g, or t
ccnnnnnnnnnnnnnnnnnnnnnnnnnnnnnnnnnnnnnnnnnnnnnnnncgctaaggtaaccacannnnnnnnnnnnnnnnnnnnnnnngatggatatgcaaggtctgtatgaacaaaaaaaccctgtctt

SEQ ID NO: 19081 - DNA, 97 bp, Diabrotica virgifera
  misc_feature (4)..(85): n is a, c, g, or t
gaannnnnnnnnnnnnnnnnnnnnnnnnnnnnnnnnnnnnnnnnnnnnnnnnnnnnnnnnnnnnnnnnnnnnnnnnnnnnnnnnnccagaagacccc

SEQ ID NO: 19082 - DNA, 961 bp, Diabrotica virgifera
gagaaatatacacgtacaaagatgtcgtccatgttggtttaacagactttcctagtatgcttccaactcaaagctcgacgctttatgccaacaatatctccaaatttctgctatcgatgggcgaaaaagatcacttcaatataaatctggaagacgaagttatacgtggaagcataattttagacaagggaaagctcatgtggccgccaccaccacctccccaaacacaaccgacacctgctacagccccgaaacaagaactggaaactttgaaggcagtacctaaggcaatttctcctttcaaagctgacttaaataaatcactggctctcacaacaggtattggcacgatcttaggtctgggaatgatttctcctaagcctgaatttacagctatgttatcagtactcgggctctcgggcatagttggctaccacacagtgtggggtgttaccccagcgttgcactcgcctttaatgtccgtgacgaacgccatttccggaatcacagctgtaggaggattacttctgatgaatggaggatattatcctacaaattcggtcgagactttggcagcaacagcagcttttgtgtcgttcatcaacgtattcggaggatttttagtcactaagcgaatgttagacatgtttaaaaggccgggagatccgaaggaatataactcgttgtacgccatccccgcagttggtttcttgggtgcctatggctgggcctccatgaatggattagcggagattcatcaagctgcttaatctagcagcttcgctttgttgtgttggagctttagttggactaagctcgcaggcaacttcaagattaagaaaaaaatttaggaataatggggcgtactggcagggataccccttaacctaaggtcccccttcccccaaccaacggaagtattacccccaaaggggcccccggccccagcagggggggggcc

SEQ ID NO: 19083 - DNA, 683 bp, Diabrotica virgifera
  misc_feature (23)..(23): n is a, c, g, or t
  misc_feature (101)..(121): n is a, c, g, or t
ccccctcccggggccggagaganggaaagaagaaagagggaggccccttgagcaacacggcaaatcgaataaaaagcagacacgcacaacgacgcgaaccnnnnnnnnnnnnnnnnnnnnnctggtaatgtataagaaacatcctgacacaagaagcaagaaacgacaagatatctcccctagacaccacgaaccactgaaaaaccacacaacctttacaaaacagcgatggatggacacaggacagtaacaacgagaggaccatagactatggtcagaaccgacctcagaaataaggtgaagaagaacagaagtggcagacaccaagcgaaccaaaacaaaccagcaatgaagaaaaggtaaacggaatgcctgcacacgaaatccgagcggctgacaaagggggaaacaagagaaaccacaacgtgagcaaagctcacgctgggggaaggcatgtgaatgacgaaaaagacagacggcaacaatacatacaccgaggaataactcttgacagaattttggacgaggcagatagggacagtgaggaagatgaggaagatgacgaaacaacggcgcaatgtaaaaacggaaggaacgcccacgcgaacgcgaatggcgaggacccaccgagaatgacaaatgggagcagcccggaagaagtgctgcgcaaggactaccaaaac

SEQ ID NO: 19084 - DNA, 781 bp, Diabrotica virgifera
  misc_feature (612)..(631): n is a, c, g, or t
  misc_feature (637)..(650): n is a, c, g, or t
  misc_feature (653)..(665): n is a, c, g, or t
  misc_feature (703)..(734): n is a, c, g, or t
taagtatcacaatctgagaatcttttatcgcttgggttcttcgtgctcgatatataggtatgttaggactaaaccaagcccggagcgcaccggtagggacacagatagcgtaagatttagaagggcgagcagacttaataaaaaaggcgatacagcaattctaaagataaatcgaacatctagggcgaagtgttacatcttctgattcgaactctccaataagattacgctcgttatcgcctaaaggtagtatgttcttataatcaagaaaatcggatcgaaagattattaataaatgtaatagtgtaaaaaaagttaagtttatttgttatgtcaccccaagtaatagagagttatatcatataaatgagagatgtaatactaaataatgtgattaattattttataagaatactgaggggtcttctcgatttatgaaaaaattgaaggttttaaagttataataaatgtcattataataatgtagaagaatgtttattattcatccaaccctgcattcgcagtgttcaataaatgaactaatgattatggtagcttcatcacgtactgaaagacgagatcattctaattaagcagtgttatatgcgagannnnnnnnnnnnnnnnnnnngacggnnnnnnnnnnnnnnggnnnnnnnnnnnnngacggattactatattaaacctatatatttttagtacnnnnnnnnnnnnnnnnnnnnnnnnnnnnnnnnttactagatttactaaatttagatttatatcttaataaaaaatttat

SEQ ID NO: 19085 - DNA, 899 bp, Diabrotica virgifera
  misc_feature (8)..(792): n is a, c, g, or t
  misc_feature (794)..(893): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacag

SEQ ID NO: 19086 - DNA, 851 bp, Diabrotica virgifera
cggctaattcgggaaaattataataaagaaaactaatagagaaaatcttcttaaatcgttatgcggaacgccggtctttcgaaaccataatttctcggatctatgagaacttcgataacttaataaaattctttcgggccaaaataataaactaactcccggtatgaaaacttcattcggggtaaattaactcggatgaacgggctaatattcctttcgaaacggcaaacgggctatgtagagagagccaaaaaggggaaacggcacggttaaacacaataagaatcaaaaccatgctcgtttctttcttaacggcatcgggtctttctcatgtaagtggccaagggattttcgtaaaattatcgggcccaaaatagaattcaaatcggcattcgaagttcagcatgaacggatggataacggacgtttcgggttaggaaatcaacagtggaaactacacttcgggtcgatggaacgcatcgagaacattgggattcctcgataaacgatcggcaaaatcatctcggattcacaggtttcggacgaaacgggagtcaactcacgatttaggcccggcaaaaaattggactatcatcgtcaataagaactcgggactggaaaatggtattttctatcaggacatttccctgggaacatcttcaagtttttggtaataggagctttaaagaacagaatataatggaaaaaatcgctttaatgtcagcttatagttcggtaggtaaaggatcacaggagtctaagagtttgaggatggtgagcatatcttgaatcttgaaataatattggtggacatttaaatattcatagtctggtgtcgattcttggattat

SEQ ID NO: 19087 - DNA, 956 bp, Diabrotica virgifera
  misc_feature (193)..(211): n is a, c, g, or t
  misc_feature (243)..(256): n is a, c, g, or t
  misc_feature (259)..(271): n is a, c, g, or t
  misc_feature (280)..(339): n is a, c, g, or t
  misc_feature (371)..(402): n is a, c, g, or t
  misc_feature (404)..(841): n is a, c, g, or t
  misc_feature (845)..(946): n is a, c, g, or t
cggacggcgtgttgcgttcgattcttataaaatccgaaacgcagtcgctcagtaaaatgtaagaggaaaattatttcgctcgaacgatacgccgaacgcagtatccgtgagtggaacgtttgtagttccgtcgaacggaaaaatttaatacttcgaacctcgtgtcgcagggattatctaattaagaattacnnnnnnnnnnnnnnnnnnncgaaggtgctcatgaattcgaatttttatcgnnnnnnnnnnnnnntgnnnnnnnnnnnnnacgtaatgnnnnnnnnnnnnnnnnnnnnnnnnnnnnnnnnnnnnnnnnnnnnnnnnnnnnnnnnnnnngtaataatatgtttataattagatatgtttgnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcggggtg

SEQ ID NO: 19088 - DNA, 632 bp, Diabrotica virgifera
  misc_feature (136)..(154): n is a, c, g, or t
  misc_feature (181)..(203): n is a, c, g, or t
  misc_feature (208)..(227): n is a, c, g, or t
  misc_feature (240)..(303): n is a, c, g, or t
  misc_feature (305)..(318): n is a, c, g, or t
  misc_feature (332)..(350): n is a, c, g, or t
  misc_feature (370)..(405): n is a, c, g, or t
  misc_feature (425)..(441): n is a, c, g, or t
  misc_feature (443)..(457): n is a, c, g, or t
  misc_feature (590)..(607): n is a, c, g, or t
gaaatctctaaaaaggaggctaaaaaaaatctaaaaatcctctaaccggaaaaataaaataaccctaaaataaattttctttcggtaaacggaaacggttaactcggtttctcaaatataatctaaattttcttcnnnnnnnnnnnnnnnnnnncttaacctaactaaacaaataataacnnnnnnnnnnnnnnnnnnnnnnnactannnnnnnnnnnnnnnnnnnncagggaaggagcnnnnnnnnnnnnnnnnnnnnnnnnnnnnnnnnnnnnnnnnnnnnnnnnnnnnnnnnnnnnnnnncnnnnnnnnnnnnnnggtaataactaacnnnnnnnnnnnnnnnnnnncacttttcaaaaatttttcnnnnnnnnnnnnnnnnnnnnnnnnnnnnnnnnnnnngtaaatggatggataataannnnnnnnnnnnnnnnngnnnnnnnnnnnnnnntatagggttaataaagggaattcggaacatttttttcaccggttaataaaaacaggttttttggataaatataaaggctcggccggccactggataattggagggtgggggattttgacggggtaaggagcannnnnnnnnnnnnnnnnnggaagtggaatggaagggtgggtgg

SEQ ID NO: 19089 - DNA, 621 bp, Diabrotica virgifera
  misc_feature (13)..(41): n is a, c, g, or t
gtttaatattatnnnnnnnnnnnnnnnnnnnnnnnnnnnnncatgaaacaggtggctttacgctttatatattcacctttattttttcatttcaacagagtcagtttaccgaaggaggattttttatagcctactttttgctaaacacaaaaatcagcaaagatgcaccaaaaggataatcgatgaaaaagaacattacaagtgaaacggcaccgtaggcgacaatccggacagcttcgagcaatacatgcgcgggcgaatgcaatgacagagcctccgacagcgtgtatcagatgcacgctgaatctcccaaccgtacactacgtcgaccgaagaaggaagccaaaaaaaggagaagtaagaacaagcgtaccggatcttcattggcgtcatcatgtcttccagatctgcataaattgaccgctgtagctctgcccacaaggcgcttacgctagcgtccaaacttgagtgcgtctgatccctgatctacaatttgctgtgaaaattatcgacaagaaaccagctcatgctagagccagcgttcttagggaagaatagacggtccctcattgctcccgcccacccccacatcacccagttaatggagctttcccagtacga

SEQ ID NO: 19090 - DNA, 245 bp, Diabrotica virgifera
  misc_feature (2)..(243): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnta

SEQ ID NO: 19091 - DNA, 63 bp, Diabrotica virgifera
  misc_feature (2)..(56): n is a, c, g, or t
gnnnnnnnnnnnnnnnnnnnnnnnnnnnnnnnnnnnnnnnnnnnnnnnnnnnnnnnatttaaa

SEQ ID NO: 19092 - DNA, 198 bp, Diabrotica virgifera
  misc_feature (45)..(68): n is a, c, g, or t
  misc_feature (76)..(91): n is a, c, g, or t
  misc_feature (93)..(190): n is a, c, g, or t
cttaacgatagttaattagtatcgtgagagaatatctttcttttnnnnnnnnnnnnnnnnnnnnnnnngtacctcnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgt

SEQ ID NO: 19093 - DNA, 515 bp, Diabrotica virgifera
  misc_feature (8)..(55): n is a, c, g, or t
  misc_feature (67)..(119): n is a, c, g, or t
  misc_feature (121)..(164): n is a, c, g, or t
  misc_feature (186)..(211): n is a, c, g, or t
  misc_feature (248)..(288): n is a, c, g, or t
  misc_feature (314)..(404): n is a, c, g, or t
  misc_feature (422)..(446): n is a, c, g, or t
  misc_feature (454)..(473): n is a, c, g, or t
gtgtggtnnnnnnnnnnnnnnnnnnnnnnnnnnnnnnnnnnnnnnnnnnnnnnnngcatattatggnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnggaataaaaagaaatttgtatnnnnnnnnnnnnnnnnnnnnnnnnnngaatgaaaatttattgattaaaaatatatttagaagnnnnnnnnnnnnnnnnnnnnnnnnnnnnnnnnnnnnnnnnnaaagttaaaaataatatttaagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaatatttaagaagnnnnnnnnnnnnnnnnnnnnnnnnntagtaatnnnnnnnnnnnnnnnnnnnngagagagtgaatagaagataaatatataaggtgaataaagga

SEQ ID NO: 19094 - DNA, 827 bp, Diabrotica virgifera
  misc_feature (179)..(198): n is a, c, g, or t
  misc_feature (319)..(336): n is a, c, g, or t
  misc_feature (790)..(806): n is a, c, g, or t
  misc_feature (808)..(825): n is a, c, g, or t
aaaaatgactgattatactgaattatttgaattgaggcagaatgttggaattgaagctatgcagtaatttatattattttaaggtaagacaggagtcggtggggcttgagctagcttccacacaaatctataaatacgaaaaatgatctaaactgacatacttgcaagaaaactttaannnnnnnnnnnnnnnnnnnnaattcattttaaatttaaccagtactttaatttatgccgctttgtattaaaaatgcatacttttaatttgtagcccttgtacatctttaaacaatagtaactaaacaatagggaacttgcnnnnnnnnnnnnnnnnnnctacataataatattcagttttgtttaaaaatgagatttccaaaaatttcacgcttcaaatactcatagaaatacaaatttaaattcttctgtaatttaaaatagttcatacacgacccgtgacgtcacatagttttactagattgttatgtttatgattatttttttttctctgattctggctttggtttagaactagaacctttagccacgtaattgtataacttatcactaagtcaggtgagtaatgtgtagtgtgtgtgttgagtaagtgtcttgttactttgcaaagtcgacgtcattgtctttgcaaagagatgctaattgtttccgaacgtctgcggtccctccggtgagtgtttatgattatatttaggtatattctttttctccttctttagtttattggcctccatctacttgggtatttgccagctcattgtggcggaataannnnnnnnnnnnnnnnncnnnnnnnnnnnnnnnnnnaa

SEQ ID NO: 19095 - DNA, 928 bp, Diabrotica virgifera
  misc_feature (515)..(537): n is a, c, g, or t
  misc_feature (629)..(648): n is a, c, g, or t
  misc_feature (765)..(788): n is a, c, g, or t
gtccatccacggcggtccgattcactagaggtctcatcctcggataatcacatgttaaatacaaaatcggatcatactaagtttaaaagatttcatctccgtatctctaagtaattaaaaaaataccatctcagttaaagtttcatcaaattatctaatttcagattattcatcaatagacactaacataatttagtttgttaagatcaagtgattaagaagtttcgaaaaacaaaaaaaatacaggatgtttcattaaaaattaagacgatggacagtgcaaaacttcgtatcgaatcaacctcgtgcatttaaatttatcgtttaaaaacggcacatttgaatttagaagttgacgtgtatcagagttttatatagttttctaaaataagggcacaaacagtctaattcaataagtaagcggtttctacactttataattccaaaatttcatcctgtaatattcagaatagacatagttataattctttaagagatcagattcttaaagagcnnnnnnnnnnnnnnnnnnnnnnngcaggacgttccattcaaaataaaacttatggactattctaggtttgcgtgaatcacgttgcacatttcaagttatgtttaaggtgtgcagnnnnnnnnnnnnnnnnnnnncaaggacagaaatgggttttgttccataagtgagtttcaccctgtttaattattattccctatttcagtttatttttcttattttaaagcagtactatttttaatgtttgacattcnnnnnnnnnnnnnnnnnnnnnnnngtttaggaatctttgtttacaagcttcttatttttttggtctcgttctgtaacggacttttcattccatcttctaaaagtttaagttctacaactgtttgtatgcattttttgacttcattatttattacactcagataa

SEQ ID NO: 19096 - DNA, 762 bp, Diabrotica virgifera
atttgtgtaattcatgtcgggagatgaagagttataattgggagtgagaactcttcggacgggttgttttatatacacgatactccggggtgtgacactgccattgtgaaatatttggaagtatcggccaggctattgtttgatcttgacgccataatttgagtaatcataggaaatttaatgaatttgcgtggaagctgacctacccccggtataccagaagacttcgaactaactcctgtcgtctcgagcatcatcgggtccatcgtcgtcgtcacagcggttctcggaggctgggaagaatgcacagatggaacttgcatggaggccacgtatgcaaatatcctggtggcgtaattcatcgtgcacgaagccatcgacgcttacgatgtcataccaatgaaagatacgaactcgattaactccgtacatactaactaaatgaaggacgcattcgacgatatatatgagtgccagcaaatcacagtgactatgatggtcacgctacgattgttgctatgacgagtggtgcgcgcaactgaagactatgaattagctgacagaacaccgccgaccacgtgtaggcgcaacataaatgggcacagggcgagtcacacgtacgcattctcctctgaggtatgtgtgctaaagatacatccgtaattgcagaaggattcgaagactattgatgcagtacctatggtgatcgctgttgcagagatggtggacactatcttcacattgtggtcagtcagttcgatg

SEQ ID NO: 19097 - DNA, 613 bp, Diabrotica virgifera
cggacgcgtgaacggacgcgtggatcccgtacctctttgtcatcaactggttgttttttaaatctgcgtaaccatgtctgacgaataagaagattactccagcataagaggcgttggaataagagcgttgaaaagtctaccatcactaccaccgaagtctagattggaggggcagatacagaattaatcatacttcaagaacagaaaagatcagatctcgatgaagagattgttgagtgccgctcagaatgtcgtgcatccacgagcctaggaagaagaagactaaaagaagctcacgttagaacaggctagatgcaaaattactcgtgatgttgataagtggtaaatggtgtaacgttagaaggatgattaagaacgtcgcgttagcgaagttgaagagaataaaggtggagatattgagggacagagacaacgtcttgaaaaagccgctaatatacgtcaagccatgatgaaggttcttaaagatcaaaacaaaaaccgagggatctatcttcacttttaccaggaggatcgtcgcatctcatcgctctgccgctcatctagcgaggattgagagtatggaacaatgggatgaagaagagaaaatctccct

SEQ ID NO: 19098 - DNA, 951 bp, Diabrotica virgifera
  misc_feature (4)..(21): n is a, c, g, or t
  misc_feature (99)..(112): n is a, c, g, or t
  misc_feature (114)..(126): n is a, c, g, or t
  misc_feature (144)..(179): n is a, c, g, or t
  misc_feature (185)..(218): n is a, c, g, or t
  misc_feature (227)..(243): n is a, c, g, or t
  misc_feature (245)..(342): n is a, c, g, or t
  misc_feature (344)..(423): n is a, c, g, or t
  misc_feature (442)..(476): n is a, c, g, or t
  misc_feature (478)..(624): n is a, c, g, or t
  misc_feature (627)..(689): n is a, c, g, or t
  misc_feature (691)..(904): n is a, c, g, or t
  misc_feature (910)..(910): n is a, c, g, or t
  misc_feature (919)..(920): n is a, c, g, or t
aaannnnnnnnnnnnnnnnnncttacacgatagttaattcgtatcgtcgagagaatatctctctctctcctaaaagaaaaatttcttttccgtacctcnnnnnnnnnnnnnncnnnnnnnnnnnnncatcatcatctctctccnnnnnnnnnnnnnnnnnnnnnnnnnnnnnnnnnnnnctctcnnnnnnnnnnnnnnnnnnnnnnnnnnnnnnnnnncgaaacgtnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnngttattatttcatttttcnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgcnggtgattannaaataaactcaactctttttatattattata

SEQ ID NO: 19099 - DNA, 829 bp, Diabrotica virgifera
  misc_feature (167)..(186): n is a, c, g, or t
  misc_feature (597)..(625): n is a, c, g, or t
  misc_feature (801)..(818): n is a, c, g, or t
atgccatctaagcaaaaaatttttgttaccggagtaataacaaattacatcaatacatgtgcctgcgggctgatgcaggaatcttgaaaatcggagtacaaataataaagttatagattgtcaaaaatattgggtggcgaaattttgtcccggtgagagtatataannnnnnnnnnnnnnnnnnnngcacttcaaaccagtcaaacttacagatcctataaacaatacacataagttaaaataaatgttaaaggggtaacgattagttttatttagggtgctgaataggggaaggttttcacgatttattctaccaaaaaaaggcgccaacttgttttcagtgtgactcgtttatttttgatgctagaaacttttctaaaaaacaaatataaagataatttagatactttaaaaatgttaattagcttttcccgaaaagtgcttaatttttcggtgatttcgcgttgaattattcgatttggaattaaacgactaagaacgtatttttcatgcgctacaactttgcctttacataatttatagactttttactgatacaccatttttttcgcttttttataagctacacttttgctnnnnnnnnnnnnnnnnnnnnnnnnnnnnntttttgagttaattacgaaaaacggtctgaaaacgtagttttttttttaatcaacattttcagtcacgaataactccaaatgtattgatttacgtaaaaaaattttttgaacgaaagttgcttataatccgtcaatttatccatttccgggtttatttttaaacacgcgttttttnnnnnnnnnnnnnnnnnngagaaagggtg

SEQ ID NO: 19100 - DNA, 581 bp, Diabrotica virgifera
  misc_feature (130)..(155): n is a, c, g, or t
  misc_feature (261)..(373): n is a, c, g, or t
  misc_feature (386)..(408): n is a, c, g, or t
  misc_feature (421)..(452): n is a, c, g, or t
agaaaagataaaatgaaacaactataactgaattaggtaattcctatttaattgaatgtattgaattgaattccttcgtatgcccacgaatttttattatctgtctcatgcgagaattattttcttttgnnnnnnnnnnnnnnnnnnnnnnnnnnattctggagttctctttccatggtgattatttgttatattctattaaactaagaaacaattcttatgaaaataatgtaaatgtttcctagagtaatttaataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacaaaaaaannnnnnnnnnnnnnnnnnnnnnntaaaaagaacacnnnnnnnnnnnnnnnnnnnnnnnnnnnnnnnnaacaaagacggggccgcgcctagaagatcaactaatacaacaagtctgtgggtccccaaccacccttccctagggtggatctaaaaaatacaaggctgggcccctcttaacccacgtattgagtaaaaa

SEQ ID NO: 19101 - DNA, 799 bp, Diabrotica virgifera
  misc_feature (171)..(196): n is a, c, g, or t
  misc_feature (247)..(268): n is a, c, g, or t
  misc_feature (347)..(366): n is a, c, g, or t
  misc_feature (371)..(396): n is a, c, g, or t
  misc_feature (399)..(414): n is a, c, g, or t
  misc_feature (490)..(613): n is a, c, g, or t
  misc_feature (615)..(678): n is a, c, g, or t
  misc_feature (680)..(792): n is a, c, g, or t
ttcaattcgttccgcgtgtggatctccttcaccttctaaatgaaaaaatctctcatccttttcgtacctccgcgtaatcagggatctcactaatctcaatcaaattctcatcacttcaccatctttcgaaatcttaaatgagctcaaaaaatctcaaaatcttctcatcgnnnnnnnnnnnnnnnnnnnnnnnnnnctttcgtaatcgaaacgttatctcgtttttaaataatcatctaattctttnnnnnnnnnnnnnnnnnnnnnncttctctcaacaatatcatttatcaattaaatatcttttcatcatctcatctcaatattaaatatcttttcagggatcnnnnnnnnnnnnnnnnnnnncatcnnnnnnnnnnnnnnnnnnnnnnnnnntcnnnnnnnnnnnnnnnncatcattttcaaaatatcggtattaatctaattttcaatcatctattcatcttttcatttttcataaattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttt

SEQ ID NO: 19102 - DNA, 808 bp, Diabrotica virgifera
agggaatgtcgacgtaaaaggatcgtcggcagataaacgtcctacagtacaacggacgtcacggcttgataggcatttgtcgtacacatcgcccacatcgtccgcgaaaatcgacaagatacacaatctctttatcgtcaatactcgcaggtctgtcacgcgacgggagaatggctatatttacacgcgctacacgtttttgaaatacttctaaaataatattttgcgatcttcgatttccgaccatctttcgcgcgtgatcgcgtgtcgctcatctcttgacagggaatcattttgagcagttgtgatctcgttggttacggctctgttgctttgcttcgctctgtacattttcatatcgctactgcttatcactggattcagatattaaatgatattcttcgacaactaatactcatagcattataatcacgcgttggtactgtgattatattcgatgataaatgaagatggacagagagggtttcttcattgtatttgtgccagatagaggaattgacacattgtatttagtgtttcaacttcattatattctacttttagttatattgaatttattattgctgtttaattgattaattgttgagtttatactactcttaatcttctacttaagattttaagattgaagatatgttattaataagcaatctatagtatgtaataaatactgattagatttctgtatgtggtactgcttgtgaaacatatatagttaaattgacctttatataatatgtgcatattatatagatactgagcattagtatataatgtttcttcttca

SEQ ID NO: 19103 - DNA, 679 bp, Diabrotica virgifera
  misc_feature (64)..(83): n is a, c, g, or t
  misc_feature (350)..(370): n is a, c, g, or t
  misc_feature (517)..(517): n is a, c, g, or t
  misc_feature (563)..(563): n is a, c, g, or t
cttgctaaagtccgagggtaggtaggagggggtaggggttaccatttattaggttaagtataannnnnnnnnnnnnnnnnnnnggaagataggtagttgtaatggagaatggtgaagatttttaaaaagatgtataagtagagtattaaaatggattaggtgatgattaagttgatagtggaagtgaagaaaggtatggtggtgaagatgatagaaaattatttgttggtgtgatgtaattgggaaattattgataggggtgttatgagaatattttgtataatatggagaaatagaaagtataaatgtaaagaaagatacaaagaatgttagattaagggtatttgtannnnnnnnnnnnnnnnnnnnngaagatattgataaagttgtagttgtatgtgattatgttattaatgataaaaaagttgagataaaaaaagtaaaaggaagatatggaaaaatatttgtaggtggtttgaggtttgaattgagtgatgatgatattaagaagtatttntgataatttggattgatgattgatattgaaatgtgatttgataagnaaaagaatgaaaggaaaggattgtgttttataatatttgaatgtgaagaagtagtgaatgagttattgaagtaatataaataaagtattaaagagaaagagattgatgtaaagaaa

SEQ ID NO: 19104 - DNA, 906 bp, Diabrotica virgifera
  misc_feature (4)..(707): n is a, c, g, or t
  misc_feature (714)..(751): n is a, c, g, or t
  misc_feature (771)..(784): n is a, c, g, or t
  misc_feature (787)..(809): n is a, c, g, or t
  misc_feature (817)..(839): n is a, c, g, or t
  misc_feature (868)..(896): n is a, c, g, or t
cacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccagttggtnnnnnnnnnnnnnnnnnnnnnnnnnnnnngacgaaaggg

SEQ ID NO: 19105 - DNA, 109 bp, Diabrotica virgifera
  misc_feature (31)..(61): n is a, c, g, or t
  misc_feature (71)..(96): n is a, c, g, or t
cgaagggttgaatgaaaaaaaaacttgcctnnnnnnnnnnnnnnnnnnnnnnnnnnnnnnncgtaaaagcnnnnnnnnnnnnnnnnnnnnnnnnnnagaccttattgag

SEQ ID NO: 19106 - DNA, 574 bp, Diabrotica virgifera
gaggatactatgcccttatccagcagacttacacgattccgaaaagatcgatcatcaactaaatcgaaatgaactttcaaaccagtggacaacccaaaatgccgagaatgcgggttaccagtataagtcgatgaaaaaaaagaagatgaagtattcgactaggacaaagtcgagctcctattagagaatgctcaatatgtagcacaaatacaacagttatggagtagctgaatatggatggctatggagaaagagttgtataagtagaaatagtctaacagataagcatttccagtgcgaatgttagaatattgtgatttgtatgtgaattataagattaaaaattatggtgtaatagaataggttgtcaagtatacctacaaattattagagtatacagcttgctactgagcacattgaggtttgagattagggatctttccgttgaacaatgtttatattactaatttgatacagctggtatgtgtaggatatgtgaaccacgaaataagggaatacggcctcagattttttgagggggggtaaaaaaatgttcgaggtttttttctccata

SEQ ID NO: 19107 - DNA, 323 bp, Diabrotica virgifera
tatctgtaaatagctctctgtcaaaacataagggatcatgagatctatttacagaatcttaaatttcctggatccgatgattatgcaaaagcagaaaggattgtatggcatgacgaaaatgatccagatgtggttgctgggtacgcgaagacagctggaaatttaaccgaaattttggttagaaacgctggtcatctggtaccgacagatcaaccagaatgggcgctacaacttattaataagtttacaagaaacgtaacttttatctaattgacaataattaactaacattaacaaaaatttgcaaaattgtgtgattctat

SEQ ID NO: 19108 - DNA, 842 bp, Diabrotica virgifera
  misc_feature (96)..(118): n is a, c, g, or t
  misc_feature (725)..(725): n is a, c, g, or t
  misc_feature (796)..(796): n is a, c, g, or t
  misc_feature (798)..(798): n is a, c, g, or t
taagaatgtctatgaaagtatccgaaatccgaacacaagacattaatttccttacattataataatagtttataatatagataatatgtaagacgnnnnnnnnnnnnnnnnnnnnnnnctataataagacagacactttacaaaatccattctagtcatttgattagactgatatcttattaataaatttactacatttttcaatttcagtttaacttgtttatttttgataggttttgcaataggcaaactttaaattttaacatacgtatctacctaaaattctttaattttttcaaagaaaatatatatggatggatgcgtattacaaaacgataaattaaaatgcgaatgaaaagattcgcaagcattcgtaatacgaatagcagaagaatttgcctctgtccacaaatatggggagaaaatggtattttcgtcttatcaacatatctatcttaaatttcattttctggtttgcatgacattaaatcaaacacaaaacaagctgatacgtcttctggttttatatgtaaggccaaaagtatgtttgagccacttgcctcctacagaataatttttatattctgatttaggaaaccaaaacatttctataccaagcttggtgtaagtgaaatttacaaccatgtatttcagtgttcggacacatttcaatgattgcattatgtatagccttttcaaaatctcaaaaattttactagcattanactcaattttgagatctttaaaatttctgattttaacgatgaaaaatattgtaatttctgattttttgttngncagtaaacagtataataaagaaatataatgctcattaattagcc

SEQ ID NO: 19109 - DNA, 489 bp, Diabrotica virgifera
  misc_feature (193)..(219): n is a, c, g, or t
  misc_feature (335)..(362): n is a, c, g, or t
cattataagtgttgtcatccttttgaaatcggtcaagaacccccttccaataccacaatccatgaagatgatgatagtaggttaatatgtgagggttatgagtgatgtataagttgccctctaaaagttggtatgatatgacagagaatagataaaatacatgttagtgatttgaatagatagatatcttagnnnnnnnnnnnnnnnnnnnnnnnnnnngagtttaacttggagatgtttgatagggttggctatagggaatgtttagttttttatatacagttagtctagctgaaaatattaagtgttgtactaaagaatatatgtgggatggnnnnnnnnnnnnnnnnnnnnnnnnnnnnggtaattgtaaagattgtgcaagcccccccaatactattagaataacagtttgtgtctgagcacaaatatgagtgagagaatggtattttcgatttatcaatatatctatcttaaatgtgatttatg

SEQ ID NO: 19110 - DNA, 373 bp, Diabrotica virgifera
  misc_feature (12)..(35): n is a, c, g, or t
  misc_feature (37)..(53): n is a, c, g, or t
  misc_feature (60)..(83): n is a, c, g, or t
  misc_feature (102)..(122): n is a, c, g, or t
  misc_feature (139)..(159): n is a, c, g, or t
  misc_feature (181)..(202): n is a, c, g, or t
  misc_feature (212)..(232): n is a, c, g, or t
  misc_feature (241)..(264): n is a, c, g, or t
  misc_feature (282)..(310): n is a, c, g, or t
  misc_feature (359)..(372): n is a, c, g, or t
acccccgcccannnnnnnnnnnnnnnnnnnnnnnngnnnnnnnnnnnnnnnnntccccgnnnnnnnnnnnnnnnnnnnnnnnnacccgccgggccccccggnnnnnnnnnnnnnnnnnnnnntcccacccagccgttgnnnnnnnnnnnnnnnnnnnnngccccccaccccaaccacccgnnnnnnnnnnnnnnnnnnnnnngcgcagcctnnnnnnnnnnnnnnnnnnnnngcccgccannnnnnnnnnnnnnnnnnnnnnnngcccccccccagtgaggnnnnnnnnnnnnnnnnnnnnnnnnnnnnngtccgcccccccccgacgagcccaccagccgcactcaacccgctccccnnnnnnnnnnnnnna

SEQ ID NO: 19111 - DNA, 333 bp, Diabrotica virgifera
  misc_feature (14)..(36): n is a, c, g, or t
  misc_feature (105)..(136): n is a, c, g, or t
  misc_feature (144)..(159): n is a, c, g, or t
  misc_feature (161)..(193): n is a, c, g, or t
  misc_feature (202)..(228): n is a, c, g, or t
  misc_feature (238)..(256): n is a, c, g, or t
  misc_feature (258)..(284): n is a, c, g, or t
  misc_feature (287)..(305): n is a, c, g, or t
gttattaaaaactnnnnnnnnnnnnnnnnnnnnnnngtccccgcctgccccctgattaagtttgaatggcccgcgaatttttgaccggctaaagtacacaaaatnnnnnnnnnnnnnnnnnnnnnnnnnnnnnnnngggttggnnnnnnnnnnnnnnnncnnnnnnnnnnnnnnnnnnnnnnnnnnnnnnnnngtgaaaagnnnnnnnnnnnnnnnnnnnnnnnnnnncctatcaagnnnnnnnnnnnnnnnnnnncnnnnnnnnnnnnnnnnnnnnnnnnnnncgnnnnnnnnnnnnnnnnnnngcggggtaacacggaattttatcttttt

SEQ ID NO: 19112 - DNA, 709 bp, Diabrotica virgifera
cttttacgactgagctcagccgaaaataaccggtagcatgtcgtatatagcggctcgctcataaaaggagatagtggttgaacgatattttaatacatgccgattttatgttgctatgatttatatgtgtcgacttttgctttatatgttgcttttatattggtcgactttatcaaatgtatgtagttccgatgcactgtattgattgcgtatgttttatttggcttagtctgtatgttattttattttttaatgactatactcctacagagagcgttttaggtttttaaacctagctcaactcacaatatcttcagatctttttacataggcactatccttttatactacacaaagttcaaacaaaactatatacaactttacaaataaattttggatttaaatgagattccttattgtcagtaacatagcaagggctacaagaacttgtgatacatatacaaacgttgccgcgttgtaaaatgtcacaatatggacattgactgctaccgcagacttgacatatatccaggacgtaggatgattaaggcatctaagatacttttcgttgtgatcgttcttgaagaatacatgtatatattataagcagtgacgatgggaatacctattcataaggtactttagaactatccccttttcacactcattttgccccagaaaaaggttatgctttttatttgcttttaaa

SEQ ID NO: 19113 - DNA, 895 bp, Diabrotica virgifera
  misc_feature (825)..(825): n is a, c, g, or t
tgaaaatgtgcttaaaatgttactggtatacatatacggtcattgtacattataatacaataaaacatttactatttcaaaaatttacgtgtatataatataccgtgtatcacttactgcttttttcttattggattctgatggtttaccattcatcggtagaaaaatggcagaaaacgaacctctgtattgtttttttgatgctgatcggtcaatgtacgtagttaaacaatttaaaggcaaagaagaatgttatgtacatagtgtcaagttatgcgcaaactttggacaaaaaaaggccaagaagctagcttgttttacatatcgagtaccaagaaatccaagcgtgggggataaatttgctagtagagctggacaaaagggaatttgctctcaaaaatggcccgctgaagatttaccctttacggaaacaggacttgtacccgatatcgtcttcaatcctcacggtttcccttccagaatgacaattgctatgatgatcgaaatcatggcgggaaaatctgcagccttacatggtctagttcatgacgccaccccctttagattcacggaagaagatactgctatcgattattttggcagactattggagaaagggggttacaattattacggtacagaaacaatgtattccggtattgatggaaggcaaatgactgctcagatattttttggaatagtacattaccagagattaagacatatggtatctgataagtggcaggtgcggtctactggaccaactaatatattaactagacaaccgttaaaaggaaggaaaagaggaggaggtgttcgttttgntgaaatggaacgtgacgcacttatcagccatggggcttcattttactgcaagaacgtttgttcactgttc

SEQ ID NO: 19114 - DNA, 175 bp, Diabrotica virgifera
  misc_feature (7)..(30): n is a, c, g, or t
  misc_feature (63)..(76): n is a, c, g, or t
  misc_feature (79)..(92): n is a, c, g, or t
taacagnnnnnnnnnnnnnnnnnnnnnnnntccataataaagattgcgacctcgatggtggannnnnnnnnnnnnnggnnnnnnnnnnnnnnaattaagcctgttcgatttttaaattttacctgatcggagttaaaccggggggagccaggttgcttcctatctttaatttatt

SEQ ID NO: 19115 - DNA, 842 bp, Diabrotica virgifera
  misc_feature (331)..(348): n is a, c, g, or t
atccccgggccgccccacgcgcccgagagaaattttgatatttaccgaagcataactattttcagtatattgttaatcagataatacatagataataattatatagtcatgatctgcgaattattctgactttcgagctgcaaagtctatttgcaacatagcacattaacataccttttttgtaaagtagaggtatccgatattacatctatctcaaccattccgaatcagcattaaactgagcgactaattaccctatccagaacctaccctgtacttatgtggatgtattagtacatatttgtagcgatgggctttccaagccaatcgnnnnnnnnnnnnnnnnnngaagccaagaagaggatgaaatattctcatatactagaatatgttgtcattaattcttagctattgttatatttaattttgacaaatttccttatgatggcataagttaaagttacttaagtttagcaacgatgactctatcaactctacaaggtatccccatttacctgtccaatctataggcatactaaagcaatccgccaccgattttcttcaccagagccccccaaacgtgcgaagcctgttacttgctataagaaccgccctgcctacggattaaattgactgcccccttccccttccaccgtgctcggcgcccctactcccctccttcttttattgtcggctgcaacgcaccttcgcccgcaacaaaaactgcctcttccccaacgcgtcagactatgtccctccataacactaccatgtcggaaattctctataatttcccggttagccccccctaagagcgttatcccccccccccttcctttttt

SEQ ID NO: 19116 - DNA, 875 bp, Diabrotica virgifera
  misc_feature (18)..(41): n is a, c, g, or t
  misc_feature (484)..(505): n is a, c, g, or t
aaattatatctgcattgnnnnnnnnnnnnnnnnnnnnnnnngtacactagatatctattattagaaaataaaatataataggttagtagcatacatagtgaaattttagaaataaaatgtatgccaggccaaagcctggtgaaaccgaagaggatctgttaaaattacaagaggaatttgaaagaaacaaagctgaaaataaaatacagctagctgcaactgtagtcagtaataaaaaatcagaagataaaagcttagtggaatctagcaaagctgaagttagcgaaattgatattaaggaacagttggcaaatacatttgaagccattcctaatgatactcaactcaaaaatgttgttgaacataaaaatcagccatcaccgtctattttcaaatttaacagggataggggttttcctcaagccaagagacgtgaagagacagctgttgctggaaggggaagtatttttaagcaacaaatgannnnnnnnnnnnnnnnnnnnnnagcaatggaagtagataacaccccaataactgtaagtaaccttgtgattaaagagagaaatgaaatttctgcaaggagctcttgtaatgagaatagacacaaaccagaaaatcttccaacccaaagttatttactaactggaaaagatagcgggcaaatacatgaagaaaatttaaatcttctgaagaatatgtcggaagaagaaatagtagaggaaagggaaaaacttttatcaatgatggatcccgctatcgtccaataccttaagtctcgtagaaaacagtgccggttgaacaagaaactgccaatagtgaacaaataagcagcgacgattttattttgaagaatcgaaaccacagtgaaattttaa

SEQ ID NO: 19117 - DNA, 859 bp, Diabrotica virgifera
  misc_feature (6)..(80): n is a, c, g, or t
  misc_feature (92)..(135): n is a, c, g, or t
  misc_feature (139)..(191): n is a, c, g, or t
  misc_feature (193)..(216): n is a, c, g, or t
  misc_feature (218)..(248): n is a, c, g, or t
  misc_feature (280)..(305): n is a, c, g, or t
  misc_feature (309)..(452): n is a, c, g, or t
  misc_feature (458)..(477): n is a, c, g, or t
  misc_feature (479)..(499): n is a, c, g, or t
  misc_feature (520)..(573): n is a, c, g, or t
  misc_feature (682)..(773): n is a, c, g, or t
  misc_feature (775)..(788): n is a, c, g, or t
  misc_feature (798)..(821): n is a, c, g, or t
agagannnnnnnnnnnnnnnnnnnnnnnnnnnnnnnnnnnnnnnnnnnnnnnnnnnnnnnnnnnnnnnnnnnnnnnnnnngtaatgagagannnnnnnnnnnnnnnnnnnnnnnnnnnnnnnnnnnnnnnnnnnngagnnnnnnnnnnnnnnnnnnnnnnnnnnnnnnnnnnnnnnnnnnnnnnnnnnnnngnnnnnnnnnnnnnnnnnnnnnnnngnnnnnnnnnnnnnnnnnnnnnnnnnnnnnnntaattatatgattataagtaaatattataagnnnnnnnnnnnnnnnnnnnnnnnnnnttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatnnnnnnnnnnnnnnnnnnnngnnnnnnnnnnnnnnnnnnnnnggaataaataaatgaatttgnnnnnnnnnnnnnnnnnnnnnnnnnnnnnnnnnnnnnnnnnnnnnnnnnnnnnnaaaatatacgctgtatatgtgattaaattgaatggtcgtttataatatgaaggtgctaagaaaggctaatcatcaatattttttattagaggtttgaaaaaatttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnccaaatactnnnnnnnnnnnnnnnnnnnnnnnnaatatgtattattaaaaaaaacttaatgttcaattagc

SEQ ID NO: 19118 - DNA, 514 bp, Diabrotica virgifera
  misc_feature (15)..(55): n is a, c, g, or t
gcaagaaagatttannnnnnnnnnnnnnnnnnnnnnnnnnnnnnnnnnnnnnnnngtggaaacgaacttcaaatataatatacaacgatgtgttaataaagtgtacagtgcctgttgtgtacgttcaattgtttcgtcgcctactttgccacatagttatatgattttggttaatcaatatggccggtcatgtttgctggaaacaatcgaagatcgtcaaacgtgaaagtcatgcaactatttcatgaaatgaaacaacaattccccaccattcccgaccatctggtaacctcttctataacttcatatattcaatctaattcgaaacaaaagaatatcgtcgattttatagaaaaaaccttagcgcattataatacagagtagatgtaaagatcctctcaacaattgtaatcgcctcacttagacgatatcttccaatatacaagcgtacatttccaaaacgataatgttgaacattggggagcccttaatgcccaaaacagtaaatgctgat

SEQ ID NO: 19119 - DNA, 360 bp, Diabrotica virgifera
gcgtaaatattatgattttttctgtatagtcttttatgttcgagaactgttatgtatgtgaaagtgatcgatattgtgattcttagtactagcgtcgtagcctgtatgttcactcgtgggttggtcgcctaagacagaacgaaggctaactttcagacgcgaatcttcagttacagtgttatggaatagttgctagtatgtgaaggaacaagtgatttgaagctcgacacctccgatgacgtattgccattgtcttgtttatgttcgccatactacacgaaagcaacgcatacgcgcataacttgtttggatgtgatatctcacctgcaaagaagaagtcgacttcagatcgaaacatgt

SEQ ID NO: 19120 - DNA, 689 bp, Diabrotica virgifera
  misc_feature (507)..(522): n is a, c, g, or t
  misc_feature (622)..(622): n is a, c, g, or t
  misc_feature (647)..(663): n is a, c, g, or t
  misc_feature (665)..(680): n is a, c, g, or t
ggaatgctccatgttctcaaaattttcaatcacggaagacgacacgaaccggtatagggctcgaatcggacggtagagagggcctcattcctcgcaactcatcatcgaaatcgaaaccccatcgaatggtattatcggacgaatcactagggcagatcgctcgaaaaattactcttaaataaacatcgaaggggcctttttaataagaattagtgaatcaagtcctcggagacttttctttcatcagtaaaatgctcagacggtgttcaacatttcaaagtactccgtgacgctactcggtaaattcttcctatgggtagtgaaattcaattctctcaatgaattagtggaatatcatagaacctcatcagtgtcccgttcacaagatgtcaaattaagagatatggtggctgaggaggtgagttttatgatgagtggtggtgaggagtatttggtccaagccttgtacgacttcaccccacaggaagtaggcgagctggagttcannnnnnnnnnnnnnnncaccgtcaccgatcgctcagaccagcactggtggcacggagaaatcggccatcgcaaaggactcttccccgcaacctatgtaacgccttatcactcttanatttatgtcaaaacaacgaaaaacnnnnnnnnnnnnnnnnncnnnnnnnnnnnnnnnngaaaacgtc

SEQ ID NO: 19121 - DNA, 810 bp, Diabrotica virgifera
  misc_feature (606)..(623): n is a, c, g, or t
gtacttctaagttattatgagtttttgaagcgtggaaattttgcaaatctcatttttatacaaaactgaacattattatgtaataaaaaaaatgagctaaagacttactatccaagaaaaggtagaaggccaaagatcgcgaggaggatccccaacaagatggatcgatcaaattacaggaatatgcaaaagacctgtgcatgagttaaaagagatgactagagaccgagatctttggggacggacaaatcatgacatcacaatgaccactacactacacaaagccattgggttgctatttaaagaggtcattattggagtttcaactgtatatttgtttaatccaattgatacatacatgggcatggtttgttttttgcctgtatagttgtaataattttaataaacgctcagtaactagacattcaggtgttcatttctgattttggtatgtcataagtgtagctatatcctgtttttaaactaggaagagtaattcaaatttaccgtgccgtaatgcttgtttgtgattggtccaacctcagacaagtttactccactgttatgaaattttgacactattgacatttatgaaattttgacccnnnnnnnnnnnnnnnnnncgtatggcatttttgccggggagatcctttcggacagttccggcgccatttacatctttaaccctgtttcaagtaactagtgccgatgtacactagcccagggggaccgaaggctttacgtgctctccgaggcacggtgagacggctcgtgtcattattggaaatgaaaacggtttgtttttggaag

SEQ ID NO: 19122 - DNA, 539 bp, Diabrotica virgifera
  misc_feature (54)..(73): n is a, c, g, or t
cgcccgatactcccgggcggccccccgcgggcccgcggtctagcgtaatatacnnnnnnnnnnnnnnnnnnnnatgaggacatgaactggaatggggttgaattgtatgaaatagaagtgcttgttcctagcatctatgtcttaaatcgataacctcatgagatgacatacatcggacgaattaacgaggtaaaaatgatgaatcaacaatcttatagttttctatgaaatggcctttttaataagagtcagtgtatcaagtactgtaaacttttcattatcattataatgaacggacggtgatccacttaacaaaatacccagtgacgcaacagataaagtcatcctatgtatagagaaagtaaatatacccaaagaagtagaggaaataacagaaacacatcagtgtcccgttcataaaatgacaaattaagagaaacgagggtcgaataggagataataaagacgagtgtcgaagaggagaaattgtactaatgacttgtatgactctcacaccgttggaagttatggagctgtat

SEQ ID NO: 19123 - DNA, 133 bp, Diabrotica virgifera
  misc_feature (3)..(3): n is a, c, g, or t
  misc_feature (66)..(66): n is a, c, g, or t
  misc_feature (79)..(123): n is a, c, g, or t
aantttgatgggccgcgtatttgaccgtgctaagtagcatatcattagtttttttatgaagctggnatgagggtgatgnnnnnnnnnnnnnnnnnnnnnnnnnnnnnnnnnnnnnnnnnnnnnctaaattttt

SEQ ID NO: 19124 - DNA, 222 bp, Diabrotica virgifera; identical to SEQ ID NO: 7599
  misc_feature (6)..(28): n is a, c, g, or t

SEQ ID NO: 19125 - DNA, 681 bp, Diabrotica virgifera
  misc_feature (222)..(240): n is a, c, g, or t
aaaataatattgaatagagaagtatgtctcaatagcacaaaacctgcaataggcgtaactagtgccagacacaacgggctaattgcagatcgtgtagttgaacattagcaagatacttgcctcctgagactgcggagggacaagctcgttatttgtagatagtgacattggaattatatgcgtaatacaccagaggtaaagaagatgtatattcccgattgnnnnnnnnnnnnnnnnnnngagattcatcgacaaaccgatatttactgtgagtttaatctatagatttttaatatcatcaatagattgtagttcgaataacttcgactataaaaatgagttatgttctttttccatattgagaatacggggttaatgctgcttaatctatttaacagtgaatgatcaggttttgttcctgctggcgatcagtattcaatatcagagctgagttaataattgagcttccaatcagtagatcgcaacctaatgaattattgtcctgaggtacacagtaattctatcaggctatagaggttcactgatctaatccgtatgaaaagtacacgattaatgacctagtaatagcacagcaatcacagttgtcgcagatcctcttcaattaaaggacttacgactgaccgccgccctccaccggaaaaatacggactatacccctat

SEQ ID NO: 19126 - DNA, 891 bp, Diabrotica virgifera
  misc_feature (268)..(292): n is a, c, g, or t
  misc_feature (432)..(454): n is a, c, g, or t
  misc_feature (647)..(672): n is a, c, g, or t
  misc_feature (821)..(822): n is a, c, g, or t
aagtttctcaaatcagtttaacgtcaatagtggattaaaacaaggagaccccctgtcaacagacttatttaacctaatactagaaaagataattagaggagccaatatcaagacaagcggcacgattctcaacaaaagacaacaatgcataggttttgcaggtgacttggtgtttctgacacgtttaagaatataacttcaaaaaatgttcaaacaatttgaagaagaagctagaaaatatcccctgactataaaccaagcaaaaacnnnnnnnnnnnnnnnnnnnnnnnnngtgtgtgtactttgtacgcacgtaagaagttatacttctattataatataatttcaacgaaataaatatacctacttaacagttacaatacaaaaaattaacaataattaccaaaatttaaccaaaacttaacaatgccnnnnnnnnnnnnnnnnnnnnnnngtatgaatcgtccgggaattgaacccgcaacctcgcgaattctcaatctctggtccaatgctctagaaacaagaccatcaaggcacatactattaacgtgtcagatatacatatttacacatcacggtgacaagtgaaatataaaaatagatgttttattattttacgcccaaggaagacaaatccaaagacnnnnnnnnnnnnnnnnnnnnnnnnnnaaccacatttttcaaattgcgcaagttgtattattaatattaatgttaataaatgaaatataaatattttgacgtttcaaaatttgacaatatcataacaatatttgatctactatttttaaaacacttaccagtgtaagattctttanngcttgataagcgagatcgtagatcgtcccggttgatttgtgttatccacagttctctacgccttcgagc

SEQ ID NO: 19127 - DNA, 879 bp, Diabrotica virgifera
  misc_feature (10)..(82): n is a, c, g, or t
  misc_feature (84)..(126): n is a, c, g, or t
  misc_feature (134)..(732): n is a, c, g, or t
  misc_feature (743)..(743): n is a, c, g, or t
  misc_feature (749)..(813): n is a, c, g, or t
  misc_feature (818)..(878): n is a, c, g, or t
attttcatcnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaagctgnaaatgnnnnnnnnnnnnnnnnnnnnnnnnnnnnnnnnnnnnnnnnnnnnnnnnnnnnnnnnnnnnnnnnngcttnnnnnnnnnnnnnnnnnnnnnnnnnnnnnnnnnnnnnnnnnnnnnnnnnnnnnnnnnnnnng

SEQ ID NO: 19128 - DNA, 731 bp, Diabrotica virgifera
  misc_feature (715)..(715): n is a, c, g, or t
gctccagaatctcattcacgactcgtccttcgttatctcaagaaaaccaaacctaaattcgaattaagttctaaaagaaatattacagtaatctttaaaaatatcgagctaatttcgtaagagaatcgacctcgtaaatcgttaatcgatctatatcggttttcggctcctcgttcgactcggaataggctcgtgtatatactcgatgttctaaaattctatttgtttttttcgtgtaaaattttatttactaagtccacagtataaccattattaactcgctatttgttggataattcttaattctttattaaatgaagttgaagtcaatgggatagagacaagcctgttgatgtaactataaaaagcagccagtttatgttgtatggggtggtgtgaatcggcagggataactgtacctgtatgtgttggttttctataaataccaaagtcaatcgttccatttctgagtgtcaatgtaagatctaaaaagttcaaactctttgagtcattctgaatctctaaagtaaatttaatagtgtcatgtaaagtattgaggaaatctaagaaatcgtgaagaatgtcaattgtgccattccatattattaaagtatcgtcaacatacctagcgtaaaatttaatataatctgtaaatggattatttttcactattttattagattccagtcatttagaaaatatcagctaatatcgntgaaagaggagatccc

SEQ ID NO: 19129 - DNA, 824 bp, Diabrotica virgifera
  misc_feature (38)..(57): n is a, c, g, or t
  misc_feature (107)..(135): n is a, c, g, or t
  misc_feature (143)..(255): n is a, c, g, or t
  misc_feature (265)..(796): n is a, c, g, or t
  misc_feature (798)..(815): n is a, c, g, or t
attctcctccctctcaaaataataaaatcttttctccnnnnnnnnnnnnnnnnnnnntctcatctctaacgatagttaattagtatccgtgagagaatcatctctcnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnngtaaaaagc

SEQ ID NO: 19130 - DNA, 692 bp, Diabrotica virgifera
  misc_feature (85)..(104): n is a, c, g, or t
  misc_feature (110)..(180): n is a, c, g, or t
  misc_feature (193)..(239): n is a, c, g, or t
  misc_feature (249)..(355): n is a, c, g, or t
  misc_feature (365)..(400): n is a, c, g, or t
  misc_feature (412)..(437): n is a, c, g, or t
  misc_feature (440)..(562): n is a, c, g, or t
  misc_feature (581)..(606): n is a, c, g, or t
  misc_feature (608)..(678): n is a, c, g, or t
cacgcatatcaaagaaaatttattataggttttaaggcagaaataaaagatctaaatggttgtgttgaattaggattgtgattgnnnnnnnnnnnnnnnnnnnngaaagnnnnnnnnnnnnnnnnnnnnnnnnnnnnnnnnnnnnnnnnnnnnnnnnnnnnnnnnnnnnnnnnnnnnnnntagaggtaaaaannnnnnnnnnnnnnnnnnnnnnnnnnnnnnnnnnnnnnnnnnnnnnnatgaattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatgatcnnnnnnnnnnnnnnnnnnnnnnnnnnnnnnnnnnnntaaagattaggnnnnnnnnnnnnnnnnnnnnnnnnnntgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagtatatagttttatnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnntccctgttattttt

SEQ ID NO: 19131 - DNA, 106 bp, Diabrotica virgifera
  misc_feature (19)..(55): n is a, c, g, or t
  misc_feature (79)..(98): n is a, c, g, or t
ccctgatacacaaggtacnnnnnnnnnnnnnnnnnnnnnnnnnnnnnnnnnnnnntctcacaatactaatgaactatcnnnnnnnnnnnnnnnnnnnnacttttac

SEQ ID NO: 19132 - DNA, 727 bp, Diabrotica virgifera
  misc_feature (465)..(483): n is a, c, g, or t
ggacttcccgtaccagattatccagcatcttctagattagcctcatattctgataaaaggtcgtatgatagatctgttgatgagttcatttggagaacaagtcaaacagaacgatctagagttagggatagagaacgtgatagaggaagggacagagagaggagcagaagccatcataggtatagggatagaaggtgaataccatagtaccaaatagagttgtaatcatgtttattttttacaattttggatttatagagaaccgtaacttcaaaatgaaaagtttcattatattttcatgcataaaatatccatatttaaattttatacattataaaagggcttaatgcatgtttaaaaggtcttttcctaatataatgacaggtatctacagctttagatacggtcatatgttgttaaatcaatttatatttaacaatatgcaaatgtaataaattccaatannnnnnnnnnnnnnnnnnngaaccttattatttgcacattccataccagtgtattttttttgtagttttatgattaatattcatatttactcttgttgtgaacaaaacaattcctttaatctttattattacatttattggactttcaggtaaagaatgtttgtttacagagattgtaaatcatatttattatgtagtatataaagtgtgttcgcagatacctgtgggtgacaatttgtcacgacaacgcatgtccactttaa

SEQ ID NO: 19133 - DNA, 768 bp, Diabrotica virgifera
aattgtaaaaaacgtacataataaattaaaatacaagtaaatataaaaagtcatttaaatatttaaacacaaacagttgcacaaaacgtgatataaactagaacatttaattttatttaagttaaaagtgaattactggaacttttcataaattattgtcgcagaaaaaataattttctaacggtggatcaacaagttattttttagttacacatcaattaaaatgggatacgtgaagcgaataaataataactattaaagtgtctgtgatgccctcatatgctgtgttcaaattcaaatctaacaaattatgtctcgacaagaaaaagccaagtcagtcacattcctagagtcatggttcaaaacgagtactacgaaaaggccagcggggcaaaggcccacttccacggggcaggcagcacgtcccaattcggagatagatacaggagacgctgacgatgaagacctaaaacttatcgacgtcatgagcgagaaggaagttaatgctaagatcgaggagttattgagtgacatgaacctcaacgacgacaaaaagaagccccttagagaaatgcccatggaacagaaacgtgcaatgttgaagatgcagaacaaaaagaaaggacaacacgacacgggcagtcgattcaacgatcccgaagattattacagatatctggatcaacacatcaatccggagtacttgcagttgaacaaatgcctgaactgtgtggaaagcttgagggtagccttgactaacaccccagt

SEQ ID NO: 19134 - DNA, 735 bp, Diabrotica virgifera
  misc_feature (2)..(46): n is a, c, g, or t
  misc_feature (53)..(590): n is a, c, g, or t
  misc_feature (593)..(593): n is a, c, g, or t
  misc_feature (604)..(605): n is a, c, g, or t
  misc_feature (613)..(656): n is a, c, g, or t
  misc_feature (661)..(662): n is a, c, g, or t
  misc_feature (665)..(666): n is a, c, g, or t
  misc_feature (672)..(695): n is a, c, g, or t
  misc_feature (699)..(699): n is a, c, g, or t
  misc_feature (702)..(724): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatnaatttgatggnncgcggtannnnnnnnnnnnnnnnnnnnnnnnnnnnnnnnnnnnnnnnnnnngctgnnatnngagggnnnnnnnnnnnnnnnnnnnnnnnnattnatnnnnnnnnnnnnnnnnnnnnnnngctaaattttt

SEQ ID NO: 19135 - DNA, 725 bp, Diabrotica virgifera
cgaattaaaagtattactggtttctggtcggtgctacgaataagtctgattcatactagcagctttagcattatagaaaatttgaatgaaaaataaaacgaaagctagcgattatgtgggatttggtacgttagacatcaaatagaacaactcaacttatattaaaagtttccagtatttttcgttgcgaaagattacctattgtattacagttctttagtactgaatttttccagaatatgaaagaaaaattggaattcaattatagggcgcaatacccacactttcagtacatagttcctacagaaatctgtataaaatactgaaagaaaataagtattgtcggttaatgccactctcactgcaccattgttatagaggacctaccaatttcagataacagctagctctcaagcttgaaatagtagggggatttcattatacagtcttcctagataaaagaactaaataaaaaatgtagatatataacattttccaaatgtgcattattataacaccttcttgttgacagcctcctacctatttaaaaaacgaactgttttaagtatttttatatgtgattagtatttatgcaagattgctattttgctatgcataatttttaatgtaactttaaaatgttttgtaatattttatatactgtaattatgtcataaaaatgtaccaattgcttgcaaaatataaactatgtgtaaacaacgtgt

SEQ ID NO: 19136 - DNA, 75 bp, Diabrotica virgifera
gaattcaatttttaaatagacagtagtatgatgcaatttcatactttattatacgttattatttagttttatata

SEQ ID NO: 19137 - DNA, 247 bp, Diabrotica virgifera
  misc_feature (5)..(25): n is a, c, g, or t
gtgtnnnnnnnnnnnnnnnnnnnnntgtctgtttgctccgtgcctggtgttggagggcgctgggtggctgagtgatgctggtgccacaggcggagtgtgtcgcgggggctgcgcggatggaggcggcccgtattgttgcgccctgcatgaccaggggtcggacgggcgggcggcccgggccgtgcgcctctggcgagagctaccggggccgggattgttccccgtgtagcggtgcttactcctgctt

SEQ ID NO: 19138 - DNA, 123 bp, Diabrotica virgifera
  misc_feature (4)..(86): n is a, c, g, or t
  misc_feature (88)..(122): n is a, c, g, or t
attnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnng

SEQ ID NO: 19139 - DNA, 549 bp, Diabrotica virgifera
agatcgggaaagttttttgtttcgcacgtcatttgaatagattttcagtgttatttgcatatgacatgactttctagggttcataatgtgctcaacatcgaaaggtgatcggcctgtgattatggatgaacaatacgatatttgtagacagttatattgtaattgtatgcgtaataactagaggtacaaaaattgtatttgtattttggtgtagaattttaatcatgtgattgtctgacgaaccgttatttactgcgaattgtattttagaatcttaattcttcattagattatgatgaataacatgattataaatagagattatttgtttttaatatgtattatggagggttaatagtgcttattctatttatgagtctattatcttcattgttcctgctggcgatcgagtttcaatactgagataagtttataattattcttccagtattgtagatgctacattattaactagtgcttgatatacatagtaattctgaatcttttcatgtactgatgctaattttatgaaaagtttattgattattt

SEQ ID NO: 19140 - DNA, 844 bp, Diabrotica virgifera
  misc_feature (9)..(28): n is a, c, g, or t
  misc_feature (236)..(236): n is a, c, g, or t
  misc_feature (295)..(295): n is a, c, g, or t
  misc_feature (321)..(321): n is a, c, g, or t
  misc_feature (340)..(340): n is a, c, g, or t
  misc_feature (358)..(358): n is a, c, g, or t
  misc_feature (369)..(394): n is a, c, g, or t
  misc_feature (443)..(500): n is a, c, g, or t
  misc_feature (509)..(523): n is a, c, g, or t
  misc_feature (526)..(564): n is a, c, g, or t
  misc_feature (696)..(711): n is a, c, g, or t
gatgatagnnnnnnnnnnnnnnnnnnnngtgatatatgaattaatatagagagataatattgtatttctataacatattttttcactctttttgtaccttgcgtgtcatttttgtattaatatatataagtactctatctgatccatctgtacttaatttagaaatgagcctgacagaaaatttatgactctgttgtatatagtgaaagatataaatactatttagatattatttntttatttgtgatagacttggaaaattggtatagtgtgctgtgtgtattgaaaataatantacatcatagttcttttaatattaanattataatataaagatatntattatatttatacagantataatattgnnnnnnnnnnnnnnnnnnnnnnnnnnctatgtaagaatccataataatatgtttatatgaatagatgacttaatnnnnnnnnnnnnnnnnnnnnnnnnnnnnnnnnnnnnnnnnnnnnnnnnnnnnnnnnnnaaattgtcnnnnnnnnnnnnnnngcnnnnnnnnnnnnnnnnnnnnnnnnnnnnnnnnnnnnnnnccattttttatgattatataaatatattacattaagatttacaactgatgtttatagtagaattcaaatcttgaatatttattgcgaccacataggtgtattaaaggaaatcattgacgtatttttcacctnnnnnnnnnnnnnnnncctttatgatattaactagatctgctcgtctgcccactgaatacagtgagtgttcgatctataatgaccgagcatattttagcataatcattaccatatatatatgatagctgtttatatttagatggatgtt

SEQ ID NO: 19141 - DNA, 55 bp, Diabrotica virgifera
  misc_feature (3)..(22): n is a, c, g, or t
agnnnnnnnnnnnnnnnnnnnnccagaagaacccaatgggggtttataaaattat

SEQ ID NO: 19142 - DNA, 292 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattatgaaagcaaatcctcttcaattaagaaacaaaacagacagagagcaatccgc

SEQ ID NO: 19143 - DNA, 901 bp, Diabrotica virgifera
  misc_feature (848)..(848): n is a, c, g, or t
attttggtatacagggttggtcggggctcggagtgagtattttctgagttttcttaagtggaacgccctatattttggtattgtaatgaaatgatgttttgtgttacttttttgtttcttgagcattccctgtacctaactgctttaatttgtgcttaattgttaatagcaccaacaatcttaactacgtatctattttgatagctcaaccattattggtaattttaaggatcagtctagattaatatgtatttatttccggaaaattatttgtgattgaatattttcacggccaacctaataaaatttcacgtattttttgtcgcaattaatgtttggctttaatcacaaataactcactaattaaagcagttaggtatagggaatgcttaggaagtggaaaagtaccatggaatatcattgtattacaatactaggatgcagggtgttccgtttgggaaagctcggaaagtactcattccgagtttcgaccggccctgtatgctaaaatttcaaaattcgctatacgaatgattcttagcagtggtggactatattgaaaatcacttgaacgtgagcagagtttttaatatcgaactgttacaattctgcagggtgtgagtgttgctgcgaaatcgataaaaaaacgtaaatatctcttaaaatgcccagtgtagtattgcaggacctcatattttgggaaagagtatattgggggggagtccaaaaatgtgaaagtatgcagggtgtcccattaaaaagacgaagttataaacaactttcggtatagcccgggggttgcaaatagatgaaagtgttttcatttaacagatgactcctcaaaaacncttaattcaaattttcatgattctgttgccttttggtctcgagatatttctaa

SEQ ID NO: 19144 - DNA, 143 bp, Diabrotica virgifera
  misc_feature (2)..(26): n is a, c, g, or t
  misc_feature (35)..(117): n is a, c, g, or t
cnnnnnnnnnnnnnnnnnnnnnnnnnatgaaggtnnnnnnnnnnnnnnnnnnnnnnnnnnnnnnnnnnnnnnnnnnnnnnnnnnnnnnnnnnnnnnnnnnnnnnnnnnnnnnnnnnncgcaaagccctatagagttttttaaa

SEQ ID NO: 19145 - DNA, 877 bp, Diabrotica virgifera
  misc_feature (762)..(762): n is a, c, g, or t
tgaagatttggaagatgttattcccatggctcctgtcaggaagaacaaaagtgttaaaagtttgaacatttctgagaacgaatcgcttcaaggatctttgggagccaatagagctgtatttagttctgagaaggacttagaagtaccgatagagccaatcagaactgagtccaaggtaataataccgatagcaacagaccctctaccaccaaaaagaccatctagatcaagatcacgaggggactcccgggcaacgtctcagtcaagaactgctccacagagtctaaacacctctcaacgagatctagatagtttatcgctacaaacaggactaacggcggaagacgacatagaaccatgtgtagaagaaccttgcgttcaaaaaatatgtgactacatggggtattccgtcatagataaatcaaaaatcaaagatccaccattaccacctcctagaagtttgaggcggaagaaaagatccactaaagtcgataaagaaaacaagttctttactgttccaaggtctaaacctcctaaggaagatgaagtactaccagtaagaccactgaggaattatagtactctagggccttctagactatcagtcacgccagatcttgtcgaaaataaagaaaatattgatattacacaatatatagaaatagaagacgagcctaatagagacctacagtctggagaggttatcgaaaaaatgaaaacaagacctttaccagcaccacccagaccgcctagaaaaactanaccttttcaggatattacatccagtgtcacatccagggagaatataatgtcacaatcaacagaagagttgcataaagaacagcccagtgaaatccgaggatatacacaaactgag

SEQ ID NO: 19146 - DNA, 819 bp, Diabrotica virgifera
  misc_feature (203)..(233): n is a, c, g, or t
  misc_feature (495)..(515): n is a, c, g, or t
cggacgcgtgggttgaacggaaattttgggcgcggacctattataagttgttgtacttacactattcattgttaagacgtaatattttgaaaataacatttttaaacattagttaacaattttatgcaaaaatatttttatgtgcaaaatccgtatttcatgtaggtatatgccttaattgtacacaattggtaaaatttgannnnnnnnnnnnnnnnnnnnnnnnnnnnnnnccacacaaaaaatggtaaataaagtcactgtggaagctattatttaaaatggtcataattatctgccgtttgctttgccataaacagtctaatgaaagcaaatccaaacggccattaagagccttctttttctattttgcccatgcataatatttccattaaacaccaatccaatctggcttatgggccgcagaccgcataacgttacttttaagcgataacccgaatatcaaaaaatgcaaacgacgatatttcgcctacnnnnnnnnnnnnnnnnnnnnncgatcagagatttataccgccatcggtatttaaactataggttatggattcctgcgggattaatattatagtacagttatattcctcatagaaatattctattcagtacgttttgaaagaattgaccagtagcgtaaaaaggaatatatacacaccctgtgtatataagacaatcggataacacagctcggtaataggtctggatccggcgtatgaaagaaaagtgattaatagcgggctgaaaaatttgttgagagcttaaaggcgcctggccgaaataactttgaaatggggggaccctgaa

SEQ ID NO: 19147 - DNA, 669 bp, Diabrotica virgifera
  misc_feature (132)..(157): n is a, c, g, or t
aaatactacattacttctatttaacaatatcttattatgctgcaccacgtgtgtactatatttattatataccatttatttaatcgtattaatttccatgtgaactcattccagagattccaatatataccnnnnnnnnnnnnnnnnnnnnnnnnnntttgtcatgaattgacctgccttttcaaccacatgtaactattcacgaaaaataatatgtttattaactagcaatatctctctaataaaatgtttgtacattatcataatcataaagaattggatatgaatctagaaaaagaactttctgaaaaatacatgattaataaagaaaaaggactgacatacttcatatttaaaaacctgccagtatacatatacatccccccttcatattagtactattatctagccttcaaaacaatatataccctcaaaataccatttgagtcttcatcaaagtacacagagaatgaaactgactagttaattgaaatgtatctttgtaataaatatgcatcatcctccacttctgccgcccatcatatccatgacatgatgtacacaatataaagacatcacctgatcactgcatacatgatccggtcgcgctgtgttcatcgagctaaggtaacatagtcattaagtattttatggaaacctgtactgaag

SEQ ID NO: 19148 - DNA, 641 bp, Diabrotica virgifera
  misc_feature (9)..(485): n is a, c, g, or t
  misc_feature (492)..(529): n is a, c, g, or t
  misc_feature (549)..(562): n is a, c, g, or t
  misc_feature (565)..(587): n is a, c, g, or t
  misc_feature (595)..(617): n is a, c, g, or t
ttactaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgaggccagg

SEQ ID NO: 19149 - DNA, 899 bp, Diabrotica virgifera
  misc_feature (555)..(573): n is a, c, g, or t
gtaaaataagttatagttactaaaaaatgtaatctaagtataagggtttttaagtgttctgcagctgtttctcctttacatacacaataatgacgaaaattttagttgctggtattttagcaggatgccttcttatgatacctgctggcatttctgaagctagttatgggctatatgcacaaagacttttaaaagatgatcacacagtgaagatcacgttgactcttataagtatatttagattattttccaaaataggaagcattagtggatcattagtatttagtattttagcggagattattggcagaaaatatacaataactgctatatcaataccatacataatatcatgcattactttccaacttacatcaacttacatgatgggttgtgtagcaaactttttaactggtttttcaataggcggtgcttattctatcttacccatatacattggagaagtcgccactaaatcatcaagagggaggctgatttctcttctccatacgtctttcatattgggaagattttttgtaggagccatactgggannnnnnnnnnnnnnnnnnncgcttccagtaataaattttactactggagttttggcaatttttgctgcaattttatcaattgcatttgtgaccgaaactccttacttttacttaaaaaaggtaaagcatgaattagtcaaaataagtttacaaaaagtaagaagaaaaaatgcaaactacgaattagagcttaccgaaattcaagagagaaagacattcgggattcctgataacggagtaggaaagggcatgttttttaaatataagtggcttaaccatacctattgttgatttgcctttatgttctcatatggcttatcactatttttaacttttttcaattcc

SEQ ID NO: 19150 - DNA, 880 bp, Diabrotica virgifera
tagttctttataaaaaatcttctactacccttaattaatctctgttggtgatgatatttccatctgtattcttcaatttccttattccttttttgtcatttgttactttttttcctagaactttgaggcttttgttatcttcaattttttgttgaatttgtccgtttttatatttgcagttgtccgtcctaatagatttttgtattgttttacttatttctcgtatataagttcatggtgtccatgaagactttgatttcacatttcacgttcgctaccggagagatttctttctatccgagagaagtctttccctttatttcataaagatgtcgtacctagcgtactgaagtcggtttaatttactaaactacctaggcctgttgcattttatttctctctgaacacgcatcaaggtgcttctgatgagtttttgatatgaaaacgaaacacgtgtagggtggcgatggtgtccagaatgaaataaaatgcaaccttcgattttctcttatattttattaactattgtatgaattttgtttacttttcgtttcctgatcttattccaaataaaagcaagttaggtcaatattaaagtttactgttttgtcgactccgtatacagccataacgactatattaattttgtctacttctactcagcatgaacaaaacttcgttagaatcaaaatatgtgaatcgtaatgtaaacacaaggtcttattccgaatgttctctctctcttcctctctctcttctcttctcttgggaacgggagttcccctctaaagaaacaaacccttaaatccagaaaaacatcttggcaacagaaaacattctacaaaaactacaaaattataattttcctaataaaatttga

SEQ ID NO: 19151 - DNA, 921 bp, Diabrotica virgifera
  misc_feature (44)..(920): n is a, c, g, or t
gcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 19152 - DNA, 930 bp, Diabrotica virgifera
  misc_feature (428)..(445): n is a, c, g, or t
  misc_feature (826)..(826): n is a, c, g, or t
aaatatttcaaaaacgaaacaaaggagatatataggtaataacaaataaaaggtaaaaacttacaatcaaagcatcaacggcgaaaccaacactatttcgcgtgtgtacacattcgagttctgaaggcgtctcattccttacatctagggcttccaatcccgcagcctaagttcaatctcggtatttgcgggactaccaattttctatcccgcgggatctcggtatttgcgagatcccgcatattgaaaataatcatatttgtataaggcaaataaaacaatgaattaatcaactcattccatatttatttaagtattactattagtatgagatcaatcaaattacaccatctattcttcacaaaaaacagatacaaacactgaaaaaacaaaaaatctaccttcttcaagaaacacaccaagttttnnnnnnnnnnnnnnnnnncacattttcaactgaaaattgacatagtttactttacttatttagttgctatattacttagctataagttactattatttagctaaagcttttaatttgaaatgattgcgaaggaaacccaacatacataaactgtcatttgccaaactactgcgtattttacaggcaatattgccggcagcagaaaatgttctttcggcttccacacctgtcggcggtattccttttaaggctttatagattttttaagatattttcctattggccgtccagattcatagagcatttctttttttataatggactgaaatgtattatctcgatatggtgacgggcaaagtacattacatgctggcgataaagttaactctaactcctttntgcatgtaagatcaggattcaccatgacggaacctctacattgacgtttcttacttgatcagcctcttcgtcatcattgctctcagcctcttcgtcacacgacg

SEQ ID NO: 19153 - DNA, 436 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(190): n is a, c, g, or t
  misc_feature (202)..(233): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnaacgaaaggacnnnnnnnnnnnnnnnnnnnnnnnnnnnnnnnnctaattccaaaacaaaaaaccgacataactactcacaaaaaggaaaactatattatttgggggggccggtctaagagatccaagctttacagacggggggaatgggccgctataagtttttttaaagtgtcacctaacttcatcccccgccccggggtttaaacacctggggaaggcgaaaacccggggggttaccccactta

SEQ ID NO: 19154 - DNA, 294 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(288): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaa

SEQ ID NO: 19155 - DNA, 180 bp, Diabrotica virgifera
  misc_feature (10)..(72): n is a, c, g, or t
  misc_feature (74)..(179): n is a, c, g, or t
gtaaaaagcnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 19156 - DNA, 399 bp, Diabrotica virgifera
aaaatctataagaaaccgttgagtttgtctatcagaattgaaaaggacatggtgacctctatttggcgcctagactagtaggaatatagttaaatatagtttatacagtggtgagcgcactaatggccggcagaatggcgcaggagatggagaacatgttgagttgtcagatggaaagagatgaacctagtggaggtgttaaatttagcgatagtaaattatagattgacattatattgattgtttcccacctttagacgctgcgcaactttttgataatagcctgttgtgaagttaaaagtgttgtgggcctagttgtctgatatgtttaatgttagtaataatatttaagatgtagaggtacaagcatataagatggtttttatctatagatctacg

SEQ ID NO: 19157 - DNA, 605 bp, Diabrotica virgifera
  misc_feature (66)..(84): n is a, c, g, or t
  misc_feature (239)..(258): n is a, c, g, or t
  misc_feature (274)..(293): n is a, c, g, or t
  misc_feature (361)..(380): n is a, c, g, or t
  misc_feature (417)..(433): n is a, c, g, or t
  misc_feature (436)..(470): n is a, c, g, or t
gatccataagaggtaaaaggaaagaaaagttatattgagagaatgttagttaaaattatgaagagnnnnnnnnnnnnnnnnnnngatagggaattagtgtttgtaagttgtgagtaaggaatagaaaattggttaattgtaaatgtattattttagaatttaaatgaggtaaaaaaattaagattttattgatgaaatagttatgtgaggagaagtagtaagaagtgagatgtaactannnnnnnnnnnnnnnnnnnngtatttatgataaacnnnnnnnnnnnnnnnnnnnngctatatatttaccgaaaagacatatttataggatggatatttaagatgttatatggatgagcttatnnnnnnnnnnnnnnnnnnnnggaaattatgtagatgaaaatttaggattggtgatcnnnnnnnnnnnnnnnnngtnnnnnnnnnnnnnnnnnnnnnnnnnnnnnnnnnnnatatagattttttattaatatctaaaagaagagaattgaagtttggtaatgaggaaaagattagaatgataaatgggtattattgaggaaaaatgtatatgtttattacggggaatcataagcattttgtttcac

SEQ ID NO: 19158 - DNA, 293 bp, Diabrotica virgifera
  misc_feature (61)..(81): n is a, c, g, or t
caatgaaatgtgattcgcttttacatatatctaattccgtactagatagatgaaactcagnnnnnnnnnnnnnnnnnnnnngaagatatgtttatattagaagtattcaagatttttagtaccgagatggtaactcagaatcttgtagaagtacatgattaacagagagacaagtggtaaagataacccgcaggtcaataacagagatttgcccccttattataacccagattacttgagacatcgccaaatatcttatcaagcaatgggtccgtatcatcgctgatatactc

SEQ ID NO: 19159 - DNA, 573 bp, Diabrotica virgifera
acaagattctaaggactcaggatgatatgttttatggagtatagacttattataaatgcattctttgtattggaaagaaattccgcaataatgattgccaagtatactcgactcactgtacctgtatatattagccttatattaatcattcgatattttcaaataattgaaatctcacattctaaagaatgcgctgatttttgaacatgtatgctattgtaatgtttctactaagattcaccgtaaacagtttcttattttaaaccacctccgccctaataaatatctcctacgattactagtcattatacccactatataaacctataaccctctacactattaacatgtaggaaggctctatacaccatgatcacaaacgtgtatacttaaataacagatatattatgtatcaacatttagttcggaagcatattttgctcctgattgttatccccatgtcattttgcttgaactataaatgcttcgctgacgcacgtgaataatttagaatgcccgcgggattatgatcgtgatgagtttacatacccattatgctattcatcccatatt

SEQ ID NO: 19160 - DNA, 696 bp, Diabrotica virgifera
  misc_feature (22)..(62): n is a, c, g, or t
  misc_feature (78)..(111): n is a, c, g, or t
  misc_feature (125)..(150): n is a, c, g, or t
  misc_feature (152)..(179): n is a, c, g, or t
  misc_feature (212)..(244): n is a, c, g, or t
  misc_feature (249)..(295): n is a, c, g, or t
  misc_feature (308)..(349): n is a, c, g, or t
  misc_feature (354)..(380): n is a, c, g, or t
  misc_feature (383)..(461): n is a, c, g, or t
  misc_feature (474)..(492): n is a, c, g, or t
gatggtaaataattattgtggnnnnnnnnnnnnnnnnnnnnnnnnnnnnnnnnnnnnnnnnnagcttgtggagcaggnnnnnnnnnnnnnnnnnnnnnnnnnnnnnnnnnnctacttaaaaagannnnnnnnnnnnnnnnnnnnnnnnnngnnnnnnnnnnnnnnnnnnnnnnnnnnnngtgaagagatgttcgtctttaataataacaacnnnnnnnnnnnnnnnnnnnnnnnnnnnnnnnnncaacnnnnnnnnnnnnnnnnnnnnnnnnnnnnnnnnnnnnnnnnnnnnnnnggaaggaggttannnnnnnnnnnnnnnnnnnnnnnnnnnnnnnnnnnnnnnnnnggatnnnnnnnnnnnnnnnnnnnnnnnnnnntgnnnnnnnnnnnnnnnnnnnnnnnnnnnnnnnnnnnnnnnnnnnnnnnnnnnnnnnnnnnnnnnnnnnnnnnnnnnnnnngtagtgatgatgnnnnnnnnnnnnnnnnnnngttgattaagtaaaaatattatgtatgaataatggaggtcgtcaacatttttttctcctgctgattattaacatgacgtcttgtagtattaataatgacgcctcggccgaccgctgattatgatggatggccgcattatgaccgcggtactgaagcataatcatcattatttttattgtaggcagcagtgatgaaggggtgaat

SEQ ID NO: 19161 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19162 - DNA, 864 bp, Diabrotica virgifera
gggctcatctctttttttcgaggaatcccaggcttcattttctttacttatcttctgcagctttctcctctttcttttctgtccttgcttcattgccaaattcatttccaccgtttgttttcctcattccttgaatgaacgatatactctcagtagagagtacgagaatcgtatttctcagtaggtagctattttgtataaagtaatcattttttacagtattcgttactttgattactatgattacttttgttacttttgtatttgaataccggtaatcatatccagaatcgtatttctcagtaggtaggtattttgtatagtttttgtatattccgatataacaactacaatagtcgtagtcgttactcgttctgatacgattggtacgaagtaatcagagtaatcaaagtagatacaatagtcgttactcgctctgatacgattggcacgaaataacgaactaatcagagtaatcaaactagatacaatagtcattactcgctctgatacgattggtacgaagtatcgaaataatcaaagtaatgaaagtagatacaatggtcgttactcgctcgaatacgattggtacgaagtaatcagagtaatcaaagtagatagaatagtcgttactcgctctgatacgattgatacgaagtaatcagtgtaatcaaagtaacgatttgcctctctgtatagtaatcgttagtttcggtatttgtaagaaacgagtactttgtaacgaatagttacttttgtgaacatcactatcaagcacattatttcagaaccatattatgtcattacttggccaaattgcttctctgtaaattgagaaaacaaaaatgaagctatataaaatga

SEQ ID NO: 19163 - DNA, 675 bp, Diabrotica virgifera
  misc_feature (79)..(101): n is a, c, g, or t
  misc_feature (103)..(172): n is a, c, g, or t
  misc_feature (181)..(224): n is a, c, g, or t
  misc_feature (296)..(313): n is a, c, g, or t
  misc_feature (643)..(666): n is a, c, g, or t
cttatttcaccataacaacctatttctttagtaaaccgtagacaaaaattttattcaatgccagttaattagcatcgcnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnncatttaacnnnnnnnnnnnnnnnnnnnnnnnnnnnnnnnnnnnnnnnnnnnnctcactctttttgtaatgaaccgctcctccttcttaaatatctctaattttttcacacacaacttaaattcnnnnnnnnnnnnnnnnnncataatgaaacatttttatactctcattatcaaatattcttaggaatgagcttaacaataaaattttcttaaaacttaatttttcaataaccactaggagtatgaattttcctattttaccatatgttattatctattgttatatattatgatttttcatttcccatcaaatttttatcaaaagatccatctcacctacctaaagttagaaatgcggctcatgttagaattcactaattgtatactgaggaaaaatccctaggactagtcttcgaagtcgacgacctttttttcacctgattattagaaacatgtctttttgcattatcnnnnnnnnnnnnnnnnnnnnnnnngtaatttga

SEQ ID NO: 19164 - DNA, 350 bp, Diabrotica virgifera
cccccttcacgcgtccgcaaaaaactatttttgacaagatattccctttgatgcatcacattgcagctttagaaagaattgaaaatgatatccctaaatcccgaaagaattcttttttttaaggcgaggaagaaagggcggagattgaccgaatgaaaaggtaggaaaggattatataaaaagaatattctgtgatggaggcaataataaggtaggaacaatgggagagactacagactacagaggatttgttgtgcgaagatgaggtatgattagccacgaagagagtaaaaactgaaatgacgagtatcagagatataagaactgacggaataagaatttataattta

SEQ ID NO: 19165 - DNA, 863 bp, Diabrotica virgifera
  misc_feature (831)..(849): n is a, c, g, or t
cggacgcgtgggcgttaatgcagagaaacgattaatttgtgcgaaacaaacgtttgcgtttggacagtcgggattatggaactacacgaggatttgactatatttgtaaatgggcaatttcataaggttctggcaaatgaattatcacctactaccaccttaaacagtttcttaaggaaccatctacatttaacaggcactaaacgaatgtgcttagaaggaggttgtggagcgtgccttgttgctgtcaaacggcagaatgcagtaaccaaggaagatgaaatagtcgctgtcaattcttgtttggtttccattttttcaacagttggctgggaaatatacacaatagaaggccttggagacacaacgaatccaaataagttgcaacaagtaattgccaagttctacggcacgcaatgcggatattgtacgcctggtatgataatgaatatgtttgctttaaaacaaaacacgaaagatgttacgatggaaactgtggaaaattcatttggcgggaatatatgtagatgtactggctacagaccaattttagaagcctttaagtcagtttgccaagacgcgtctccagatttagctaaaaaatgtggagatatcgaagacatgcctgtgtgcaaaatgaaactgaaatatcctgatattatttgcactccacatttagcatccccattttattataaactaggaggattatcttggataaagtcaccttgttgaacgatttaatacaaataataaagacaattccaatcaactaagaatggcaatccgaattattataccttagtagctggaaatacctcaaaagggagnnnnnnnnnnnnnnnnnnnaataccaccgttta

SEQ ID NO: 19166 - DNA, 205 bp, Diabrotica virgifera
  misc_feature (2)..(50): n is a, c, g, or t
gnnnnnnnnnnnnnnnnnnnnnnnnnnnnnnnnnnnnnnnnnnnnnnnnngatttttttcgcctgattataaaaagacatgttctttttggattagaaagatacgcccgcctgcgcactgattaaatttgaacgcccgatttagcctgtgcgtacttaagacaaatattagttacattttatgagagaagaaagggaaggggggt

SEQ ID NO: 19167 - DNA, 700 bp, Diabrotica virgifera
  misc_feature (3)..(18): n is a, c, g, or t
  misc_feature (24)..(59): n is a, c, g, or t
  misc_feature (78)..(109): n is a, c, g, or t
  misc_feature (120)..(145): n is a, c, g, or t
  misc_feature (147)..(176): n is a, c, g, or t
  misc_feature (210)..(296): n is a, c, g, or t
  misc_feature (330)..(349): n is a, c, g, or t
  misc_feature (375)..(393): n is a, c, g, or t
agnnnnnnnnnnnnnnnngagagnnnnnnnnnnnnnnnnnnnnnnnnnnnnnnnnnnnngtgccccgtgtgtctcggnnnnnnnnnnnnnnnnnnnnnnnnnnnnnnnntctcaaatatnnnnnnnnnnnnnnnnnnnnnnnnnnannnnnnnnnnnnnnnnnnnnnnnnnnnnnntgaagagaagtgatactcgtttataaatatctcnnnnnnnnnnnnnnnnnnnnnnnnnnnnnnnnnnnnnnnnnnnnnnnnnnnnnnnnnnnnnnnnnnnnnnnnnnnnnnnnnnnnnnngaggagatcaaaaaaataaaattgtaataaaatnnnnnnnnnnnnnnnnnnnngggaacaaaaattctcatattagaannnnnnnnnnnnnnnnnnngtatataataagatttatactttataaacagttcatggaaaaaataagtggcgacgcttgttcactccaaccgcgatctggaataacaactccacaatcgagtatctacaacaaacatccccgcgcaaaactcgtcacaccgcctacctgagttttcaccccgttgctataaacgaacaccctttcgtccttatccctcacaagtaattccgtccggacccctcctttctgcctcccgcccccccccttcctccccccgtctaccccccctcccatcccaccgcccccctcccgccctccccccccc

SEQ ID NO: 19168 - DNA, 161 bp, Diabrotica virgifera
  misc_feature (2)..(18): n is a, c, g, or t
  misc_feature (26)..(65): n is a, c, g, or t
  misc_feature (67)..(100): n is a, c, g, or t
  misc_feature (104)..(160): n is a, c, g, or t
gnnnnnnnnnnnnnnnnncgagaacnnnnnnnnnnnnnnnnnnnnnnnnnnnnnnnnnnnnnnnncnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnc

SEQ ID NO: 19169 - DNA, 551 bp, Diabrotica virgifera
  misc_feature (537)..(550): n is a, c, g, or t
aaaaatcaaagcttatattggtttgtgttattggtgttatagataatttaataagatgagaaggtgtatcatccttttgtttgtcactctttttgaagtgattttttaaaacctaccatcctacgatgagtcaaggaaaactatatctttaaaactttctaatatacaaggcctaaaaaagtaaaagtcttattgcaacataaatgttccaaaaacattattgagaaggagaggtcatatagttttccgatatccgtaaaggatgaagaaaaaatttatacttaaatattgcagatatagataaaattaattatttcttctatattgatattacataatataaccttatagagcctagagactcaatcttatcaattattaattcctaccaaagaattaggagtaaaaattcccatatttcaaaatatgttattatttctttttatgtattattatttatattgtttatcagttatttattgaaacctaattacaaattatctaaaattaggaacgaagagaagataacgattaagnnnnnnnnnnnnnnc

SEQ ID NO: 19170 - DNA, 935 bp, Diabrotica virgifera
  misc_feature (836)..(836): n is a, c, g, or t
ctcaactagagcaacaaaacgaagtggacctatctattcaagatgcaacacaacagagagctagtgacgtgcgagaactaatacaattatttaaggaagagcaatataggtatcatagagaaaagttggagtatgaagaagctggtaagttgtgccaggataacgtgcaggcatctagtgaattagaaaaagaactgaagaaccaacaagaacagtatcacaatcttcaaatagccacttctaagattatcctagagcttcagtcagagctggaagaaagcaaacaaaagctggaccaaatacagattgaaaatagttctaaattaaacgaagtcgtccaggaactggaagagtcgaagcgacggtgcgcagagctccaattcgaacaggatatcaaggtttcccaaacgcaagacgtcgatgaaaaattgcaagaaatgtcgcggttgcaaagttctttgattgaaaaggatacgagcattaaagagttgaagatgttgatcgaagaactgcagaatcagaaagctggtttagaaggggagatgaaagaaatgaaggacagtctgaacgaaaagcaaatcgagctggatagaatggaaaatgagatggttgagagcattgctcggttggaagagaaatgggcggcgcaagttgatgaaagaggaaatacagtcgccgaaagctggaagtaccatctgagcatcgtggaatctgactttgccgcagtccaagagaaacttaagaacgaaatcaacgagctcgaagaaaagtgcaaccttctcgtgaaacgaaacaatgagctaaggaaaaatgctgacgtcgatattaaaaatgangtcgatcgtatttctgctctttcacaacagatcactgacagacagcattcgattaatgacttaaataaacttttgtcccccgagcaaatggaaaaagct

SEQ ID NO: 19171 - DNA, 238 bp, Diabrotica virgifera
  misc_feature (2)..(155): n is a, c, g, or t
  misc_feature (165)..(187): n is a, c, g, or t
  misc_feature (189)..(232): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccctatannnnnnnnnnnnnnnnnnnnnnngnnnnnnnnnnnnnnnnnnnnnnnnnnnnnnnnnnnnnnnnnnnngggggg

SEQ ID NO: 19172 - DNA, 544 bp, Diabrotica virgifera
  misc_feature (24)..(41): n is a, c, g, or t
  misc_feature (264)..(289): n is a, c, g, or t
tttaaaaacctaatcagcaaattnnnnnnnnnnnnnnnnnncgcattaatccccttccaattattgccaaattttacgtagattttagtacttcaccaaattaaaagatattcctgtttttagtaacaattaagatctcagggattttttactaaataaacagatattatgtagtttacataaacatattcatagtttaggatatgtgagtattgaatgttatttttatattttaccccaattttaaatgaaatgaattttagnnnnnnnnnnnnnnnnnnnnnnnnnngaattattgactccataacctaaaaatatgttacaagaaatgtataaatttaatttgttttataatgttattcaataatatttttggttttataatgttcttcattaatattattataatgtacttacttaaattcatttaaacttggtagccagaataagttacgatagtaatataagtacattatggtacctacccgtttaaaatgctcataagttatttttgatggagccactgcaatggcaaatatttaaa

SEQ ID NO: 19173 - DNA, 676 bp, Diabrotica virgifera
  misc_feature (142)..(171): n is a, c, g, or t
  misc_feature (316)..(329): n is a, c, g, or t
  misc_feature (331)..(343): n is a, c, g, or t
  misc_feature (441)..(455): n is a, c, g, or t
  misc_feature (457)..(469): n is a, c, g, or t
  misc_feature (565)..(583): n is a, c, g, or t
cggacgcgtgggttcaaagggtcaatctttattgaaagtgcacaaaaatttgatttaatggtaactaaatgggaatcgggtacagtaatttctttatctaacagagaaagttattcttctggcctggcgggtcgccggatgnnnnnnnnnnnnnnnnnnnnnnnnnnnnnnctcgattcaatgacttatgatatcaaaattctttttttgtaatatatatcttctacaatgtttttgtgaagagaagagatactattttaaaaatatcttttgttttatagagaaagttaacagcttctatcattaatatagtatnnnnnnnnnnnnnncnnnnnnnnnnnnngcagcaattggtaggagtgatctgataaccataagtttattacgattatctatttaagaaagaccggtacgactcttgtcatatcagatatgatgttnnnnnnnnnnnnnnngnnnnnnnnnnnnncttctctataaattttatctgaagatacatatacacagtagtaaactctagagttgacgatccaattagaattaaagatctgtatactgagagtgnnnnnnnnnnnnnnnnnnncgtaattccgggaacctgtttctcacctgtttatcaaggacctggcttttcgtcttaattataaagcgtcgcctgccccctgattactatgta

SEQ ID NO: 19174 - DNA, 627 bp, Diabrotica virgifera
attgaattaaattgtcaggatcaagatattcaacaagagtatgcgaaaagacaacgattagatactatattttcaaaaactttgtctagagcaagaacgatgttaaaaagaaaatgttccgatttatccagttcacagtcgaaaaggttagacataagccatgaatatagtggattagaaggtgtcaaattacctcctattcagttacctgtctttcatggggactatttgaagtggattgagtttaaagatacttttgaagggttaattcaaaataataaagtattggcagatattcacaaatatcattatttacgtgcgagtttaaaaggtgatgcattgaaaattatacaaagtttagatttttctgcacaaaattacaattctgcatggcagactctatgcaacagatttgacaactctcggatgttagtaaacaatcatttaaaagctctttttgagattgaaaatttaaataaagaatctgcattaggtcttagaagcatgatagattcagttaaaaagcatttattcgctttaaaatcacttcaactaccgactgaacattgggatgctattatgatgtatttggtaagtggtaaattggataaatttagttctagggaa

SEQ ID NO: 19175 - DNA, 627 bp, Diabrotica virgifera
  misc_feature (150)..(179): n is a, c, g, or t
  misc_feature (460)..(478): n is a, c, g, or t
aaaatattttacacaagatgaaatcagtattcgttattgtattcttcgcttgttttggtattatattatcagcaaaacttccaactccagcaccaagtccaacaccagaaccagatgacttagtctgtggagtttgttttatgattgggnnnnnnnnnnnnnnnnnnnnnnnnnnnnnnattcctaaggcaaaacagcaacaccacaacaagctcaagatgttcacaaagcactcagagaatacattgctaaaaatattggtgaagatgttgcaaagagtgttaggattcaatatggaggatccgttactggaggaaactgcaaggaattggcagctatgcctgatattgatggatttttagttggtggagcctctctaaaacccgagtttgtcagtattgtaaatgcaaggcagtaagtgttgttttctgtgaagtgtagaagtgaacgatcaattcannnnnnnnnnnnnnnnnnngacacttacaaattgtattttattgttaaatatttcgaaagtatgcaagatgaaatgtactggaaaattatgtactcttgaaaggttaatgtgttgatgttcagatgagtattgcgttggaataaacagtaaatattccttatataacc

SEQ ID NO: 19176 - DNA, 77 bp, Diabrotica virgifera
  misc_feature (2)..(43): n is a, c, g, or t
  misc_feature (47)..(69): n is a, c, g, or t
gnnnnnnnnnnnnnnnnnnnnnnnnnnnnnnnnnnnnnnnnnngggnnnnnnnnnnnnnnnnnnnnnnncttttttt

SEQ ID NO: 19177 - DNA, 77 bp, Diabrotica virgifera
  misc_feature (5)..(71): n is a, c, g, or t
agagnnnnnnnnnnnnnnnnnnnnnnnnnnnnnnnnnnnnnnnnnnnnnnnnnnnnnnnnnnnnnnnnnnngggggt

SEQ ID NO: 19178 - DNA, 907 bp, Diabrotica virgifera
  misc_feature (313)..(333): n is a, c, g, or t
  misc_feature (761)..(761): n is a, c, g, or t
aaagacagtactcaaaaacaaatgttgtagtcgcgaattgcttcattactttaattgtttagtacttatcgtgatataaaaatgtattttgtacttaaaatagccgcgtaccgggtgacactttgaaattatttccttcatctgtatcaaaagtgaataactggccgtacaaaatttgatcatttttatcttaacgaaaatgcctcagcagttcatcaaagtgaaggaaaaccctggaacgataccaaaagcggagtttaacaatcctgtaaagagtcaagactgggattcgaactcgaatctgtccaattcnnnnnnnnnnnnnnnnnnnnnatgccattgtgaggctgatggggacaatcctctgttgtccccctgttactgttctggaagtttgaaatacgtgccaaacctgtctcagacaatggttggctgcttcggatacacggtcttgtgagttgtgcaagtttaactttattctacataccaaaatcaaacctttttctgagtggcgaatattagaaatgacaagcgtcgagagacgaagacttctgtgtgccattctcttccacttcgtagcggctgtctgtgttatttggtccttatttgttttaatagatagagcggctgaagaagtaaggaaaggactgattgcttggcctttttggactaaacttgtggtagtatctgtaggatcgactggaggtgttgtatttatgtatatacaatgtaggcagtatttacatctgttttctagatgnaaagcgcacaatcgtataattctcgtacaaaacgccccggaaaagccggctgcaccacccgcttcgccgtattttcagaagaatcttagccacccacgtcctacgcaagtagtcaccgttgcggaatataatcagccatccctcat

SEQ ID NO: 19179 - DNA, 343 bp, Diabrotica virgifera
  misc_feature (27)..(45): n is a, c, g, or t
  misc_feature (59)..(133): n is a, c, g, or t
  misc_feature (135)..(335): n is a, c, g, or t
cgtatcaggaattattagttaccaatnnnnnnnnnnnnnnnnnnnaatttatcagagcnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttta

SEQ ID NO: 19180 - DNA, 724 bp, Diabrotica virgifera
  misc_feature (2)..(50): n is a, c, g, or t
  misc_feature (52)..(723): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 19181 - DNA, 792 bp, Diabrotica virgifera
  misc_feature (699)..(700): n is a, c, g, or t
  misc_feature (749)..(749): n is a, c, g, or t
  misc_feature (768)..(769): n is a, c, g, or t
attttattaaatatcaatcaaaccaacaaacacattcatctccatcttttggcaagttatatcgttagtctatttctggaccttagctaaacaatgaggtttcgtttttgtggagatgcagattgtccagattgggttttggtggaaattaataccctttcgaaattatcatccattaaactgaaacttttagctcaagttgtcgctcagggcataattaatccaccactacaaatggacaaagcagaaaaattattttcagaatctaaacttgacgcagatatagatttaaaagcttgtatagcttgtataacttatattttaacatcaactactcgttttaactgtgacagcaatgctttacagaatgaattgcaacaactaggactccctagggagcacagtacatctctgaagagagttgtggatgatcagataggggctctaacagataaatttagagcggcatctctcaaagttaatcctctagaagatattgtcgctactgtagatgcagatcttaaatgtgctattctagatttaaaaattaatggtgagaatcgttctgtagctttaactcctttcacagtgaatgtattgcttgagaatttggaagaagtaaggaagaccatggtggaattaaaggaagcgtcttgatggaagtgagatgtatgtcaacagatttgagaatttctttannatatatatgataatatacaggataacctttcttttcacagcagctgtgntgaaactttttagtattgnngaatggtgaaaaaattcatgcag

SEQ ID NO: 19182 - DNA, 414 bp, Diabrotica virgifera
  misc_feature (386)..(407): n is a, c, g, or t
tttcacgcgtccgatggatcgagagcacttacaaatacgacatggttgtacctactgagaagcaattggtgtacattcactatgcttctctgaactttagagatgtaatgacatcttcgggaagaataaacgccgatgtaataacacaagataggattgaacaggaatgcgttcaaggatttgagttttcaggataccccgcacaagctacgagggtaatggggtcgtaagtttacgtagctctggtctcatctagatgcatatacactgcataagaactcttaggaaggtttttataatataaagtaatagtttactctatctataattaggttcatctgttcaaagataagtgaattgtgtgctatgactacaacaattgaacnnnnnnnnnnnnnnnnnnnnnncactcac

SEQ ID NO: 19183 - DNA, 598 bp, Diabrotica virgifera
  misc_feature (552)..(553): n is a, c, g, or t
tgtaaatacacttctccaagaaattaacgcagcactttggaaattggtcatttttgatgtctcaaattttcaaaacctgttgtccgatttgggtgattttttaacatgttatagccttattctttaacagtgtcgctgtgatggtattgttgctggacagggtggttgtcgttgtgtgccggatctaccaatcaaactgtgtacgtgaccctgtggaatattctagcatttataaagtgctgaaattggaaccaaactatatacatattatagcctcatgttttcttggcattgtgtttcttgattcattcgcttatgttggatagtgaaagagttgggtgctttgacaactagccttgttatttatcaatacgggtgtttttgaatgggtatggcaagctttagcggtgattctgcatggagggtaatggcagtttgctttatagacgtgtgtccgcaaatgcttcgtttccgaggtaggaggtgttgaagtttttcttacagactgacgagttgtttattgctctaaaaccggttaagatatgcaggtgnnggttttggcgagttttaagaggtagttattgcgcattttttgata

SEQ ID NO: 19184 - DNA, 884 bp, Diabrotica virgifera
  misc_feature (54)..(71): n is a, c, g, or t
ggagaaacagtggaatgaaattctttcgctttcctacatccaaatataggcagnnnnnnnnnnnnnnnnnnattaatgctattcgaagacaaaagtatgttaacctcacttttatacttttatctataattattaaattaaatcatcatccgtgagcactagcactaccagcccatggagggccatggtcgcccgttagggtttctaggctactaggctctaaagttttgcaaggcaaaggccagctacacgcataacacttcaaaagttctataaacgttatttatctaacataatatattactttctttattcttttttaaggaggtcttttcggcgttatgtgtattgcttgcttgactactacagttgcccatgttttcctttcttttgcaatttttcccattctcatatttctaggtctttcaaatcctagtgaataccatcaatccatctctttctaggcctacttctcggtctcttcccgtttattattttctaagtactttttgtatttttgttatcatgtactttgtctttgagacattaacttctagcctatagtctgtgccgcttctttaaaacatgtataaattttttctatgtcttttaatgcgattatgtgaacaactgattatgtctatatcatctgcctaagtaacgacttgattgaactttgtaaatattgtacctctcctatctataggagttttcctgattacttgttccaacgcaaggttaaaaagtattgttgacagcacatccccttgtgttagaccttcattaaatgttaattcatcggaaagttgatttcggatccttactttttgccttggtgttggctaggcatagttttactaatctgattagttttttttgacaca

SEQ ID NO: 19185 - DNA, 866 bp, Diabrotica virgifera
  misc_feature (764)..(764): n is a, c, g, or t
  misc_feature (780)..(780): n is a, c, g, or t
aatatatgctgtatatatgctataaatattatttagcaagaaagatgttagctacgctatccatgatgctgtaaatcaacaaacgtttttggaaatacaaaatttagaagaaactaatgatgaaattatgagaggtgagtggctgacccagaatcgttgtaagcctaggcgtcaatatttaattggtggaaatgaggtggaaaaatcggtggagaccgtcccaaaatttgtgtctctgcatgtcacatgtcttaaaccgcaaacaacccctgataacctacataaaatgttagctgtatcatttcctgaagtccaatgtgtggtacacaaatcaaaaatgccagaagcatatagttctatgaaggtcaccattaatcaagaaaacctaaagagagcttggaacaaagatgtttggccaaagggtgcagtggtgtctaagttttttgtgaagaggagggtgccaatttaactggatcctctgtaaaaagtatttcagtatttcaggcaagtagttcagagataaataataatcattttaaaatcatttgtgtaaattcacagtcaatagctaacaaaacaagtgcacttgagctaattttaaatagtaactgtccggatattgtttgtgttactgagacatggtgtaatgaattaagtgtaaatagtattaattttgagaattattgtcaagctgcctcatataatagaattgaaaaaatccacggtggtgtcctgatatttgtcagacagtcaatgtcatttanagtaccaaagtatttnaatagtttagcagaagaagtaatttcgagtgttgttgtataaccttcaatttaaatgtaagtacatactgtttgataaacatatat

SEQ ID NO: 19186 - DNA, 808 bp, Diabrotica virgifera
  misc_feature (109)..(130): n is a, c, g, or t
  misc_feature (270)..(318): n is a, c, g, or t
  misc_feature (481)..(499): n is a, c, g, or t
  misc_feature (724)..(724): n is a, c, g, or t
ggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctaaagtaccanaagcttctttttttctctctcttgcctaacatatgagaaataaaccaaaatctggtaaaataaaatatatacttcaggatgacc

SEQ ID NO: 19187 - DNA, 757 bp, Diabrotica virgifera
  misc_feature (155)..(172): n is a, c, g, or t
attcagttatttgaaaagaataaagtattgttttaaagcccgctgagaaatgttcctatttagtggtacatacctaggaattcgcgagaagaatatgtttatgtttatatagaaagtaactacttatatcttctatgtaccattatgtatcacgnnnnnnnnnnnnnnnnnnacatagttattattttcgaaattaccaagaaatctcaaaataccctttttattgaaaaaccaatagttgaaataatttttgtggaatggaaagttgttctgttttagatatatctaacttccttatcctacccaattacaatttatttatcagcactataattataacttttaatcttcacattattactattaaatatactttcactccgagctcagaactcatcctttaatatgattctctctttagatagaaattaggattccttattcttctgttctctgatctactattattaattgttacatatgataatattgactgttcatagatactttataaccatatatatgtaattgatacatctacaatattgacgatagtattatactgatgccatagtatctatatgatgaatatatagcaagaataagggaaatcagatcacatttttttcacctggatattatccacatcgtctttttgaattaactatgtagtctcgactgcccactgtgtcattagaatgtacatacacttttgctggtgctatcgagaataatcataccgcttagtattgttagc

SEQ ID NO: 19188 - DNA, 212 bp, Diabrotica virgifera
  misc_feature (7)..(64): n is a, c, g, or t
  misc_feature (82)..(100): n is a, c, g, or t
  misc_feature (118)..(146): n is a, c, g, or t
  misc_feature (150)..(211): n is a, c, g, or t
cctgtcnnnnnnnnnnnnnnnnnnnnnnnnnnnnnnnnnnnnnnnnnnnnnnnnnnnnnnnnnncagaagaccctaatgagnnnnnnnnnnnnnnnnnnngttttttaagattaaacnnnnnnnnnnnnnnnnnnnnnnnnnnnnngccnnnnnnnnnnnnnnnnnnnnnnnnnnnnnnnnnnnnnnnnnnnnnnnnnnnnnnnnnnnnnnt

SEQ ID NO: 19189 - DNA, 899 bp, Diabrotica virgifera
  misc_feature (409)..(432): n is a, c, g, or t
  misc_feature (695)..(695): n is a, c, g, or t
  misc_feature (738)..(738): n is a, c, g, or t
  misc_feature (762)..(762): n is a, c, g, or t
  misc_feature (777)..(777): n is a, c, g, or t
gttgactaaagataggttaggtgagcttcttaatgcccagagaacaagcagccgcaataatgaagtgaaagtagacattatcacaaacggagacgtggatagtgcaaacgaaaatgtgaatttacgaaaagtgttcgaaagggctgaagttttgggacagtggatagagagtattgagcaaaatgttgtggcaatcaaacagtatattggaaggttggataccttaagcgttaatcatagagacctcaccgataaaatcgaggcgctattccaaaacaacaccagtatatgtcacaaaatcaatggaaaattaaaagaaatagaagcagaaataaaatcagccaataccgactcagcggaaggcaggataaagttaatacagctgaatacgttaaaaacacgttatacnnnnnnnnnnnnnnnnnnnnnnnnggaattggaaaattttaggaatattcaaaaagagaatttggaagctcagctcagagctaaaggagttagagtgactgacgaagaacttgagtcattacttgacaataaaagtgatatacagatttttacagaaaatattatagcggaaacacaagaggccaaacggattttggccgatattgaggaaagacaccaacaattgttgaagatagaaagtatgttattagaagttagggatctttttctacaaatggccatattgntagaggcacagcaagatttagtagatcgagtcgaatatcaggnccatttagcaaaagaatacgttgngaaaaactccaaaangatttgcaaaacgctgctcaacataaatacgatatttaaaggcaaaattatctttggaattgtgaatgtagtggtgctcgcaataatattaataatgttgttaaataaactacaaccagggt

SEQ ID NO: 19190 - DNA, 581 bp, Diabrotica virgifera
cagttacctttttgttgattcgttgattgttttcatatttatgaaggtttatgtcttttttactgagcgttaatgctaatcgagaatggataatcttttcttcacatttatcctatatcatagtgacttgagtatgtcgtcatccttgataactattacttccctaccatgttcgccctcgacagcccgataatactaccaatttcatatgtctctctaagttttgctagtacagttctgggagctcccatgacactccattttactattaactatatttttaaaacatcaagtaattctttctttaaactatatataggtcatcttattcatctttatgtgaatagtctgaccagactactacggatgcccttgataaccattctttagcaaaccctccctttctcacaaaaccacatcattaaaaacctacttattttcatccatgcaattatttctaggtccactactatgattcttcatgtttataattttctaagaaaaattatgactttagacaaaatgcacttagtcctgatgattatatcactattccaaaggcggatctgcaccacaaatac

SEQ ID NO: 19191 - DNA, 771 bp, Diabrotica virgifera
  misc_feature (25)..(93): n is a, c, g, or t
  misc_feature (95)..(137): n is a, c, g, or t
  misc_feature (145)..(763): n is a, c, g, or t
cggacgcgtgggtttttatcttatnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggatg

SEQ ID NO: 19192 - DNA, 789 bp, Diabrotica virgifera
  misc_feature (583)..(583): n is a, c, g, or t
  misc_feature (644)..(659): n is a, c, g, or t
  misc_feature (665)..(665): n is a, c, g, or t
  misc_feature (736)..(736): n is a, c, g, or t
atttgacatttgtttataggttgttaaaaatggttaacaaaacaaaattttctattttgaaatgctaaaagatggacacagaagagcaaaatattgaaaacaataataagatattaagtgttgaggatcttaatatagacattttaccaataatatacgatattatcaaaagtgttgagaaagataatcatcacgataatacggcaaagacaagggattcgcaagattgttctcaaaaagttttagagctacaaaaaagactagatcaagccagagctgagatccggatgcttccaggtattgattacagtaaagaacaacaattaaatcaccttgaagcacttaaaactcaactaagacttaaacaagaactactgcagaagtaccgttatatgtacccttttgaaacacaaaagtcataaaatggtatttcgtttcctaatcagattattagctaacaatgaacacttggtgcaaaaacttagcgaatcgtatccgatgcgtagagctgcacagttagtagtaagagtaatgttttctggaaaaaacttcatagaagagcagcgactccatgaaaaactanaccctgaacagtttagagctctaatgagggacgtaagtgccaattttcaaaatcgaatcannnnnnnnnnnnnnnncattcngaagaaatgaaatagtatcaatacctactttatctaaatttttagtaataatctttgttggattatttatntaaaaatgtattgatttattgctacttttttttttacaaaattatgtatcaat

SEQ ID NO: 19193 - DNA, 847 bp, Diabrotica virgifera
  misc_feature (732)..(732): n is a, c, g, or t
  misc_feature (740)..(740): n is a, c, g, or t
taaaattttcccctgtctaattcttaattacatttttttaaaacgaaaaattgtatttacacgcatttaaaagttctgatctatgatctgtatcacatctaacatttttctacaaaatctcttgttaacataaagtttcctcagtgagtaggaatacaaacatattgttaattgttcaatttggctgccaagaattaaaaacgaatatttatatcccactcacttcggggaaaaaactaaaagtttatcagagaaaagtttctgaatataatttataaattgaagtctttctactaatatttatttatttagtagcgataaattatacgtaatgataagcttatttaaacttgtttcctgtattacaaaaaagtagtaaaagaaaatagaacgtgtagttcttgttatcgttatatgtattccgagttgattcttcttacccgtaagttggtagttttaattttattatctactacttataactttttagtcatgctatctttagacattcagtagtacttttaccagctttatcacattgcagtttacaatcataataatgtacgttgcggtatagtacatagtccccaacctacattatgatggtgtactgcatttttattgctatctgatctcgagttctctctagttcgtctaatataattaattatcacattcacatcatccactaatatattaatgattgcaacttcttattgcctatctcatatnaaacatgnaatattatatgtctgttttcttttaataatattgtaaaagctccttttgaaacaagaactgtactacattagacaataaaatcacgtaaacgcataaaatgcaccat

SEQ ID NO: 19194 - DNA, 394 bp, Diabrotica virgifera
  misc_feature (127)..(144): n is a, c, g, or t
  misc_feature (267)..(283): n is a, c, g, or t
  misc_feature (285)..(307): n is a, c, g, or t
gtcatccttcgttttattttttcccagttactttctaaatttccaattacaataattgtcaacggaaattttttttgggtacctagtcgtatgcgattttcgttgcttttatacgtattatgcagtnnnnnnnnnnnnnnnnnncggataatggtcagaatgaacagcattaaagattttaaaatgttgtggatgatgtggatgtagtggatagttttttattaggaaatgtatttgtttattgaagatgtataattttttgcatannnnnnnnnnnnnnnnngnnnnnnnnnnnnnnnnnnnnnnngaggttatacatgttatgaatgcgcgtctatagaatttgtctagcgatatttagttttatggctactactacttataactaaggtcc

SEQ ID NO: 19195 - DNA, 320 bp, Diabrotica virgifera
  misc_feature (9)..(43): n is a, c, g, or t
  misc_feature (73)..(91): n is a, c, g, or t
  misc_feature (142)..(155): n is a, c, g, or t
  misc_feature (157)..(169): n is a, c, g, or t
caactatcnnnnnnnnnnnnnnnnnnnnnnnnnnnnnnnnnnngtcatctatatttttgagattgaacttagnnnnnnnnnnnnnnnnnnnccctcactttttaaacataagctatagattataatatttcttattttgacnnnnnnnnnnnnnncnnnnnnnnnnnnnatgattcttattttttatcgaatttctaatcaaaatatgaggtttagacaatttaaagttagtgctgatgattatatttgtattcaaaagtcgcttctttactaaaaatatatattttcaataacgcagctccgcaacttttttttcgcct

SEQ ID NO: 19196 - DNA, 762 bp, Diabrotica virgifera
  misc_feature (24)..(36): n is a, c, g, or t
  misc_feature (38)..(65): n is a, c, g, or t
gtcaaaactggatgttcagtttcnnnnnnnnnnnnncnnnnnnnnnnnnnnnnnnnnnnnnnnnntatctttgccatctgcctgttaattgtgaatgattaatattttaaattgtatcagtgtaaagtgtctttcaaatacgggttatcttcattaacatattttatcaagttttaaatctatgaccagcaaacagctaccggatattgtacgattaactaatatttctggttacgaacaaagatgcaacgatatagtgtattgcagacctcaaaatgttaccgaaaactcaagtctctgtgtattcttcggcggagatgttcaggacttcacagaaaacatgctcagtcacagagataataaaaattatgtgcagtggaatttggaaaatacagctaaaatcttacagcacagatttcttaatagtcatattgttgtgatacgtccagtcagaatggagtacaagacatttagctgctatgaaaacttcttaccgtgttttgcgtgtggcgtaccaaaccattgccctatgaattttagcctgaagcatttagaattgctgctgcttaatatatcaagaaaattacaaacgatgactgatgaagaactaagacatgatgaagaagtttctaagaacggactaatgaggtagctactccaaaacttcagacgaagtccacttagactgcggtaatttgacgattgcgaagttcagttataagattagcaaggatgcgtcgttttaatcagtttctatatgag

SEQ ID NO: 19197 - DNA, 779 bp, Diabrotica virgifera
  misc_feature (308)..(335): n is a, c, g, or t
  misc_feature (750)..(750): n is a, c, g, or t
  misc_feature (764)..(764): n is a, c, g, or t
ggctgtcatggcggtgtcgaaatgaaattgcgactgtcgaaatgaattagaatcaggcccctgtttgcatattcgccgatcccacaacgtacggcataggaaaataaatacgaacctcggattggtcaattggtcctaatataaacgtcatttacgagtcagagtcaacgtaacctcaaatttttatgtgtttcagttggtttcacttttgtttattttcctttgactgaccgtttggtttaattttctttgcgttgaagctttttgtagtggattgtttttacaaggtttctacttgtgggtgtacnnnnnnnnnnnnnnnnnnnnnnnnnnnncagagtttggcgttatggcatccttcccaaattttccaaaagactatacatatgcatggagtgatactaccagtgatgaaataataacagtaaaagtaaaggagattagtgatgagataactgctaaggagtggatacaaaagtggtctgaagcaactctgatgacctggagagttatgcgaacatatcctaactctggcaaaattaatgtttacaaggtggacttgaggtgtcagcataacactgacaaaagaactcaaggtataagatctaccaaaaatacaaactgtccagttacattatcaattgttgtaagaaggtaataaaattactgcattagtgaacaagtgctctattaggttctttccaacacacacagagacccttcattgtactatcaagaaacacttgatanaataaatgttctgncctttcatctacaga

SEQ ID NO: 19198 - DNA, 886 bp, Diabrotica virgifera
  misc_feature (34)..(53): n is a, c, g, or t
  misc_feature (514)..(540): n is a, c, g, or t
  misc_feature (848)..(849): n is a, c, g, or t
  misc_feature (877)..(877): n is a, c, g, or t
tttaatttaaaatataacagaaacatggaaaacnnnnnnnnnnnnnnnnnnnntcccgttttcagttcattaaaatgccacaaaaaattcagatacgtctcgctactcacagagtaaatccatcagttgccccaaataaaaggtatccaaagatatttactccaggagaagttatcactgctcaagatgaattcatgagaggtcatggaacatatgaagagaatggagaactgaaagcttcagtagcaggtataagagaacaagttaataatctgatatcagtaagacctctaaaaagtagatataatggagaaataggtgatgttgtagtaggacggattacagaggttcagcaaaaaaggtggaaagtagataccaattcaagactggactcggcactgctcttatcttcagtaaatttgccaggtggtgaattgcttggacaaggtgttttggtaaaggtatttccatctttgatcaagagaagcaaaacacattttcacactctacccannnnnnnnnnnnnnnnnnnnnnnnnnnatgggttcatctggatatctccaattattgttaattctgaagatagcgtcggaggcttcatacaaaatttggaagaggtaattccaaggcaagagagagaaataataggacgtttaagaaactgtgtcttggcgttaacacaaagcaaaatgatgttgtatgataccagcattttatatgcttacgaagaatccttgaaatattctgtagccgaactactcatcccagaagcgatggtagatgtcgcttttttacacaacataggctgtcgatgctggaaattgaatagtgaaagtttaatgagaatnngatacactctattttttttattttccgncacgtacac

SEQ ID NO: 19199 - DNA, 917 bp, Diabrotica virgifera
  misc_feature (64)..(82): n is a, c, g, or t
  misc_feature (786)..(786): n is a, c, g, or t
cgtattatgaaaaatcctacttaagttctttattatttttcctgttagaattgttgatgatttnnnnnnnnnnnnnnnnnnntttgtgtttgtaatcgggatgccaggagacgtcccaaactttatttattgttcaaataatcaaaaacaaaagactacagggttctgaggggtatgaacattttacgttgactttttaattcagttaaattgtgtttttgactaggaaaggtttggggtggttctgattcagcactccaaaatatgtacatgtaaaatggaagaagtcagaactaccccaaaactttcccactagggggttcctagagtacaaattgactgaattatttatctgaaatttctttgagaaatcagagcccaaaacacatatttattgtctaaatttgatacctacttatacatattgttgcaaaaagggaacatttgtataaataaattatgaataatgttgtatagagtatagagattatatatttaacatatttataaatagtcaatagtctacgcaggtataaatggtgtgtgctttcatagtagtagttgtttttttcagtgtcgtattctacatattttataattgtcagtatagacgtttgcttaagactatcacacacggtacggttgattttgataaagaaatttgattgttacccaaccatgcttaatgttcctttgagggaccagtgttttatatgaaagtattaactttttcgacaaaactacgtagggataaatgtgatacagaataaaaatctttatttttanaacgtttttatacactccacttgttctttgtcactttgtccggaaaaaaataaacatacttcctgactagctagaggtctgaaattttccgaatatgtcagaactcgatgaccatgcatattcaacagctt

SEQ ID NO: 19200 - DNA, 441 bp, Diabrotica virgifera
  misc_feature (89)..(108): n is a, c, g, or t
  misc_feature (259)..(282): n is a, c, g, or t
tacaaatttatttgtaccatcacatgattcgatgtttgagtcggtacatggactatagtttggagttttaccacccttttagagtgggnnnnnnnnnnnnnnnnnnnngatagaaaggcgaaacataaatacttaacaaatggttttattttacacaacctaaaaacatgcataatacaaatctatgtttttataataagtatctaaaaatataagtacatataactgtattcacaaaaaatatttcagtttgctgaannnnnnnnnnnnnnnnnnnnnnnnggaagatgtaaatgttccaagattagttacatgagagattgatatcatagacttcaatagtgtaatcttatttgaattcactgatcatctaaaaacaaggattaaatagtttcatatttgaagatatgctattaattattcttggataacatcattttt

SEQ ID NO: 19201 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19202 - DNA, 844 bp, Diabrotica virgifera
gctaccggtcagccggtgataccccaagtacagaccaactcgacacctccgatagccactcagtgctttatgttaagtaatatgttcgatccatcaacagaatcgaacccatcctgggacatagaagtccgagatgacgtgatcgaagaatgcaacaaacacggaggtgtactacatgtctacgtcgataaaggctccccacaaggcaacgtatacgtcaaatgtccatcaatagccactgcagtagcctctgtcaacattttacatggtcgatggttcgctggtcgtgtgatcacggctgcctatgttcctctgttgaattaccattcactgttcccagacgccatgactacgaccactttgttgttaccgtctagtagaaaataatgtgattatatcagatcgtttaagtggaggacattttgttagtaggtacgtgagacattctcgagcaatatcttaggaatattgcctttatatcacttgatacctagtcttttttgagtgtttttacgtttctgatccgtatttaaatacaatctgaagttattattaaaataaagatctataccgattccatatttttgattaacacattaaatgaatttgtctgtctggcattggctattaaaatccgagatctgaagaattaagatacaatttggcaacgtcgctagaatatttgcgtagattggaagggtattgactcattttgatgatttagatcaatttctgagtttagctgccagtttatattaattacactgtgttagtaaaagcatgaatcacaggaagaaacactaattgcaaaattttttctgtctgtcattttatcaagatctca

SEQ ID NO: 19203 - DNA, 796 bp, Diabrotica virgifera
  misc_feature (3)..(20): n is a, c, g, or t
  misc_feature (738)..(738): n is a, c, g, or t
gtnnnnnnnnnnnnnnnnnnctaacaatgcccaatcgtcataattaatacgaccttttaacttcggcacgttcatcaaataattagacgccattatctctacagcaaaatctgcacttacttgtattacgccatgtgctcttgtagagttcagtaattaaccatgctttattgttcataacctcacataattcatgatacatggcatatgacataagtcatcttcatagaacattatttttgaactaaatattaccaacaaaattgttgtccgtcctgttgtcaaacctgtccgtcgaggttatattcggggtcggacggacagacagtctaggtcaaattcctcacctttagtaccatccttggattataagctttcattagatacctcatttgtcaatctacctggtatagtgacggaggagttatattctcagtcggacggacgtacagacagcctaggtaaaattcctcacctttagtaccatccttggattataagctttcatttgacacctcatttgtcattctacctggtatagtgacggaggagttatattcgcagacgaacggacagacaacctatgtcaaatttctcacctttagtaccatccttagatcataagctttcatttgacacctcatttgtcattctgcctggtataatgacggagaagttgtgatcacagacagacagacggacggacgtggataattcaacattttcacattttttcanaattggtgaaaacatatctagccagttgtgtctgagtttagcgaaccgattatatgat

SEQ ID NO: 19204 - DNA, 100 bp, Diabrotica virgifera
  misc_feature (20)..(39): n is a, c, g, or t
  misc_feature (44)..(67): n is a, c, g, or t
ccctttagggaaaaacaggnnnnnnnnnnnnnnnnnnnngttcnnnnnnnnnnnnnnnnnnnnnnnnggcccccccccagggtggggatttaaaaaggtt

SEQ ID NO: 19205 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19206 - DNA, 54 bp, Diabrotica virgifera
  misc_feature (4)..(53): n is a, c, g, or t
tttnnnnnnnnnnnnnnnnnnnnnnnnnnnnnnnnnnnnnnnnnnnnnnnnnng

SEQ ID NO: 19207 - DNA, 59 bp, Diabrotica virgifera
gcctgcggggagcgggcgcggaattcccggcgccgaccccccctatacggatataatag

SEQ ID NO: 19208 - DNA, 538 bp, Diabrotica virgifera
  misc_feature (123)..(142): n is a, c, g, or t
gtcatatatacctatttcggtttattaaccttcaaataattgtcaaataaacgtcagagtacatcgaaatctaaacgtcaccgtggttacattaaaggttagaaaacaaaaatattagtgacnnnnnnnnnnnnnnnnnnnnatattttgcaggcttatgtatacgtggccaaaaatgaaggatctagttttcttgaggatgaatccgctctcgacgagatgtaagcatagcgaggtgtatgctgccatggaaagaccctaaaagttgttattgctgcagaagaagaaggaggagaagatagtgaaattgatatggatacactagattaggaagtatgttcgggatgagatcggcgagaaagagagagacggaggtaaatacaccttgcctatctgcacaaatgattcggtaccagaagattaaagtgaaactagagaggctgtaaggaaatgtaagaaaaatgacatacaggggtgctatgagataatgatagatgaaaacctctgaatggtagaagatgtgcatagaagcccagaa

SEQ ID NO: 19209 - DNA, 891 bp, Diabrotica virgifera
  misc_feature (233)..(256): n is a, c, g, or t
  misc_feature (269)..(286): n is a, c, g, or t
  misc_feature (320)..(342): n is a, c, g, or t
  misc_feature (568)..(588): n is a, c, g, or t
  misc_feature (667)..(686): n is a, c, g, or t
  misc_feature (715)..(715): n is a, c, g, or t
  misc_feature (751)..(799): n is a, c, g, or t
ggtatttcttcaattttaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgngatttatccaatgatttcctttatttacaggtatannnnnnnnnnnnnnnnnnnnnnnnnnnnnnnnnnnnnnnnnnnnnnnnngtgtaaattaaccttcttccctcaacattttttaggattaataggaaatacctcgacgatattcagattatccctgatgtatttatattatg

SEQ ID NO: 19210 - DNA, 827 bp, Diabrotica virgifera
  misc_feature (49)..(66): n is a, c, g, or t
  misc_feature (351)..(371): n is a, c, g, or t
atttagaaattaagcatttattttcattataacttatgaaatatatctnnnnnnnnnnnnnnnnnngcacaatatcatcagcgtatgctagatatttgtccttctcttgttctgagggtacctttgttgattttcctgacgttgtatttctgggcaagattaaacagagttgctgataaggaatttccttgtctaatccctttatttatgacaaattcttctgtatctcctacttgagtgtttatactcactacagttctactcattgtcatttatgttaatcatcttaatttcttttgtattcccatttctttcagagctaccattaattttgatattttattgtatcannnnnnnnnnnnnnnnnnnnnaaaagcagttcaatttctattttatatccattagctttctccataatttttttaaccgtatgtgtagcatctgttgtagacttccccttaataaatccgcattgatactatcctatgatattcgtcatagcttcggtcagtctttgttgtattcatgtcgacataattttataatgctgtgtttaatagcgtcattcctatgtagttattacacatttgttggtttccttttttatgaatcatgataatttttcctttgtacctacctaccgtttttccggaattttgtattagtccatatgtcatttattaaattgtacagtttttctctaaattcttcccaaccagctccatattaacaccaactgatcctgaggctttaccattacggttgctatttataattcaatcaacatggtcatcaataccatacgtatatgtatatcaatgctatac

SEQ ID NO: 19211 - DNA, 856 bp, Diabrotica virgifera
  misc_feature (773)..(807): n is a, c, g, or t
caaagtcgttgtggaatttgtattgtttgttatcaagaagtttttgcaaagtgagaattgaaattcatgtattatgtagtaatcacacagtttgttgaaattgttgtgtttgttttgattgtttaaataaataaaaatgaatttggaagtggcgaaaaacacggagttagacaacattcaaaatgtttgtcgattatgttctgggacagtacaattaacatcagttttcaataaggtggatggcccaaaaccgttagtggaaatagtaaatgtcttaacaacaattcagatcagtgaggaagataaggtgtcccaaaaagtgtgctataagtgcatctttaatgtcgttaaaatgtttgagtttagggaacaatctataagaaacgataacaaactgaaggaaaaatatgcagagattacaaaaaatcgacaaactaacggtgaagtagatgtacttaagaaagatgccataggagaaaacagttgcggagtagctagaaaaaaaggttctgatatcaaagctaagctaaaagaacgtagtaaacacatagttcatccgagcataacaccaattttcaaaaaatatcccagtatacgtttgccctcagtatgcataaatacgaacatatctccctactgcagttatgggtatggaccaagtggaaaacttatttttaaataatgaaaattaaatatgcagaaagtatataaatatggcactgacgaaccagaaacgaacagttgcaatgaagagctccttcaaaaggctacannnnnnnnnnnnnnnnnnnnnnnnnnnnnnnnnnntgaatacttttttttgcggtcaaaaacattccaaaatttggatcttttc

SEQ ID NO: 19212 - DNA, 913 bp, Diabrotica virgifera
  misc_feature (27)..(49): n is a, c, g, or t
  misc_feature (94)..(133): n is a, c, g, or t
  misc_feature (442)..(466): n is a, c, g, or t
  misc_feature (646)..(671): n is a, c, g, or t
  misc_feature (860)..(873): n is a, c, g, or t
  misc_feature (876)..(890): n is a, c, g, or t
catgaaagtaaccagactgtcgtaagnnnnnnnnnnnnnnnnnnnnnnnacgtaaaactgtataaagttgaattttaaaatggaaaaccattcnnnnnnnnnnnnnnnnnnnnnnnnnnnnnnnnnnnnnnnnaaaccacaaatatgtatttttcctattaacagtctcataggttgtaaaataccccgtagatacttgtgcagaaaagaaccaagccacatatgatatatatcgtcctctatgagcgaaagaaccaaccaacattgtcgttgcagcatgacagagttctgcagaaaagatccatgtgtgttggttcctttatgtaagttcacttaagttattttgcagaaggggccatggctacaaaagtggattttttttaaacaactgttgtcttgaattcacgagactttcagaacaaatttttaaatcccaataatnnnnnnnnnnnnnnnnnnnnnnnnntacgcctgattatgtcactcaataatggaaaataaatgtttgttaactttgaattcacttaagttgttttacagaagggaaccaagccataaattaggattttttttaaaacaactattttcttgaattcacgggacttccagattttgaaatcgaacaaattattaaatcccagtaatnnnnnnnnnnnnnnnnnnnnnnnnnncgcctgattatgtaactcaataatggaaaaataaatgtttgttaactttgaattcacttagttgttttgcagaagggaaccaagccacaaaagtagattttttgtttaaaacaactgtttttctgaatcaaacagtatgtgtgaaaatcaatctaatgcatatattgacgatttgattgtaaaccatgnnnnnnnnnnnnnnagnnnnnnnnnnnnnnncgtaaaagttttggctaatatct

SEQ ID NO: 19213 - DNA, 212 bp, Diabrotica virgifera; identical to SEQ ID NO: 11509
  misc_feature (20)..(57): n is a, c, g, or t
  misc_feature (77)..(90): n is a, c, g, or t
  misc_feature (93)..(115): n is a, c, g, or t
  misc_feature (123)..(145): n is a, c, g, or t
  misc_feature (175)..(206): n is a, c, g, or t

SEQ ID NO: 19214 - DNA, 168 bp, Diabrotica virgifera
  misc_feature (13)..(30): n is a, c, g, or t
  misc_feature (36)..(61): n is a, c, g, or t
ctaaattattgannnnnnnnnnnnnnnnnncaatcnnnnnnnnnnnnnnnnnnnnnnnnnngaaataggtaaataaccttttcatgctaaatatattaatttatcataacgataacggggtaatgtcccacgaactcacaaccacaaaaatctaattaatcctaactt

SEQ ID NO: 19215 - DNA, 113 bp, Diabrotica virgifera
  misc_feature (3)..(55): n is a, c, g, or t
  misc_feature (60)..(81): n is a, c, g, or t
gtnnnnnnnnnnnnnnnnnnnnnnnnnnnnnnnnnnnnnnnnnnnnnnnnnnnnnatccnnnnnnnnnnnnnnnnnnnnnncttaccttagggataacagcgtaattttattg

SEQ ID NO: 19216 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19217 - DNA, 64 bp, Diabrotica virgifera
  misc_feature (4)..(61): n is a, c, g, or t
gttnnnnnnnnnnnnnnnnnnnnnnnnnnnnnnnnnnnnnnnnnnnnnnnnnnnnnnnnnnaat

SEQ ID NO: 19218 - DNA, 180 bp, Diabrotica virgifera
cccgcggaattatgaccgtgctaaggcagaataatcattatttttatttatagaatagcaagtatacatactctatccgtctataagatatatgtaaatttatattaaacaacaattcaccattagaaggtatagggttaaaaattctaattttgttgaatgtcatttttataccataat

SEQ ID NO: 19219 - DNA, 116 bp, Diabrotica virgifera
  misc_feature (2)..(18): n is a, c, g, or t
cnnnnnnnnnnnnnnnnnccaagcgacttccgcaaccatttttcttccccccgcttattaaacacctgcctttttcgattaaatatcacctctcggcctgcccactggataacttt

SEQ ID NO: 19220 - DNA, 915 bp, Diabrotica virgifera
  misc_feature (10)..(81): n is a, c, g, or t
  misc_feature (83)..(125): n is a, c, g, or t
  misc_feature (133)..(828): n is a, c, g, or t
  misc_feature (833)..(907): n is a, c, g, or t
attttcatcnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnngggggggg

SEQ ID NO: 19221 - DNA, 194 bp, Diabrotica virgifera
  misc_feature (2)..(37): n is a, c, g, or t
  misc_feature (39)..(91): n is a, c, g, or t
cnnnnnnnnnnnnnnnnnnnnnnnnnnnnnnnnnnnngnnnnnnnnnnnnnnnnnnnnnnnnnnnnnnnnnnnnnnnnnnnnnnnnnnnnngcctcgcccgcccactggattaatttaaatgcccgcgccattttggccgagctaaggcaggttaatcattacgttgttttatattaagctgggaatggcaggg

SEQ ID NO: 19222 - DNA, 819 bp, Diabrotica virgifera
  misc_feature (20)..(42): n is a, c, g, or t
  misc_feature (149)..(168): n is a, c, g, or t
ttttattttgtaccaatgtnnnnnnnnnnnnnnnnnnnnnnngtgaacatacagatttttatttatacagtacctttctaataaaatcttattcactgattcactgtttataaaaaataaatacaaaacacagatttcttaacgatatnnnnnnnnnnnnnnnnnnnntagaaataatagcatagctgttgtcttggttgatcagtcacaaacagctatatcgttaacactttggggccaagaagccgaaaattttgatggtaccaataatcctgtcgtagttataaaaagtgccaaaattggcgagtttggaggtggcaagaatttaactactcttgttagcagcactgtaaaaataaatcccgaattaaaagaatgttacaggatcagaggatggtacgacagtgagggtgaaaatctgaatgcaaagaatattagtgccagagttggatcctcgaatatgtctgccacttggatgacctttaaggaagttaaagatcaaaaattaggatcatctgaaaaaggtgattattataaagctattgctactgttcttcttgtcaaagccgataatattgtgtatagagcttgtcccaccgctgaatgtaataagaaagttgttgatatggaaaatagtatgtacagatgtgaaaaatgtaatagagaatttccaaatttcaaatacaggactgttagccagcatgaatgttggagaccacacaggaaaccaatgggtttacaatgttcagttcagaaaccgaaaaaatttcttgaagatgactgcttgagtaagtaagacagaaccttggaacccaataa

SEQ ID NO: 19223 - DNA, 399 bp, Diabrotica virgifera
  misc_feature (158)..(175): n is a, c, g, or t
  misc_feature (226)..(252): n is a, c, g, or t
  misc_feature (350)..(374): n is a, c, g, or t
aagccctcttccaaccttccttcttgggtatggatctccaaacaagaatacgacgaatccggcccaggaattgtccaccgcaagtgcttctaagctatttaatcaattcatacctaataagctatttttcatgttgtttgtactgtgtttacatcttnnnnnnnnnnnnnnnnnntgcgaccgtggttgtaactgccagacagacttttaagatcttataacaccnnnnnnnnnnnnnnnnnnnnnnnnnnntacttactataactattttgtaactgggcaggtaaataaatcctatctagtactaaacctgcctattatttcgattaagaacgagaatatgatgttannnnnnnnnnnnnnnnnnnnnnnnngcatagtttatatacaatatacaat

SEQ ID NO: 19224 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19225 - DNA, 208 bp, Diabrotica virgifera
  misc_feature (3)..(80): n is a, c, g, or t
  misc_feature (83)..(141): n is a, c, g, or t
  misc_feature (144)..(206): n is a, c, g, or t
ttnnnnnnnnnnnnnnnnnnnnnnnnnnnnnnnnnnnnnnnnnnnnnnnnnnnnnnnnnnnnnnnnnnnnnnnnnnnnnnaannnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnat

SEQ ID NO: 19226 - DNA, 629 bp, Diabrotica virgifera
  misc_feature (35)..(63): n is a, c, g, or t
  misc_feature (72)..(91): n is a, c, g, or t
  misc_feature (100)..(128): n is a, c, g, or t
  misc_feature (130)..(145): n is a, c, g, or t
  misc_feature (267)..(293): n is a, c, g, or t
  misc_feature (408)..(446): n is a, c, g, or t
cgcgaagattttttttaatgataattaatgatttnnnnnnnnnnnnnnnnnnnnnnnnnnnnngaataatcnnnnnnnnnnnnnnnnnnnnctatggacnnnnnnnnnnnnnnnnnnnnnnnnnnnnngnnnnnnnnnnnnnnnncgaatgcacacaaaatgtttattcgtatactatccttttaattaagttttttgaatcgaaatgttattcgtgttttgacatgtctaattttttacgatataaatgaaacttctttattaacnnnnnnnnnnnnnnnnnnnnnnnnnnntatgattactcctcttaattatgaggtatgagtttaaagagaaaattatattatgatttactttctaaataagacatacggttacttattttcatatttttgaatgtgcacatgnnnnnnnnnnnnnnnnnnnnnnnnnnnnnnnnnnnnnnnctttgtattagaatataaatctagctcattatcatttggtacaggcgataatatgagaactactaaattgtaaatttagtaaaactatattggctaaacttaggaatgcgctaacatttgtttcatctgcttactagaaacatgtctttttgtttgaagtatcaagtctcgacctgccccttg

SEQ ID NO: 19227 - DNA, 872 bp, Diabrotica virgifera
  misc_feature (70)..(89): n is a, c, g, or t
tttccaaattgattttatgttttccgaatatttaaactaaattcgttcatacgtttcgcctgacataacnnnnnnnnnnnnnnnnnnnncgaaaataacaagtgacgagtccacatttttttgtaagacttttctggaaatcacattgttaatagaactgaggttctattttggtaacattttaccattgttctccaatatatcaggcagtgcccctttttgtcggtaatcagatagattcgtctgattactgtgtgaaatatatcttcaatctggatgatgagacaacattgacacaagaacttaagctgatatgggaagattctctgggaaaaaatgtcgcttactgtcgatgttatggcttacgacgtttttcttcttcgtagaaatagtcgtaggttatataacaaattcaatggccttagtggcagatagttttcatatgctgagcgacgtcgcagcattagttgtagcttttttatccgttaagatgtcaccaaagaaatggtcgaaaaatactttcggttgggcgagagctgaagtgctgggcgccttggtcaacgccgtatttttagtagctttatgtttttctataaccgtagaagcctgcaagaggtttatcgaaatagaatatattcacaatcctcagttgttagtaatcgtcggaggaattggtctcttagtcaacttagtcggattattactatttcatgaacatggtagttcccatgttcattcccacggaagactgtccccatagtagaaaaaaactaacccaactagcgataacggacggaaacgaagaacgaccgaaacgttttcctaagccctcctccacccgaaaacccatttaagtggaaaaaagcctctga

SEQ ID NO: 19228 - DNA, 132 bp, Diabrotica virgifera
  misc_feature (2)..(97): n is a, c, g, or t
  misc_feature (101)..(128): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccnnnnnnnnnnnnnnnnnnnnnnnnnnnnttaa

SEQ ID NO: 19229 - DNA, 219 bp, Diabrotica virgifera
  misc_feature (7)..(25): n is a, c, g, or t
  misc_feature (81)..(107): n is a, c, g, or t
ggaaagnnnnnnnnnnnnnnnnnnngatatatgtttatgaatgatactttaaatcaaactattattcataggtatgtgagnnnnnnnnnnnnnnnnnnnnnnnnnnnccaatatgttaaaagtaggtgttgagttaataatttacattttgatatatgacgatcttaatacaatatttattaagaattatttttagctttgttgacttttgtattgatg

SEQ ID NO: 19230 - DNA, 845 bp, Diabrotica virgifera
  misc_feature (36)..(54): n is a, c, g, or t
  misc_feature (756)..(776): n is a, c, g, or t
cgctccggaccggtcttaacaatgggccaagtcagnnnnnnnnnnnnnnnnnnncgaccgcattgaccgaattgaagtcaaccatttactgctaaacaaactttaccatttatgatgttcccaatttacgtaggatccatgctgataccatttttttatacgctttaactcgcctatttaccaatatttgtcaaaaacaaatttcagcacttttcatatccattgttcgtacagtgagatgataaaatcgtacctctctgtcaactcgtttttgcaaagataaaacataatcgctggaacatgtcgatgtttaagcttgttctaatatctaatggtatcgacgtttcggcatttcgatgtacccccatcgggtgacagtcacactctcaacttttttaaatagcaaagggtgtcatgtgacatactatgaaagatactaaaactctgattccaaaaatatattacacttaaagtgtgtctcatctaaggtgaagaaaccccaatatttctactatcaaaataaatacagatttgaaattttggacagtcatgaggattgatggttcgcattttttgggatagtcgactgaaatttaaaatttaagcgcggcctattgcgaatccacaaaaggggtgaattttcgatcttttgcttcgcgtgagagatataaaaaaaagaatttgtgtactttgtacgcacgtaaaaaggtatacttctattatatgaattcaacgaaatcaatatactttaaatannnnnnnnnnnnnnnnnnnnnctattaaactaattttaatacttactactttctaaaaatttttattagaacaatacccaaaattaaaaa

SEQ ID NO: 19231 - DNA, 732 bp, Diabrotica virgifera
  misc_feature (165)..(183): n is a, c, g, or t
  misc_feature (341)..(373): n is a, c, g, or t
  misc_feature (435)..(466): n is a, c, g, or t
gcgcaaggttgacatgccttgaccataatttcaatgtctttgtcaatgtttttccaatagcaatactttcttgcaagttgtttcatctttgtaatacctatgtgagttctgtggagttccgataggaccagtcgttggagttgagatgaaataacaattctctgnnnnnnnnnnnnnnnnnnncttctaaaaaaaatcatgttcattttgatttggggattttaaaacagatttaattcttgataaaatataaacctcctctgtgtggtcttgattatttgaaaggataaatcggaggttgaaaattcctttattgtctcttgttagaaagatttaattcnnnnnnnnnnnnnnnnnnnnnnnnnnnnnnnnntttgatttaataaagattagataaaacatgcaaagtttaagcgttataaaagatcttttttnnnnnnnnnnnnnnnnnnnnnnnnnnnnnnnntataatggggttataataccgaacgatataatataaattatatgatgtgtagttaaagaggaggaggaaaagtcccaaaaaaaaagcatattatatcaaagaaattttcgacatattaccccgaggctattccagcctgtttttgctcaacttatttacaaaacgtgctgtttttttactgatattaaaagactctcccggtggctctcttttaatttggaagaggacccgggtaattttgacccgggcaaaggtaagcctcaatc

SEQ ID NO: 19232 - DNA, 945 bp, Diabrotica virgifera
  misc_feature (59)..(77): n is a, c, g, or t
  misc_feature (646)..(665): n is a, c, g, or t
agaaatataaatcatttcgaaattatcaatgataattttcccacagttggtgactcggnnnnnnnnnnnnnnnnnnngttatataacgaaaatcgtagtagagagattaatatagttaaaattaagccacaccattgccttgagaattttaatactttgaaaaaactagtattagtccgaaataaaacttatagcataccttattttgaaagcaatatttattataaaatgctcagtttcctttatccagacgttaactttgtaatttgtaaaaatatcgttactatgccgcctgtagaagataggcaaaggataattttcgaatatcacaacgacccgagtaattatcacaaaggaattaatgaaactgcagacaaaattcgacaactttataaatggaaaaatatgtatagagaaataaccgaatttattactttatgccctacttgtcaactctcaaaatttgatcgtaggaatcgtactcaaggtttaaatgtaaggcattctccggagaaaccatttgaggctttatctgtagacctgttcttttttgataaacagaaaatgctcaccgttatagataatctaacaaaatttgcgcaagcgtatattttaactgataaaaaaaccagaaacgataattagnnnnnnnnnnnnnnnnnnnncgctttttggccttcctaagatgattatgtcagatcacgggggcgaatttaataataaaaagatacaaagttttgttaattcgttgaatatcgaatggcaccttacttcgtctgagtaccatgcctctaacggtataattgagcgtttccatgctaccataacagatactttgcgaagctatcttttagaacataaccagtgcgacttagaagatgcacttttagtcgctatatactcatataattctagtaaacatcattcaacatccactacccccct

SEQ ID NO: 19233 - DNA, 54 bp, Diabrotica virgifera
  misc_feature (4)..(5): n is a, c, g, or t
  misc_feature (10)..(50): n is a, c, g, or t
attnnttttnnnnnnnnnnnnnnnnnnnnnnnnnnnnnnnnnnnnnnnnntaag

SEQ ID NO: 19234 - DNA, 507 bp, Diabrotica virgifera
  misc_feature (482)..(499): n is a, c, g, or t
agaaattaatttatttagttagtttataatttaagtataaaaaagaaaatgctcatcactaatttatttgttaagaaatagatacaacaatatgcgacattttagataaaatggatatgcactttcttatagattattagtagatctgattttattttagtcaaataggaccgattatacatttttagcgaattagagatttccaacagcattgtcttccagaattaggtagacatactagtagatatatattttttggttggtgggatgtgcgcacgcataggtagagctcgttccgcgtacaaaatacttcttctatcacttcaacttacaatacagactcaaaattgatttgagaaaaacccctaaaaataatatttatccttacaattctaacagaatgaaaagagacttgtaagcaagaatgccccgagttttctataggattagaatactactttacaatcactttcttattacannnnnnnnnnnnnnnnnntctgacta

SEQ ID NO: 19235 - DNA, 381 bp, Diabrotica virgifera
agcttatttttattcatagataaataagggtgttattttattcatgttgttttttgcttattttcaatatttctattcagttgatttgttagttatggaaattgaagacaagtttttgaacatgaccaaagatctatacatactcagctatccacatcaacacattttgtggacttgaagaatgaaccagtacaggataagacagcaatggaactccaactcaaaattcaggaagagattgactgatcatgaaatgatgaagttggtctagttaataatacttatttcatttacccaactatctatgcaccttcggtcaaaagttctgtccatttgatgcgctacttgcaagaggaagcataaagttaattattttcttgt

SEQ ID NO: 19236 - DNA, 792 bp, Diabrotica virgifera
  misc_feature (648)..(648): n is a, c, g, or t
aaacgtttggcaatcatttgatattaaaaatattttggaatatagcttgttatacatgaagaccgatataatgttgttaacttgcatctttgcaaatttccgacaaaaatgccgaggtacatacggtcttgatcctgcctggtactacactatgccaggtttttcgtgggatgccatgcttaaatatacaggttgcaaattggagttgctgcaggatatcgataaaatcatgtttatcgaaaaatctattcgaggtggaattagtcaagtgagtaatcgatactcggaggctaataacaaatatatgccatcttacgactcctcaaagcccagcaagtatttagtttatttagatgtcaataatctttacggctgggcaatgtcccagtgtttaccatatccaaagtttgagtgggtggacactaacatcgatgttcttagtattcttaacgattgtgatacagggtacatactacaagttgacttggagtacctcgaacacttgcatgatttacacaaagattttccattttgttgcgaacatcaagttccaccgggatctaattttaagaagcttatgaccaccctccataataaaacggagtacactttgcattaccgtaacctcaaacaagctctcaatgcggngctgaaactaacaaaattcataaagttttgaaattcaacaaagcgcctggctcaaccatatatcgatcttaatacaaaactacgaactgcagcaacaacggcatttgagaaagacttatacaaattagctaacaatgctatatt

SEQ ID NO: 19237 - DNA, 744 bp, Diabrotica virgifera
  misc_feature (209)..(224): n is a, c, g, or t
  misc_feature (480)..(497): n is a, c, g, or t
ggtccaaatccgccaccagtgagtcattaggacctggaccgggggggtacgatcgacccatggctgggttatctggatacggcatgtccaggtccaaatccgccaccagtgagtcattaggaaggcaggcgaagtgcacacccctacacatccgtgtcaattgattgcgtttggtgaaggcgttgctcaaattagcaatacgacgtcgnnnnnnnnnnnnnnnntgttaaataaactcaaaattattctcgatgatctaaatctctggtaaccctcgtgtaatttctccatatttatatttgagaaggaaatattaaacatagtcacttcctcactcgcatttgcctattatttatctatggttagcgatgcaaatcatcgaaaacatattataggaacaggcctacaaactacttccaattgttcagcaattcaaccatttatattcatattttcttcgtcatttactgcggtcttttnnnnnnnnnnnnnnnnnncggtcaaaaatttaatgaattctaaaatgtattttaccaagaacgtttttagtttctaaaatagtgcaagcatataacacatctgatatgactcctttcaaaattaagtaatcacttaatttgatattttctagccaatttcaaaaatattttgtccctattaaagaatgctaaatgaataaataaatattgcaattgtttggtgtccaatagatcttctaggtgtaccagtaaaagcttctaactg

SEQ ID NO: 19238 - DNA, 77 bp, Diabrotica virgifera
cggtaccgtggagagatgttcgataacgagaacgaaacggcgagagtgagagaaaaaatgatatccatcgagtcaac

SEQ ID NO: 19239 - DNA, 581 bp, Diabrotica virgifera
  misc_feature (502)..(528): n is a, c, g, or t
agttgactgcctaaaagccatcgaactctccacatatgttaactttcgcttcttactactagtagtgatgcggcttcgtaagcacctccgaggagatggaggtcatctcgaagacggtcgtcctccctgcgggccagcgcaacttaaacctcagcactcaaaccaaaggctgcactcaatccatcatatttatatgttatgcagatcgatgactacgatggaagtttgagaaaatactcagaggccttactcgggcaagtacaagctgagacctgttgtaatggaaccagacaacccaaagaaagatatagtgaaaagactgttactagtagaagacgataggacataattgactctagatctcagcggggatttgtcaaagctcaaaaaagatacttttaccataatagaagaagattcataaaagataagaattgacatattgtaccatatagaaataataaatgtatatatattagtatagaaaattattagaaagtgnnnnnnnnnnnnnnnnnnnnnnnnnnntgtgaagatagttatggcggagacaattgtattaacagaatgatatattaggt

SEQ ID NO: 19240 - DNA, 69 bp, Diabrotica virgifera
  misc_feature (2)..(17): n is a, c, g, or t
  misc_feature (19)..(63): n is a, c, g, or t
cnnnnnnnnnnnnnnnncnnnnnnnnnnnnnnnnnnnnnnnnnnnnnnnnnnnnnnnnnnnnncacctc

SEQ ID NO: 19241 - DNA, 506 bp, Diabrotica virgifera
atgtaattaatgtgagtatgttatattactttttttggttaaaaataaggttgatggatctggagtgactattcgccgagtgagagaaaatttgataggttccttttaactgttagttatccgggccttggtgggacgggactacaagatgagacatgcctagtgtattctatttccggaccatctagagctcaccacagaggcagccggcctggcgaccccgaacagtaataatgtcctccccgactacgacaggcgatcattactatttctgagctaataaaacatcaatcaaacgaatgatagaacagagcaaatcaaagcggtgaagctacctgtatatagtataggcgtaaacactccttacataggcgcagaaaggtaacacatacttaacaatccgcttttactgacgaatgaacaaaaaatgtcagcatacacaccaagcatggatgtgcctgaattttttttagtattataattcccataaacgagtcattcagtaa

SEQ ID NO: 19242 - DNA, 584 bp, Diabrotica virgifera
attagctgtgtttttctgtctagtgagctgtgatcaaccacaaaagacaacatgtgtgacgacgatgttgcgggtcttgtctttgagaagggatccgttttttgtaaatgcgataatggcactaacaggaaaagccttagagcggtgtcgatatataattatgacaccccatacaaggaggaggttattataaagaatggttcactcaaaatgaacagatatattctatccagctagagaagggaagcaattactaagataagatgaagaagtgtctcggacaggcgcgatcaaaaaatacgatccatccgaatacaattcaaaagcactaactaccatcccttgcgcgtatccccctcttaacgatgtcgtttcctatcctaagcggcaccaattacacggaaagactagacagccaaccccatagaggcacttacaaaattgtcgaagcccgagccctgaatacagaaagcaagaccgataatcaaaggaagagcagtcctacctaaacgggcacctaaccatgcacacgaatcctattgataccagagggaacatgtatgacaaattaaaagttataaata

SEQ ID NO: 19243 - DNA, 813 bp, Diabrotica virgifera
  misc_feature (13)..(81): n is a, c, g, or t
  misc_feature (83)..(125): n is a, c, g, or t
  misc_feature (133)..(744): n is a, c, g, or t
  misc_feature (753)..(811): n is a, c, g, or t
tttttatcttatnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaagggnnnnnnnnnnnnnnnnnnnnnnnnnnnnnnnnnnnnnnnnnnnnnnnnnnnnnnnnnnngc

SEQ ID NO: 19244 - DNA, 554 bp, Diabrotica virgifera
  misc_feature (6)..(47): n is a, c, g, or t
  misc_feature (87)..(108): n is a, c, g, or t
ataacnnnnnnnnnnnnnnnnnnnnnnnnnnnnnnnnnnnnnnnnnnactacttctatataattatacattaaccattggtaagcannnnnnnnnnnnnnnnnnnnnngtaaaatttaattattacatcaaacttgcatagtttccattttagcagtatgcgattgtgttatctattagatattacacattattatgtattaatatttctaagtatatgatataaaatacatttatatattatataaggtgtgagtaatggtgccaataatagtgatcataaattaggaacaatttgtcacgattacctaggatttcccgacgactttttctgccttttttttcactgtctcctttttttcgtattcattataaattccccctcgggccacttcgactaatttaatggtccggctcattttggcccggcatagggaacgtaatcattaatttttttacttgaaagctctattgaaggaatggatgaaaaaaaacccctccctattaaacatccagacttttttttttttagggcgaaagtgtttattttttttt

SEQ ID NO: 19245 - DNA, 376 bp, Diabrotica virgifera
  misc_feature (352)..(372): n is a, c, g, or t
cgacgagtgtgtctgcaggtgcacataatttaaaatgatccttatttttaagttttttgtgaatattatacgtgtaaaatgatcaaaaaccagttacttgagtgagtaaaacttctggctttggcggaaattaaagatggcagttacacatctttccttgaatcgagcttgaatgaagattacaataaattaataatcacacatgaagatgtcttatctgaattatatgacatagcaagtcaaaatttctctaataatgtagatgtagaatgaaagtacgtatgtcgagaattcttcgtaattacgcaattcgaatggaacatcatcaaataccacatctttgcgggtgtcnnnnnnnnnnnnnnnnnnnnnccta

SEQ ID NO: 19246 - DNA, 152 bp, Diabrotica virgifera
  misc_feature (137)..(137): n is a, c, g, or t
gtgaacgaaagtgtcgcatcattcgctgtaaatattacaattttaagttaccattaatagcagtaaaatgaaaacttccctgataatatttttatgttgcatgatagtgtctgtactatcagcaaaggatatgatgncgaaaaagcatcgtt

SEQ ID NO: 19247 - DNA, 383 bp, Diabrotica virgifera
  misc_feature (6)..(72): n is a, c, g, or t
  misc_feature (89)..(127): n is a, c, g, or t
  misc_feature (158)..(214): n is a, c, g, or t
  misc_feature (299)..(312): n is a, c, g, or t
  misc_feature (314)..(326): n is a, c, g, or t
aaaccnnnnnnnnnnnnnnnnnnnnnnnnnnnnnnnnnnnnnnnnnnnnnnnnnnnnnnnnnnnnnnnnnnnccaaaagggggggaaannnnnnnnnnnnnnnnnnnnnnnnnnnnnnnnnnnnnnngggggccccccatttttggggataaacccannnnnnnnnnnnnnnnnnnnnnnnnnnnnnnnnnnnnnnnnnnnnnnnnnnnnnnnncgttaaaaaaaaccaaattttccagcggggggggggcggggacaaatccttttaaggggggcccaaattcccctttcgggggggnnnnnnnnnnnnnncnnnnnnnnnnnnnccctgctttccacacattaaaagccgcgggggggaaacccgcttttcggctgtgtgg

SEQ ID NO: 19248 - DNA, 109 bp, Diabrotica virgifera
cagcaatggttcgtaagaatgcagctaaatacatggaacaacttatttttaactatattttgttaattgtatggtaaaatatttttacaataggtttattgatgtaaac

SEQ ID NO: 19249 - DNA, 631 bp, Diabrotica virgifera
  misc_feature (27)..(47): n is a, c, g, or t
  misc_feature (50)..(68): n is a, c, g, or t
  misc_feature (97)..(131): n is a, c, g, or t
  misc_feature (154)..(172): n is a, c, g, or t
  misc_feature (288)..(322): n is a, c, g, or t
  misc_feature (338)..(352): n is a, c, g, or t
  misc_feature (354)..(370): n is a, c, g, or t
  misc_feature (384)..(408): n is a, c, g, or t
cccccccggcgccgtattttaatatgnnnnnnnnnnnnnnnnnnnnngtnnnnnnnnnnnnnnnnnnnggatagagagagagtattgggagagaggnnnnnnnnnnnnnnnnnnnnnnnnnnnnnnnnnnnatctgggccttggggataaaggnnnnnnnnnnnnnnnnnnnataattatcatatttcgaactagatagaatcgtaaacatcattattgtaatggaagaaccatacataatatttctgtcccggaacggaaggggagtttcactatatctgaagtttnnnnnnnnnnnnnnnnnnnnnnnnnnnnnnnnnnnatcataacgttgaagnnnnnnnnnnnnnnncnnnnnnnnnnnnnnnnncgaggagcgggagnnnnnnnnnnnnnnnnnnnnnnnnncttacttaaaaatgaagaataaaagagggcatacccaccagcatagaaggattgatttttatataatattaccataattatttataaatcatttattaatacataaaatgaacatatttactttaattaatgacgctgatactagcataaacaaaacgaatatcccagcccaaaatatataggcctaacacagggattccccaacatctctctcccccgtcct

SEQ ID NO: 19250 - DNA, 715 bp, Diabrotica virgifera
  misc_feature (674)..(709): n is a, c, g, or t
agaacacgatagttactccgttagttactagataaaggaaataagcaagtaggttattggaaaatctatttacggcaattgaaataaaaacagaaagtatcacatatacatttaattataaatcattaagatgtacaaaattaaattatgcgacatgaccaaagatacaaaaacagttatctaaggctgagaatacatacacaaacatgattacacaaagagaaataatggaataacggtatattttaagatcaatacgatttaaatgtgaataaattaaccatcaggtaaacaataacaatacaaatcaagctatgtacctacctgtgatgtaaggtgttcaccaacaagttgcgacaatgaaatttaagaaatacgtacctaatcgctttcacagttgattgtataaaaaatgtgagcattatcgtatgtttcaatcgtatggatttttttttgtattgtaattcacattagtgagtcagccagttataagtagatggattattagtccctatcttaaatagtcctaactataaataactaccctaacgaatatccaaaaagaaaaagtatggattattactgacagatatacttactttaagaacaggccacatattattgtccctcacactcttaattgaagatgcttaaacactttaaagttatgtgcnnnnnnnnnnnnnnnnnnnnnnnnnnnnnnnnnnnnttatat

SEQ ID NO: 19251 - DNA, 704 bp, Diabrotica virgifera
aaagaccttgaagatcttctaccatggcatgagaagcctgtgaagatacaggtcttagttctagacatgtagagggacataatctgtgttatattttagatcacaaaagagtgcaattaaggctgttgtgtgatgagtactagacaggaagaaagagcagactcccaggatatctcgtggttgagtcttatgatcaacaatatacatattttgcatcagaatcttgatagatcaggctatcttctaattattcttctattttttgtttttttctcgagttagctcagttttttcctattttttttttggtacttttgctagatatattttacacatactcatttttatgagtcttaagtgcaatacgttggtaacggaatactggttatttgtcattccttccttgtcgtacctaggttgtttctctttacttcaatagttacaatgactatttgatttttgattgtgtcaagctatacaagaaataagagagtaatcaggagagagaaagagagaaaagattgagtaatctgtaagacatcaaaagatgaaaagacctagaacatcttctatcatagttgtaagaggatgatgaaaggcacaggtattagttcaatccagataaaaaatgaagtgttaaaagacatagaagaaaaacttttgtgtacagtcgtacagtagacataggaatacagcgaagatgc

SEQ ID NO: 19252 - DNA, 88 bp, Diabrotica virgifera
  misc_feature (6)..(81): n is a, c, g, or t
ggggtnnnnnnnnnnnnnnnnnnnnnnnnnnnnnnnnnnnnnnnnnnnnnnnnnnnnnnnnnnnnnnnnnnnnnnnnnnnnggataat

SEQ ID NO: 19253 - DNA, 799 bp, Diabrotica virgifera
  misc_feature (2)..(46): n is a, c, g, or t
  misc_feature (53)..(727): n is a, c, g, or t
  misc_feature (730)..(787): n is a, c, g, or t
  misc_feature (791)..(791): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaannnnnnnnnnnnnnnnnnnnnnnnnnnnnnnnnnnnnnnnnnnnnnnnnnnnnnnnnntaangttttttt

SEQ ID NO: 19254 - DNA, 450 bp, Diabrotica virgifera
gtttggtgggggtcgaactggggaagttttagtgcatgcccatactctcctatagaagtaggcgattgaaggtaaacagatgatgcagcgctgagcttttagttgataatagcgataattgcattagggattaaagcattagtatctatattcatatataattataaaaccagaatacaaaggcgaggacactaaaaagaatggaagcataacaaatgaacagacactattctatccctttagcgaggcgaagccaatactcatttaagtggccgacgcgtcatgttctgcgcggcgcaacacacatgatccgactgaacacaattggaaagtactaattaccatatttctgcaggtgtcctcatattaacgatggccgcccctatcgtccgtggcatcaattacacgggaagactggcagacgcagcacataccggtacttatgaattt

SEQ ID NO: 19255 - DNA, 187 bp, Diabrotica virgifera
gaacaccaacaaagaaaatgcctgttactaaagtttaatccaataattatgactcgagatattgtaaaattattgcaatattattgcaacataagtatttttaaaagtttttttcgatgttagctcgtcttctacggatgcaaatgatgattgcaagggccagtcttaaagcttaatttatggcctc

SEQ ID NO: 19256 - DNA, 151 bp, Diabrotica virgifera
gtttgttgacgtaaccattcaaccaaacctttgcttcatcgccaaacaaaattcgcttaggaaaatccggatcaacgacaatctcgttttgggtccatttattttatctacgacttgctaggagatagggaaggtacaattcttgcccgag

SEQ ID NO: 19257 - DNA, 602 bp, Diabrotica virgifera
cagaggcagtatgtgtggttgttgaatatcaggtcagactaacagaataacgtcctctgcagtgtgtctcaattgatctggtgaaacctgcagtaccactcgcacatcgccgtaaataggcacctaaaacgaacgtgcacacgaaaatgaaggtctaattggacatgtttcttctgatttttgaattttcgtattaattgtttatttctttttaggatatcataaggatagacagaagtagtcgtttaaacgaagataaaatagtggcactcgaacaggaagaaaaaatgttacgggatgtattaaataaagagggcgaattgatggaaaacatacaagaagtaatatcagttgtcgataaattaatggatagtacgcagacatactctttgggacagattgccagtatttttaaagaattgcaggataagcactcagaggaatatacaatgtatgaactaggcgaattggcccccggtctaatcggccctcttatcacatcggctttagccaattgcaatcctctattacagcctcaccaacattgtcgatgaatttaagcaacggaaggatatcctcgagtcccagcaccgtgggaattc

SEQ ID NO: 19258 - DNA, 1030 bp, Diabrotica virgifera
  misc_feature (18)..(756): n is a, c, g, or t
  misc_feature (818)..(831): n is a, c, g, or t
  misc_feature (834)..(856): n is a, c, g, or t
  misc_feature (864)..(885): n is a, c, g, or t
  misc_feature (917)..(939): n is a, c, g, or t
  misc_feature (958)..(1006): n is a, c, g, or t
cttaaaaaattagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagttaaatcgatataaagattgcgacctcgatgttggatnnnnnnnnnnnnnnggnnnnnnnnnnnnnnnnnnnnnnntgttccannnnnnnnnnnnnnnnnnnnnnagtttaaccgggggggcccaggttggtttccnnnnnnnnnnnnnnnnnnnnnnngacccaaggcccaataatnnnnnnnnnnnnnnnnnnnnnnnnnnnnnnnnnnnnnnnnnnnnnnnnnggcccgctccaagacacccccccc

SEQ ID NO: 19259 - DNA, 205 bp, Diabrotica virgifera
  misc_feature (19)..(93): n is a, c, g, or t
  misc_feature (100)..(119): n is a, c, g, or t
  misc_feature (122)..(165): n is a, c, g, or t
  misc_feature (180)..(201): n is a, c, g, or t
cagaaagaccccataagannnnnnnnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnacnnnnnnnnnnnnnnnnnnnnnnnnnnnnnnnnnnnnnnnnnnnnccaccttttttttgnnnnnnnnnnnnnnnnnnnnnncctt

SEQ ID NO: 19260 - DNA, 737 bp, Diabrotica virgifera
  misc_feature (87)..(135): n is a, c, g, or t
  misc_feature (211)..(225): n is a, c, g, or t
  misc_feature (228)..(253): n is a, c, g, or t
  misc_feature (309)..(322): n is a, c, g, or t
  misc_feature (324)..(350): n is a, c, g, or t
  misc_feature (406)..(428): n is a, c, g, or t
  misc_feature (446)..(475): n is a, c, g, or t
  misc_feature (483)..(506): n is a, c, g, or t
  misc_feature (508)..(521): n is a, c, g, or t
  misc_feature (532)..(577): n is a, c, g, or t
  misc_feature (595)..(620): n is a, c, g, or t
  misc_feature (622)..(634): n is a, c, g, or t
  misc_feature (649)..(686): n is a, c, g, or t
  misc_feature (688)..(712): n is a, c, g, or t
atttattttaaaacactaaaatattttttagtcaaagcaaagacagctctcctatttactgagaggtcattagaactgagcgagacnnnnnnnnnnnnnnnnnnnnnnnnnnnnnnnnnnnnnnnnnnnnnnnnnccgattattaattactaattatgtatctattattttcaaatttcaaagagctagaaaattaaaattttcattgacnnnnnnnnnnnnnnnccnnnnnnnnnnnnnnnnnnnnnnnnnnctttttaaacatatctaactttttaagaaatacattacctttattcattaacaacnnnnnnnnnnnnnngnnnnnnnnnnnnnnnnnnnnnnnnnnnctttaggcatgagcttacaaataaaatcctattaaactttaatttttaaacaaacnnnnnnnnnnnnnnnnnnnnnnncttaaaagatgatattcnnnnnnnnnnnnnnnnnnnnnnnnnnnnnncttatacnnnnnnnnnnnnnnnnnnnnnnnncnnnnnnnnnnnnnnccaatgagtgnnnnnnnnnnnnnnnnnnnnnnnnnnnnnnnnnnnnnnnnnnnnnnattactaacgccattcgnnnnnnnnnnnnnnnnnnnnnnnnnngnnnnnnnnnnnnncgtattacatatacnnnnnnnnnnnnnnnnnnnnnnnnnnnnnnnnnnnnnnannnnnnnnnnnnnnnnnnnnnnnnngtcattacttattttattgaaagct

SEQ ID NO: 19261 - DNA, 790 bp, Diabrotica virgifera
  misc_feature (2)..(23): n is a, c, g, or t
  misc_feature (379)..(410): n is a, c, g, or t
  misc_feature (439)..(480): n is a, c, g, or t
  misc_feature (586)..(644): n is a, c, g, or t
  misc_feature (717)..(737): n is a, c, g, or t
cnnnnnnnnnnnnnnnnnnnnnntgggcggacgcagctccagccggtggacgtggtggattccgaggaggttttggaggtggtggccgtggaggtgatagaggtgaatatatgttacgatcttacggcaggagtttttgcattcatagccatatttgttgtatactgtgaatgccaattccgatactggaaggttagagttgtatgatttgagatgtttattatttcatgctacatgctcggttttatatcttctacttttatatatgttaaaataatttgttaaaatgtatgtattagctaattttaattctcacaactttttctaagttatatgcatttattttttcaagttatatgcaaaaagattatgattctgnnnnnnnnnnnnnnnnnnnnnnnnnnnnnnnnctttaatatttctaaatatgatattgtgnnnnnnnnnnnnnnnnnnnnnnnnnnnnnnnnnnnnnnnnnngatagaatataaattataatatttcttaattattgattgtacgcttgatttttcaatcttcatttttaaaaatttgctcttttcactttgtctttctgagcgttcnnnnnnnnnnnnnnnnnnnnnnnnnnnnnnnnnnnnnnnnnnnnnnnnnnnnnnnnnnntgctcctctatggcctgactggttcattctaacggatcgcattgattttgcccgggaaaagtaaagccgatcnnnnnnnnnnnnnnnnnnnnngtgtaattaagtagaaataggaaagaaacactgttttttttttaacattctta

SEQ ID NO: 19262 - DNA, 867 bp, Diabrotica virgifera
  misc_feature (258)..(283): n is a, c, g, or t
atcaaaatgaagattcttttgtttatgcttgttttccttttctgtagacaagaatgtacagacacctgtaacgacattttagttacggacttttctattgacgattgcatccaccaacaaacgctaacaagctcatatttttacacagtagatacaaagacctgtcttccaggatgtcagctgtatgctgacgctggatatttaagaaaaaattgtcccccggactgtcctccaggatatatgtgtgcgaaacgatgnnnnnnnnnnnnnnnnnnnnnnnnnntaacatgtaaagttgacgcagactgcaaagcattcccgtggtcaagatgtcaaaatacttgtgttcctgatcttaatagttgcatggcttatcatgcaaacacttcagatttccgctacaacaaattcactgccataaaatttaagcccgcttgtcaagttgacggatactggaaagcaaagcaatgcaaaggtggcgtcagtggaaggtgtatgtgtttcgataaacacggaaaaaggttatttggtgaagctagacattctaaatccgcagatatgacttgtgcttgtagtaggagaaaagctgaattattagaaagtggaagagactatgtagctttgcactgtaatagtttgggaaattatgaaaaattacaatgtgacagtggtttgtgttggtgcgcgaaaaaaaaacaggagatttggtttcaactatagtaccagaaaaagctatgaacaagttaccctgctatgaggttgcaactacaggcagtcaatatttgagacagtgtgacagcattgcagatgctatggctaaaactacacatgctcttaaaaacatggtgttacgtatattaacctggg

SEQ ID NO: 19263 - DNA, 579 bp, Diabrotica virgifera
  misc_feature (2)..(58): n is a, c, g, or t
  misc_feature (81)..(380): n is a, c, g, or t
  misc_feature (387)..(424): n is a, c, g, or t
  misc_feature (444)..(457): n is a, c, g, or t
  misc_feature (460)..(482): n is a, c, g, or t
  misc_feature (490)..(512): n is a, c, g, or t
  misc_feature (542)..(573): n is a, c, g, or t
cnnnnnnnnnnnnnnnnnnnnnnnnnnnnnnnnnnnnnnnnnnnnnnnnnnnnnnnnntgattatgctaccttagcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgattttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 19264 - DNA, 473 bp, Diabrotica virgifera
ctaggaatggaacctggataatatagtcatcaagaagatagcagcaaagtcatgagcaacaacaacttcataagtatgagaatattgaggaaatccacactcctcgatatctactactggacaaactagaagattgaagaggacaaagccctttgaactagtttgagtgataggtgatagtgaaaagcagagcgtagtgcttgtgtgcttgtgtatgttagaatagtgcacgatcttgttagattagataagagacgctatggggtaagctcttcattttaaggaacagtagtaatttaggttaaattaaatttgctcattggtcagttatgaccagattgtaattctctgatgtttggcaaagggggcttgggtcagagttgcacatcaataatgttttgatgatttgctgtatagagttgcatatgtggactgcatacgccctgtgagttattggtatgaccatgtttatt

SEQ ID NO: 19265 - DNA, 146 bp, Diabrotica virgifera
attgatatacaataattatacaacatactttaccgtatagaagtacatattatgtagttgattgtgaaatatatgttgttaaatttgtaaagtattgacagtattatatatttttggatataaagttagtcccactatgtgtacag

SEQ ID NO: 19266 - DNA, 601 bp, Diabrotica virgifera
gaccatattcacacgaattggaccaatagacacgaagatatgatatagtgccgttttgtcattgctgacatctttgtttatatggtaacatgccttcctctttccaacaatatatgatcagtcaggtcggagacatgctctaatgctcttttgctaatgtctttgtgattgctcctctttcgtttaatgtcttacatgtaataaacgaaccaataacaacgcagatggcagataggtgcttcatggataagtgtcttatttggctttctgactacaccctgtatattttgcgataaacgaaataaagaggaggccatcttggaaggcgagggtttgtgacgtaggtgggcctggctgtgttcccattggtcgttgggcggggcttcgttctcattggtcggtgattggggctaagttctcattggtcgctggactttgatctcattggtccatgggcgatgctgtgggtgggcgaggcttccttctcattggtcggtgggcaatcattggccggtgggcaaccattggtctgtgggcgtggctttgtggtgggcgtgatcggtgggcgtggcttgcgttggccgtggctttgaggtgtgcg

SEQ ID NO: 19267 - DNA, 614 bp, Diabrotica virgifera
  misc_feature (19)..(59): n is a, c, g, or t
  misc_feature (236)..(260): n is a, c, g, or t
  misc_feature (264)..(339): n is a, c, g, or t
  misc_feature (421)..(439): n is a, c, g, or t
  misc_feature (450)..(470): n is a, c, g, or t
ccctgatacacaaggtacnnnnnnnnnnnnnnnnnnnnnnnnnnnnnnnnnnnnnnnnnattgaaaagttgttcttattaaaaaatatctaatatttaatgatttaaacgcgacccaatcaataagcaaaatatgtatagatacatgtaggcatattagaattattaaatatgtgtagtaatagagctaggagtaatcatgaatatagatgtaacctgtaaataaaaattacgacnnnnnnnnnnnnnnnnnnnnnnnnngtcnnnnnnnnnnnnnnnnnnnnnnnnnnnnnnnnnnnnnnnnnnnnnnnnnnnnnnnnnnnnnnnnnnnnnnnnnnnnctataaaagttgataatattacaattacaaaattgaatatttagaattaatatataggtttactaaaggtcattctgcgatnnnnnnnnnnnnnnnnnnnaaaaaacatgnnnnnnnnnnnnnnnnnnnnngtaaacgtctgcccacggcagtaatttgaatgcacgcgatatattcgaccatgctaagacaacataagcataacattatttattgaaaatagatatgaagggccgccccaaaaaaacagcgcctttatataaattctaaaagaa

SEQ ID NO: 19268 - DNA, 678 bp, Diabrotica virgifera
gatatgagtgctaccagtatattagattatccaaaaaggatttataatatggatgaaacatatttctgtttagccccaaaaagtggtactgtaattggaccgcgaggaaaacacatctacgatgaacgaacttcgtcagataaggaaaatgtaactacgcttatcacagttaatgcagaaggaaaattcgctccacctttaacaatttttaaatatgaccggatcccgtctgctatgtgtaaaacagctcctaaaggttggggtttaggaaaaagtcaaagaggctggatgacagcagaatgtttttttgagtatttttcgaacgtttttgtaccctacttaaaggagtctctaaagatctatattcagactcttcttcggaagaacatgaagactgggaggaaactggtagcagtgaagacgatgttgacttcctggaaccagaacaagaaaatattgaaatgttcgataccgatgatctcaaattgggagactttgtgctagaaagatttaagcaactgggtaaaagatcgacgacaacatatccaatatgttgcccaaaattatagatatcctttagtagatagaagaaaaaaactgtgtctagtcccataaaaaacaatgcttcccgcacagtaaacacccccatcctcattaccgccttcctgcatcccgtcg

SEQ ID NO: 19269 - DNA, 837 bp, Diabrotica virgifera
  misc_feature (10)..(10): n is a, c, g, or t
  misc_feature (13)..(13): n is a, c, g, or t
  misc_feature (59)..(59): n is a, c, g, or t
  misc_feature (106)..(125): n is a, c, g, or t
  misc_feature (791)..(828): n is a, c, g, or t
ccctttcagnggncggatagtataagatacgaccagggaggcccctaaagggagacaangaagagggaagcaaagagaagaaaagagagaagaggaggaaagaagnnnnnnnnnnnnnnnnnnnnaactccaaatatgaaagcaccaacctcttcatattcctatactcgattgtccacgccatcaaacaaattgaaaacagatcgatctaccttaggtttaaaatagaaatacaataacaaaaccaccacacgactaacgaactatcgcttcctcaccagaacaagaaacgatgcaacagcaaaaaaaactataggtaagccccatgtccaatagaccgcgatggtattactcacatcttcttcgtatcctactacattgagtccagaacgaggatcttatttacatgcaccattaaaagaattaatagaattaacatcatatactagctacaagcatcatctccaatataaaatcccacaacctctgaacaaccagaaaaacccgctcctaccaaccccacctctcccgcccttaagtcctctcctctctaataacgcctagacagctaaaattggcaatgcacatgaagaccgtataactctaatacagaaaaccttatccacctaatcacaagaccccaaagatgatacccgcaccctacccgaacccagagcataccccggcccccctcaccccttcccgcctctcacatgtcacacccccccgcctcctcccccccgacgcactcgccccacccctccacacccataaaacccctcctaacgcgnnnnnnnnnnnnnnnnnnnnnnnnnnnnnnnnnnnnnntacccccca

SEQ ID NO: 19270 - DNA, 787 bp, Diabrotica virgifera
  misc_feature (111)..(127): n is a, c, g, or t
  misc_feature (585)..(605): n is a, c, g, or t
caaccttcaacaatctcatatcaaaacaaaactactgcaaaatgaaatgtttgtgcatctttgtcgtggcaatcgccgttttgggtgtaagttgcttgccttcgagacaannnnnnnnnnnnnnnnnggcagagtgggaaactgacgccaatcaggttagaaacaggaacataaacaggaatataagacaatcatggaaccaacaaagaggaagacaaattccaacaaattcatggaatccaaatggtcccgacttctcagatccagattttaatcaagatccaaatgtgaatatccaaataccaagtatccagatacctaataaccaactccctgtcgataatggtgttactcctgatggatccactactactacagcctcgccagcttatacaagatgctttgcgaactgccgaactaccagtgaatataatcctgtttgtggtactgatggaaacaattacgacaaccctcagagacttaattgtgccagaagttgtggaagaaatgtacaactacgaagaggaggaacctgtcaaccgttgtaaggatcaaactccacgaatgaataattttcaggactgnnnnnnnnnnnnnnnnnnnnnccataacaattttaccccattgaccttctagatgattttgcttaaattagtgtcaataatgatgtgatatttatttaaaaaagaatagttaatttatttatgacgcttttttgacacagcttaaaacgcttattcgttagtaattatgtaataaatgatgttaaataaaatacttttttaat

SEQ ID NO: 19271 - DNA, 772 bp, Diabrotica virgifera
  misc_feature (713)..(737): n is a, c, g, or t
aaattagtagtgatttcgacaacaaattaccggaaaacaatgcctaagcagggagaaaaacgaaaaagaagtctatcatcagacagaggaatatataagatctaaaaaagtctggaaaagagattagatgctattaaaaacaagcgaatacatcgttccaaacgcatttcgtcttatgaaaatagtgcgactgatattcttgacagtaaccagacagaaatttcgaatacggagcggaatgaaagtgaaggtgctaaacacaatatggtgtagtacatcttttggactcatttatttgtctatcaagatgggcgccataaaaattaatggaattaaagcatctttacttggatgtctaattaggcctatattttccttaggatgtgctttaggtgtttatggtatgtcacataaccttggaggtccaattaagaatcttatggaatcgaaagtatttatcattctcagtaactgcgtctattgcgtatatttaattcacatgccaactatgctactgattaatagatttagtatggagcccataaatttcgactattggaaagtgattcaggactatatagtaagcgtcatattaagttttttaattggtatttattttacgcttgccattgaggagccaggaaatatgattcaaaagaaaattttgccacaaattaccaaatgggagaagatatccaaaaccgaataatgannnnnnnnnnnnnnnnnnnnnnnnngtacaattgtaaaaataatattacataacgctttg

SEQ ID NO: 19272 - DNA, 788 bp, Diabrotica virgifera
gccggtttctgtagaaatttataaaagatgaaagcatagacaatttgaatttgagtatgacaatattatgaaacacataataacataacgtgccataacctacaaaataattatggggaaagcatactcctctctgaaaaatccattaaaaaattttaatgtggaaagcagggctcataaagtgatatcacaaccgaaacctatacctgcacctcggcataaaatagaacaggatcagtatgacagaatgttgcaagagtatccaaaggagtttgaagaaagtttaaagaaaaatgaagagcttgataagaacttaaaaagtgtgtttgttacttctcaagatcaaaacattaatattaagcaagaagcaaatccaaaccggcctctaccaacagatagaagccaagtagaaccttccttatatggaataaaagagcctgagcccaataaagtaccaataggaaaagttacattaggaaatgtattagaatttatatcaaaatatcagggagatccgaaaaattataatgcaaaagtgatagcggataagttcaccttgcaagagcaaacagtccgaaatatattgaagtattttagagtctttgaggtatacctaccccaagaaagaacaaaaactaatgcaaaattcgtaggacccagtttgccaagagttcatataatcaaggagtttaagaagcagctaccaaaacctgactctgaaggaaaaacatagtcgtagtgttgctgaaattaggaatttttaattaattgttgtagtatttatcttg

SEQ ID NO: 19273 - DNA, 750 bp, Diabrotica virgifera
  misc_feature (2)..(18): n is a, c, g, or t
  misc_feature (20)..(62): n is a, c, g, or t
  misc_feature (71)..(676): n is a, c, g, or t
  misc_feature (682)..(682): n is a, c, g, or t
  misc_feature (686)..(687): n is a, c, g, or t
  misc_feature (694)..(748): n is a, c, g, or t
cnnnnnnnnnnnnnnnnncnnnnnnnnnnnnnnnnnnnnnnnnnnnnnnnnnnnnnnnnnnngtaccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggnatgnnagggtgnnnnnnnnnnnnnnnnnnnnnnnnnnnnnnnnnnnnnnnnnnnnnnnnnnnnnnngc

SEQ ID NO: 19274 - DNA, 444 bp, Diabrotica virgifera
  misc_feature (273)..(327): n is a, c, g, or t
gcgagggaacacaaaagacaagatgtgagtctatgatggtgcgcatctaagttaatgtgaagggtctagggtgcgaggtgtatggatcgattgtagaaaactccatattccggcgtcgtaccttcagtagatgggagactaaagaatcaaggcggcgtgcatggtatgagaaacacacacacctaatgagggaatgacacccatagaaagtgatgtttcctctgatagaaatgatcgagggaagcctgaatccccaccgcctggtttgtgatnnnnnnnnnnnnnnnnnnnnnnnnnnnnnnnnnnnnnnnnnnnnnnnnnnnnnnnaacaaccatcctcacctcactgaagctcaagtcaaacgcaaactaaacatagaaaatatgacccatgctcatgaaatgaaaccttcaacacgcccgacagtgaatcgtactaatccg

SEQ ID NO: 19275 - DNA, 377 bp, Diabrotica virgifera
  misc_feature (2)..(354): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaagacccattagagttttat

SEQ ID NO: 19276 - DNA, 280 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(131): n is a, c, g, or t
  misc_feature (161)..(190): n is a, c, g, or t
  misc_feature (205)..(266): n is a, c, g, or t
taacagnnnnnnnnnnnnnnnnnnnnnnnnnnnnnnnnnnnnnntgcgacctcgatgttggattanaagttataattggnnnnnnnnnnnnnnnnnnnnnnntgttcgannnnnnnnnnnnnnnnnnnnnnagtttaacccggtgtgagccaggttggttnnnnnnnnnnnnnnnnnnnnnnnnnnnnnnaggaccaaaggaccnnnnnnnnnnnnnnnnnnnnnnnnnnnnnnnnnnnnnnnnnnnnnnnnnnnnnnnnnnnnnngctttaagggatcc

SEQ ID NO: 19277 - DNA, 54 bp, Diabrotica virgifera
  misc_feature (2)..(53): n is a, c, g, or t
cnnnnnnnnnnnnnnnnnnnnnnnnnnnnnnnnnnnnnnnnnnnnnnnnnnnng

SEQ ID NO: 19278 - DNA, 993 bp, Diabrotica virgifera
  misc_feature (386)..(402): n is a, c, g, or t
  misc_feature (954)..(973): n is a, c, g, or t
cttccagaagctgctcagacacacgaagatggtacacgatgactcccccgcgtcggtcgcgatcaaaaaaccgcacaccgacgatggttcagcggaggaagactcccatcccgtcgtgtttaagtgttcggtgtgcacgttcaccggaaagacgcccgcgatgctcgcgaagcacgagcgcgaagaacatatcaaaacgaagttcttccggtgctcgaagtgcacttatgtaacgcacatcaaagcgcgttacacgaagcacgtcaagtaccattcgatgccgatgattaagtgcgagatgtgcgatttcagaactccgtacaaatggaacctggacaggcactgcaagaaccacaacgggcacggggccttcaagtgttcggccnnnnnnnnnnnnnnnnntatcaagcagagtttgacggtgcacgagatgaaccaccacgtgcctccggtgggccaggcggcgggcctaggagttgggagacggcgcaataaggtcggcgccagcgatacaaccctcgccgaagaggtcggacagcaagagcgacaagcgcaagctcaggtcaaaagtgaaccgctctcgccagtgccagacatcgaggagaaaaagccgaaggtgaagacaccatcgaagaaattcaacatcgatggcaaagattccgatttcatcaatccccgaagatataatccaccacgccaatggcaagatatacttcaaaaacaagggtaaacattggaattttcaagaaaggtttgggacagggaatgggccaagcactgagaagaaaagtccacaacctccgagcggaaaaaaacctcagaaccgatgattaaagaaaccaaccgaccggtgggcctaaccctccattcccgattcctttcgcaaaaactctcctacttaaaaaaaacccaatttgggaagggccaaaataactccgaaaacccggctctggnnnnnnnnnnnnnnnnnnnnaaggctttttttctcggcac

SEQ ID NO: 19279 - DNA, 847 bp, Diabrotica virgifera
atatttttaccttaaatatactgacgttttaaatactgaatttaagtttttttaatgttccgtaatatcgttgattgaaataaacggtaatcttagcgccatctacacgataattgtgaaagtatcatatatatgtatacaatgtatacatattgtaaattatgattcgggagtgctcctagtagcgtttaacgtgtattggtttgtttgtttctactgcatcttgattgtaaatataggtagttagtataggtaattagtaagtgtgtttaatcatcagccattcaagtgatcgcttaatttatgataaattcatttttttatggcgttgttatgtgaatggttgaaaaatcataaaaatgaatccattggagcagaaaaaacatcataaatgtaagatttactaaatttatcttctaattttcctctcgagagactatcggtctctaagatttcaaatttatacagaattgattcaaacaagtgggtgccaagttcagtattaatatacttataatgatcggccagttctgttggtgaacaaagtttgtgttagataaaaaagaatagcatgggttcattatagacctggatctcgcataccaaggaatggtttattaatagcaagctagaagtttgttcataccttagcggtgtcaggtcggacaaactttgatgtgtgggaacactggaatagagcttccaattgattttttgacctttcattaaactctcatacaaaagtcggactgctacttgtcatcaacatgattcctgtcatttgggatgttctgcgtttcggactcgttaaaataacccaccatttttttcaaattttatctattga

SEQ ID NO: 19280 - DNA, 703 bp, Diabrotica virgifera
  misc_feature (68)..(85): n is a, c, g, or t
  misc_feature (117)..(134): n is a, c, g, or t
acaaattttcgtagtttggtaaaaaatgccattttcttcagaatataaagattagcatcagagatacnnnnnnnnnnnnnnnnnngaaattgtaggatatttaattcccaagaacgnnnnnnnnnnnnnnnnnnctacgggaaaaattgagtgaattgtaaatgaataaaataccgaaaaacattgattttttcgatataaaactaacactttcgatagcgagtaaatcgaggactgttaattttaccagaggagtttatggaacgttttttgcttggaatgaatgtttttatcaatttttgcggtcataatatggtaaaaaatttccacccccgagatggggtggcagccgccccaatggtggaggcgcctttcggcatcatatttatggattttgacccttggactgtccactgcttattatcaaattttcaggagaatccgtccattctgtaaaaattgcgaggtgaaatgcttaggttcctgtactataaaacatgaaatatagtttatggattcttacacaaaaaaagaacttgtaaaactattaaaattagttaaatgtgaaaaaattacgttatcgacgctagctgagatttatggccataaattatttagattacctccttgctattgcgtactgaatccaataaaactgttgtgggtcccatttaattagaactgtgaggaaaaatttctacta

SEQ ID NO: 19281 - DNA, 959 bp, Diabrotica virgifera
  misc_feature (109)..(127): n is a, c, g, or t
  misc_feature (191)..(208): n is a, c, g, or t
  misc_feature (795)..(814): n is a, c, g, or t
  misc_feature (831)..(843): n is a, c, g, or t
  misc_feature (845)..(869): n is a, c, g, or t
cggatttagtgaaatgtatttattagttatcgtaattattatgtttagttaattaaatcataaatttgagtttgtaaataaattagatgtgttagttggtgttatttgnnnnnnnnnnnnnnnnnnngtgatgtaaataaaataatataagtaagtcttcctttatttaaattaaacttagtgcctaaagnnnnnnnnnnnnnnnnnngtagagtcaatcgcgtaacaagtgactaataagtttcgaaaccgatagaggtgcttgcggcgctctctgattgaactggagtgcggtgcggctgtggtttcgtgttgcaacgaaattgagaatggttgttcatttttgatttaggtacatgtttactctgattgaattataaactgtaaaattccctcatcttcctttcttccttactctcagtatccgttatggcttgcaaattttagaagctcaaaggcgtaaccagagaaggttcccatttgttttcaatctggtaggatgtggagtaacatttttagtgttattttatgtgctattagattgaaaacttagtctttttaataatttaagcgttcatacaggtatgaattgtccaaaaacattcaaaaactaaacgaaatagccaccactattttgctagtgaaattgatactccgccgtcggcaactaatacaactatacctaacacacttgctaatgtttacgtctagctcgcagtgatgccatttaaagcgtttatatctaatttaaatctaaacagtctgtataaagtttagccaacgcgcaacaagccnnnnnnnnnnnnnnnnnnnncataccattattccagnnnnnnnnnnnnncnnnnnnnnnnnnnnnnnnnnnnnnnatgaagttatttcgaagaaaataaattgtacataacaaatacctttatgttaatatattttaggaattaaaatttctttcctgatttccc

SEQ ID NO: 19282 - DNA, 471 bp, Diabrotica virgifera
  misc_feature (116)..(135): n is a, c, g, or t
aacacccccacaagtacgtgtatcccttgtttgtcttcctgaacagggagaaagaatatgttttaaccatggtagggaattatatgtatatgtttacaaaggtttcaagaaagcannnnnnnnnnnnnnnnnnnntgagaagaaggtatataaaggtacaaatccaacttgccatgattttaatagtacatctgctacaagtgaaagtgtaagcttactcatcggtttcagtacgggacaaatacaattaatagatccaataaaaaaagaacttagtaaattatttaatgaagaaaggtttattgataaaacgagagttacttgtttacgctgggttcctggaagtaaatctttgattttagctgctcatgcatctggacaattttatgttaataatgaagaattgccttgtggataagaagatcaccattacccgcccttcaaaactggtcaatgcttttctttctatac

SEQ ID NO: 19283 - DNA, 96 bp, Diabrotica virgifera
ccccattccacgcgtccgaaaacacggtaatacgtaagtccttgtctgcccccttaggtaggagttcgggagaatcacacacgattagtgacgcca

SEQ ID NO: 19284 - DNA, 798 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccc

SEQ ID NO: 19285 - DNA, 945 bp, Diabrotica virgifera
  misc_feature (2)..(873): n is a, c, g, or t
  misc_feature (879)..(937): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtnnnnnnnnnnnnnnnnnnnnnnnnnnnnnnnnnnnnnnnnnnnnnnnnnnnnnnnnnnncatttttt

SEQ ID NO: 19286 - DNA, 149 bp, Diabrotica virgifera
aacaaaaatgtttgtccctaagatgctcttggtcttgggctttgcccttttagcctcagctggaaaagaccttgattatggcatggaagttttgagatttctttacaaagaaatgagaccaggaggacctgaattgggagactcaaaac

SEQ ID NO: 19287 - DNA, 888 bp, Diabrotica virgifera
  misc_feature (205)..(250): n is a, c, g, or t
  misc_feature (650)..(664): n is a, c, g, or t
agagacttgtgaagaagtaacattaaatgttatggcatttgggcaagctgtcgcacatgatcttagttttatggcacctgcaaatgctactgaattacaatgctgctcagaatattatagaaatgtagagaatacaccgaaggagtgtgcgaatatcgatgtatcgccagaagatccatattattctgaagtgggcattacatgnnnnnnnnnnnnnnnnnnnnnnnnnnnnnnnnnnnnnnnnnnnnnngaaaatttggaatatgctgaacaaataacatcagtaacagctagtttggatttgtcgattgtttatggtagtaccaataaaatccatcaaactctacgggcatttaaaaatggattactcctaacagaaacaaggaatggccaggaatggcctccaagcgcccatcgtagtggctgtccactattattaaagcatgagaatacctgttatcgttcaggggatcctcggaccaatcaaaatcctcatctaacagccaccaccattctctggataagggaacacaacagaatagctacagaactttgtacactaaatcctatgtgggatgacgaaaaaatttttcagacagctcgagccatcaatatagcacaatggcagcatattacctattaccggtgtnnnnnnnnnnnnnnnctctggtacagcatgaaataatatatgatattaaaacatattttaaccaatatgtagacgattacgatgaaaatgtgagaacacatatatataacgagttcgctcatggatctcctagacaattcctttcctcattgctggtaaaatgggcttatttaatgaaaaggggtgccaatatgattcccctatattaaggcatcccttaaatagacctgtttgcttgg

SEQ ID NO: 19288 - DNA, 145 bp, Diabrotica virgifera
  misc_feature (2)..(70): n is a, c, g, or t
  misc_feature (73)..(132): n is a, c, g, or t
cnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnatcccaatttttt

SEQ ID NO: 19289 - DNA, 614 bp, Diabrotica virgifera
ccacgcgcccgaaactttatatcgactgaaaactgcttatcttttaaggaaaaattaagctctttcctaaggtaacttatgcatctatagcaggcaataattccacaataaattctcatcaaactcccaataggaatgtgccatcctcgtcttattccttaactcaaatgtatcacgtcacaaacaacttccaatcagttcgctctatcttcagttttacatgtagatatacaataataaaaccaccataagacaagcgacgtatctcttcctcaccagacccagaaactatgaaacatcaaaaaattatatagataaaccccatgtccaatagacctgatgttattatcacctcttcttcgtatctacctacattgaatcccagaacgaggatctaaaacacatgaactttcaaaagaattaacagaattaatatcctatatagttacaagcattatctctatttataaatcataaaaacttagaaattccagaaaaatcagttctagcaaactaaacccattcagttttaagattttctcttctgaaagacacgattagatacgataatatgtgcaaagtatattgaagaaccgaataaccttctaataaaa

SEQ ID NO: 19290 - DNA, 715 bp, Diabrotica virgifera
gagcggcaaaccgatgctgtgcatcttatttcttattttggaatgcatatttcgttcaaaatctgatataggcggttgtgctagcttttggaatatgaagggttgcattaagatatacagaacggtccggtgagtaacgacgaaatctaaaaagtcccaaacaaaggtcgcagcttcatttcttttgccaagttccctcatagttcgcccgatcttcgaccactcgttcatcaactcgccttcaaaacatatcgccatgatttttaaagctaagaacgccacttggtataaagatgttttgattttcgcagataatttcacatcccttgtgccagtaaaagtcaaacttccagttctattttccgccgttggtttaacattcggacctgaaggattcaaactcttcgtatttggtggactcatggcatgcagtaccagagttagtgcgaaactaatgtcggcttgtttcatttgaccaacgtctttccttccagatcctactcgaagacacagaggcatgataaggttaataatcatgctctcagttttttcttgagatgggaaaagggaactaccaccgcacacttgctccaaagtggatgtatcttgcatattttgaatttgtagagcaatgagacgcaccaccatggagcaaaagtgtggtgggggagcttgcctcaatagcgccgctgtagctgaggtcattccttcgcga

SEQ ID NO: 19291 - DNA, 88 bp, Diabrotica virgifera
  misc_feature (5)..(86): n is a, c, g, or t
ggggnnnnnnnnnnnnnnnnnnnnnnnnnnnnnnnnnnnnnnnnnnnnnnnnnnnnnnnnnnnnnnnnnnnnnnnnnnnnnnnnnnat

SEQ ID NO: 19292 - DNA, 105 bp, Diabrotica virgifera
  misc_feature (2)..(92): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttagggaaaa

SEQ ID NO: 19293 - DNA, 806 bp, Diabrotica virgifera
  misc_feature (8)..(29): n is a, c, g, or t
  misc_feature (31)..(53): n is a, c, g, or t
  misc_feature (56)..(96): n is a, c, g, or t
  misc_feature (98)..(150): n is a, c, g, or t
  misc_feature (154)..(206): n is a, c, g, or t
  misc_feature (226)..(326): n is a, c, g, or t
  misc_feature (334)..(410): n is a, c, g, or t
  misc_feature (412)..(475): n is a, c, g, or t
  misc_feature (477)..(490): n is a, c, g, or t
  misc_feature (495)..(581): n is a, c, g, or t
  misc_feature (583)..(647): n is a, c, g, or t
  misc_feature (655)..(680): n is a, c, g, or t
  misc_feature (682)..(706): n is a, c, g, or t
  misc_feature (720)..(770): n is a, c, g, or t
caaaagcnnnnnnnnnnnnnnnnnnnnnncnnnnnnnnnnnnnnnnnnnnnnncannnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnngacnnnnnnnnnnnnnnnnnnnnnnnnnnnnnnnnnnnnnnnnnnnnnnnnnnnnncaatgaaacgttattcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgacnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnncnnnnnnnnnnnnnnccacnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnncccgcgcnnnnnnnnnnnnnnnnnnnnnnnnnncnnnnnnnnnnnnnnnnnnnnnnnnnaaatgaagccttgnnnnnnnnnnnnnnnnnnnnnnnnnnnnnnnnnnnnnnnnnnnnnnnnnnnctactaagcttaaatttttctaacagacgataggac

SEQ ID NO: 19294 - DNA, 84 bp, Diabrotica virgifera
  misc_feature (2)..(59): n is a, c, g, or t
cnnnnnnnnnnnnnnnnnnnnnnnnnnnnnnnnnnnnnnnnnnnnnnnnnnnnnnnnnncccgcgggattttgaccgggctaag

SEQ ID NO: 19295 - DNA, 247 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(174): n is a, c, g, or t
  misc_feature (176)..(195): n is a, c, g, or t
  misc_feature (206)..(230): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnncnnnnnnnnnnnnnnnnnnnncgaaaggaccnnnnnnnnnnnnnnnnnnnnnnnnnctcatataaatatttga

SEQ ID NO: 19296 - DNA, 883 bp, Diabrotica virgifera
  misc_feature (34)..(66): n is a, c, g, or t
cagtgagcaagatgtcaattgaggttataagaannnnnnnnnnnnnnnnnnnnnnnnnnnnnnnnnatctaaaatgcaaagcgaaaaacgtctacgttttttatcaacatctaaagttcttttcagttctgatagcaaaattgaagaattggttaagaacgaaaaaactgataatgacaaggaatcaaaccacaaaaaaaaaatgtccagtttatggaccttcctgaatatagaattgactcgagactatcagctggacaactctgaagacaggttttctcttaggagagagaaaatatattcttttatgaaaattccaaaagaggttgagcgctttatgctgtacggttttatgcaatgcgcagatgcatttttattcgtgtacaccttcttgcccatgagagttttattggctttatgggctcttgtgaccagaccgttttgtaaatgttttgggtttggtcgaaagagtagcaaatgcatgttaacccctgctgaaatctgtgatctactgaaggctttgattcttttagtttgtagtataattatgatgtacttagacattaatatgctgtatcacctaatcaagagccaatccgtgataaagttgtatatattttataatatgttggaaataggtgatcgattattttcttcatttggtcaagacgccatcgattctttgttttggacagccacagaaccaagaggaagaaaaagagaacatttaggaacaatacctcatttattgttcgctatcatttatgttgtttttcatggagtattggtattattccagcaacaactattaatgtagctattaattctcggaacaaagccttattgacaataatgatgtcaaataatttcgtagaattaaaag

SEQ ID NO: 19297 - DNA, 744 bp, Diabrotica virgifera
  misc_feature (28)..(100): n is a, c, g, or t
  misc_feature (102)..(132): n is a, c, g, or t
  misc_feature (134)..(263): n is a, c, g, or t
  misc_feature (266)..(316): n is a, c, g, or t
  misc_feature (318)..(425): n is a, c, g, or t
  misc_feature (427)..(446): n is a, c, g, or t
  misc_feature (448)..(491): n is a, c, g, or t
  misc_feature (497)..(538): n is a, c, g, or t
  misc_feature (540)..(573): n is a, c, g, or t
  misc_feature (599)..(636): n is a, c, g, or t
  misc_feature (656)..(669): n is a, c, g, or t
  misc_feature (672)..(689): n is a, c, g, or t
  misc_feature (703)..(725): n is a, c, g, or t
tgataatattagtattatcatcattacnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntannnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnncnnnnnnnnnnnnnnnnnnnnnnnnnnnnnnnnnnnnnnnnnnnncgtgannnnnnnnnnnnnnnnnnnnnnnnnnnnnnnnnnnnnnnnnncnnnnnnnnnnnnnnnnnnnnnnnnnnnnnnnnnncaataaattaccttagggataacagnnnnnnnnnnnnnnnnnnnnnnnnnnnnnnnnnnnnnntgcgacctcgatgttgcatnnnnnnnnnnnnnngtnnnnnnnnnnnnnnnnnnaagatctgttcgannnnnnnnnnnnnnnnnnnnnnnagtttaaaccggtgtgagc

SEQ ID NO: 19298 - DNA, 92 bp, Diabrotica virgifera
  misc_feature (2)..(73): n is a, c, g, or t
gnnnnnnnnnnnnnnnnnnnnnnnnnnnnnnnnnnnnnnnnnnnnnnnnnnnnnnnnnnnnnnnnnnnnnnnnaggataaatttatttatat

SEQ ID NO: 19299 - DNA, 1059 bp, Diabrotica virgifera
  misc_feature (647)..(662): n is a, c, g, or t
  misc_feature (664)..(677): n is a, c, g, or t
  misc_feature (1013)..(1031): n is a, c, g, or t
acagtgcatactgatgaaaaaccattatttgaatgtgaaatttgcgccaaacaattttcaacaaagtgttatttacaaatacatatgaaatcgcactctggcgaaaaaccatttaaatgtcaaatttgcaccaaacagttttcagcaaagagttctttaagagtacatatgaaattgcataataatgaatcatttaaatgtcaaatttgcaacaaaccattttcaacaaaggattatgtaaacagacatatgaaagtgcatattggtgaaaaaccgtttgaatgtgaaatttgtaataaacatcttacaacgaaacaaattttaaaaaggcatatgcgagtgcatactggtgaaatgaaattgcagactgatgaaaaatcatttaaatgtgaaatatgcaccaaacagttttcaatgaaagggtatttaaaacaacatattatgagagtacatactgatgaaaaactgtttgaatgtgaaatttgcaccaaaaagttttcaattaaaggctcattaaaaacacatatgagggtgcatactggtgaaaaaccatttgaatgtcaaatttgcagtaagcagttttcaaccaaacaagttttaaaatcgcatatgagattgcatactggttaaagactctttgaatgagnnnnnnnnnnnnnnnncnnnnnnnnnnnnnncgaattattggagagagtagtgtgttatcctaacagtaactgagagcagtgctccgaattaaatatttgaaattggtcaaaaacagttcaattgttttaaaagagttgaaagtacaaatacaagtttggaaacgccacttgaaacatttcaccgcatttaaagtaaaattaccgttaacgaaataacgtaattttacatattatgagggttaagttgggaattcccggcaatcctttaccgctacggcaaagggtttcggcaaatgattgacgcccaaaacctagcccattccccaaccccccaaatttgttattatttcgaatttggacggggtnnnnnnnnnnnnnnnnnnngggggggtccccaaaaatcccccaaaaa

SEQ ID NO: 19300 - DNA, 848 bp, Diabrotica virgifera
aaaacattatatgtctgaaaacagcttatcttttaaggaaacaattaaactctttcctaagataacttatgcatctatagcagccaataattcctcaataaattctcatcaaactccaaatatgaatgcaccatcctcttcatattcctttactcaattgtccacgtctcaaacatcttccaatcagttcgctctaccttcagtttcaaatagatatacaataataaaaccaccaaaatacaaacgacctatctcttcctcaccagaccaagtaacaatggaacatcaaaaaataataaagttaaaccccatgtccaacagacctggtggtattatcacctcttcttcgtatcaatctacatttaatccagaacaaggatctaaaatacatgaaccatcaaaagaattaacagaattaatatcaaatatagttacaagtattatctctaatataaatcacaaaaattttgaaattccagaaaaatcagttctagtaaattcaattcaatcagttttaagttctctcttatataataatgaatagattggtaatttgtcaatggaattgtagatcggctaactctaatagagaaaaccttatccacctattagaagaccagaaagttgatatcgcattattatcagaaactagatttaaaccaggaaagtattataactttcacgggtacaatattgtcagagacgaccgcttttcagtaactgttggcggtggctcagcaattttaataaattcaaacctatattacgaggaagtcaccatgaaagtagattttataaacgtcaataaagtagcaataaaaataaagtttaagtcatatactgtcaca

SEQ ID NO: 19301 - DNA, 934 bp, Diabrotica virgifera
  misc_feature (49)..(66): n is a, c, g, or t
  misc_feature (84)..(98): n is a, c, g, or t
  misc_feature (100)..(115): n is a, c, g, or t
  misc_feature (294)..(314): n is a, c, g, or t
  misc_feature (402)..(427): n is a, c, g, or t
  misc_feature (598)..(620): n is a, c, g, or t
  misc_feature (750)..(762): n is a, c, g, or t
  misc_feature (764)..(777): n is a, c, g, or t
  misc_feature (836)..(856): n is a, c, g, or t
  misc_feature (903)..(926): n is a, c, g, or t
ctttgtactctcgtaagaaattatacttgtattattatgatttcaacgnnnnnnnnnnnnnnnnnncggtttaattgtatttgnnnnnnnnnnnnnnncnnnnnnnnnnnnnnnnctaattttaaccattaaaataataccaaaaattaaaaataacgttaatactacataaactttagcctccccgcaaaaaatctaaaaaaacgtcagattttctacacaaatttctaattttctttttatcatattttaatactaattatcctattaccaacgaagacaaatccaaagacnnnnnnnnnnnnnnnnnnnnngacgaaggacgaagtagttttcaatcctaatagtaaattattaatattgaatttatcaaattgaaaatcaaatatattgaatatttgnnnnnnnnnnnnnnnnnnnnnnnnnnctaaaaacaccaatatactttttcacactttatttgcattgatacatacgtaacttgaaatatttagcaactaacttaatactgtcggtatgcgcgtactttatactgccgcttttataaaaattcactctcgccattttttccaatctcgcctaaagaagtaaaacttcnnnnnnnnnnnnnnnnnnnnnnnggtggaaagagatatacaaaaattaagaaaatcatatcaaaagcaatgtctcaaactccatgaaacataacgcacttctcagttttttgtcttttcccatagaccaccctcaaactaaaatattagaacnnnnnnnnnnnnngnnnnnnnnnnnnnncatgtattccacgttgatgtaatttttgtcagcatggtttagttttgtttgtgtgatgnnnnnnnnnnnnnnnnnnnnnagaagtagtaattttaacattttgagaatatgtatatactgttgccnnnnnnnnnnnnnnnnnnnnnnnngattatcg

SEQ ID NO: 19302 - DNA, 950 bp, Diabrotica virgifera
  misc_feature (52)..(70): n is a, c, g, or t
  misc_feature (864)..(894): n is a, c, g, or t
  misc_feature (896)..(911): n is a, c, g, or t
aatttttattaaaatgggtgtattaaaaaatctgcatggtatgacgagaagnnnnnnnnnnnnnnnnnnngattcttttgatcaagttttatttgaaataaaagattccatagatggcaaagtaaatattttaccagacaaacttagcacaattaagtactttgaaaaaattaagaaggatgtaagatatttaacagataacagtggaagcaagacggaaacagtagtagactatttacatcaacaaaatattgtgactcaaagagaagatgtgtttagacctacatagtcagttattgcttatttcaaaaataaaggttttaaaaaggaaatatttgttattggctccagcttactcaaagaagaattggagcatgctggttttgatttagcggaagaagttcctaaggagataggaaaaaattttcgtggtgtttttgtaaacaacaaagataacagcaatgtgggggctgtaatattagatcacaattttaatctaagtttcattatgctgcaaaaagcattctggtgtttagggtcacccgattgtgaacttatcactataaatcctgagaaggaaattgtcacggagcaaggaaatattttaggaatatactactttgtgaaaaccttaaaggatattacaaaaaaattagaagttaaccttggtcagtattcacaacattatcacgaagctctggcaaaaaaatttcagatatccgatcccaaacgaattctctatataagggagctagatacaaaatataaagagagagaaaatcgaagaaaactttcaaagagatttctgatattaaatggtactgacgaacaagagaggatgaattgaaaaacacatgaataacnnnnnnnnnnnnnnnnnnnnnnnnnnnnnnngnnnnnnnnnnnnnnnnccagaaggggtactaaatatattggatttatggacccct

SEQ ID NO: 19303 - DNA, 818 bp, Diabrotica virgifera
  misc_feature (163)..(183): n is a, c, g, or t
  misc_feature (714)..(734): n is a, c, g, or t
actggctttattttgcaggtagatccccctaccaccaaagcatccaggttcaagtgttttgatggttctgggatctactggctttattttgcaggtaaccatttgactcatattgtaaagggagtgttttataaagtaccagtctccttattggatttcactnnnnnnnnnnnnnnnnnnnnngataaaggagccttagctggtctttcaacgctaacatttgttcagttatctaataacaatattggagatttgaagctgtccactcttggcgacctcaatactcctttaaatggtctatctttgagtgataacggcattttttatatcgatattggagtgttcaaaaatactaaaatcgatatgttggacttttttttaaaccatataaaatcgattaaaaaagggctgttccataatgttaaaatgtacactattaatttgagtgaaaatgaaattactgaaatagaggaagatgcttttggtgatatcgaggacttaagtcacatagatgtgagcttgaacaaacttacagaagttaagaagaggatgttcagtctaccattggatgaagctaatttggaagataatgtaataactaaaatcgataatgatgccctcaatggacttcccctgtcaagtcttcagataaaaaataatcctatttgctgccaagaacaacgcttaacatattgtgtatttaataataagtgnnnnnnnnnnnnnnnnnnnnngttttccgtttctttgtttgtaacatttccgtcttaaaaatttatatgattaaattaggataaagaccttttaagatacgccgc

SEQ ID NO: 19304 - DNA, 934 bp, Diabrotica virgifera
  misc_feature (307)..(329): n is a, c, g, or t
  misc_feature (775)..(794): n is a, c, g, or t
cccgaagagtgttgacttggtgaagaagctctatagagcagaagttgcttggaattggccagtttattcatttcctgactttctttggacgaatattttttcacccccaagatggggtgaaaaccacccccagggcaggggcacatatcggcgcaatatcactttttttctttgacttgttggctgtgtgtatgccaaatttcatgtcactccgagcggttctttaaaatttagagattttgcaatattttaccgttaaagaacggactatatgcgcagtaacacatttttaattacttcgcatacnnnnnnnnnnnnnnnnnnnnnnngtttttgtgacgggttggaacagaccttttattcagacttaattagttcctttatacgtctctttaaaactcagtctactaaagctaacttaaggcctttcttttgaatataaagaatttgacactgttcattaaaagaatgattatgatctaaaaggtgacgtgcgtacgtagaatctgtttttctattgttgaaagtccttttgtgttctgctatccgcttgtcaacggttctggcagtttgaacgatgtaagtttttgtacagtcaccacatgttagtttgtaattgatttatcttttgggtcttattgttcttaatgtagttacttaagttgttgttagttctgaaagttggtgttattcctttcttttttatgcgtctctttatgtcattggtattttgtttacctgcatccgttgtacaaggcccgtccatcgtaattgnnnnnnnnnnnnnnnnnnnngtagacactgttttccacaattcttctatataagtgcctcaaaatttttcattcaaaggtagctaaagttttttatcgatttttgggactgacttattagattagccccatactaattttatacatttgacgtaaccttt

SEQ ID NO: 19305 - DNA, 672 bp, Diabrotica virgifera
  misc_feature (2)..(539): n is a, c, g, or t
  misc_feature (546)..(583): n is a, c, g, or t
  misc_feature (603)..(616): n is a, c, g, or t
  misc_feature (619)..(641): n is a, c, g, or t
  misc_feature (650)..(671): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacnnnnnnnnnnnnnnnnnnnnnna

SEQ ID NO: 19306 - DNA, 715 bp, Diabrotica virgifera
  misc_feature (86)..(108): n is a, c, g, or t
attatgattcatttacttacagtatagattgtttagcaaagtctttaaaaattccatttaatgataaataatcacaattgagagannnnnnnnnnnnnnnnnnnnnnncaactttattccctgtaccttgggcatcattactaattaataaataactatagattaattatttccgaatattaacaagatgattacacatgaaaactttctatggaaaaatacaaatgtctagataatttttttgacacgacatgtcattcctgtttatagatatctagtttttcaagaaatacatctaaatttatttattatccatatagtttataatgataaatttgtatattattatgattcaacattcttaggtacgagctaaaaagtaatgtttcataacgattgagtttttactgagcaatcactattactagttttcatatttacaaatatgctattatttactttaatatattattatctctatgttgtatcaaatttttatatagacatataaatacaaattcatgtaccattaaagaatgatgatactattctacccacacaaatgaatattccacagacatatactcactcctaatatcgctgctctgcaacctttgtttcacctgactatcaatgacgtgtcttcctgtattaactatataggctcgtctgcccactgatcaattacaacgcacgcgcaatctacaccgtgcta

SEQ ID NO: 19307 - DNA, 863 bp, Diabrotica virgifera
  misc_feature (398)..(416): n is a, c, g, or t
  misc_feature (766)..(766): n is a, c, g, or t
gtgtcgttcaagaaagcagcacacaccacaaaacaaaattaaaccagaaatttatttctatagataatacgttagattcgcttgattcaaatgatcacagatggtcatttacaaacgcttctttgattggtagtgttcaacgtaacaataataattgtgatagtaatgtggttccattatctatattagattctagttttgttaatgatgatgatacgtctgggttagttccatataacggttgtagacaaccaaatactttagatctagatattaattcgttattagttaggaaacaaaatgataataggccatatcttcctattcaaattttaggacaatcgtgtttagctttgttagatagtggctctaatatttcattgataggggcacattcnnnnnnnnnnnnnnnnnnntctagtattcccattatgcccatttcatctttgcaagtatctactgcagatggtacagttcagtccattacgggcaaactccaaattaaaatcacagtggcagatttatgtagggaaattacattttatgttattccttccgtgcagaattctataattttaggtatggactttttcaatgctttcaatagtaccttaagttgttctgatttttctttttccatatctgaatttaatttatctacccttagtgctattcacgattttgctagtttatcaagctctgaacaaaggcaattagagagtatgatctctaaatttactactctttcttcaaaagacaaactagngtcgtacgtcgttaatctctcacactatcgaagtgggaaatcccactcctttcagattatatcagtaccccatacctcaagcctgccaggcagattt

SEQ ID NO: 19308 - DNA, 943 bp, Diabrotica virgifera
  misc_feature (6)..(20): n is a, c, g, or t
ggtcannnnnnnnnnnnnnngggtagtttatacgcggagcacccagtactactcttttgagttaaatttgcgaattaggtttattttacgcgaactaagttctctgtggtaccaaaagtaccgtctagcgctgtcagaaagtaagtactttttacacaatcttttacgtctttccattaaataatcgaagttttttaattccgcaattgctcgcggttcttcacattacaaacgtattaagtttacttcttcaccttacttctgctttaattcaagacatacacgaggccatcattagagaagaaatgcaaattaatggcactattaaacaataaaccaaattgaaagaaccaaaaaatgtgcccgcatcttttaagtaatcactccagtattctctagaacaatatgaattattctgaatgccgttttgatacatggcgttttccatgttttcgtttgtttattccatttaatttcgcaacatttccttgtagtctgtggcgacacatttttcttcctattctgtattgaaacatgtaaattttaaacgatcatcactgcaagcctctgcaaatttttgcgaatacttcttcaatatattttttttgctctctatgtctggattattcccgacagtagtggggatatgcccgatatggcaaacccatcctacgtttagtatgactggatttatgggcattaattgtttcttgtattacaaaattgtaatctcccgttacgaaaaatagacaatacattaatactgtactcccatttacacagtagtaatatattgtaaaatctagttatttgactttttaatacatgcatgcaaattttttaacggttttcaaaatagccaaatcatttctttgatttcgtttggcagaaaaaggccttttccatctacgacgaacgatttacattaaaacagatttgtttt

SEQ ID NO: 19309 - DNA, 934 bp, Diabrotica virgifera
ggcaaagatggcattcatagaagtgatgtagttgagtgggaggatattattatatgagttgtttttaagagagttctacaaaaaaatatgagtcacctctcaacatccaaatgtactaatatttttacagatgcgccctggtctataggtagagtagatgtcacacaatattccgtcagttcttttaatccatttaacgctgtggattagtttgcatacgtatatcctttagactatttttctaagattatatttttgctttatctatcttttccactctctccggttgtaaatcttttctctccagtttttgataatctactacgagtagtagttgatctttccatcttatttttgatctaccttttgttgtgtttattactagtgtccagttcgttatcctcctaattagtgcgtcttcttctcttctttgtatgtgcccaacccatctcagcctttgtggtttgatacattttactatatccccatatttactgcttcatggttcatcaatcttctatatctctttgttctgtctttattgggccgtgtattcttctactaactttactttcaattattcttaggttttctttatcttctgtcgtaagacacgtgtgaaaaagataaacagatgttgtgttgaaccagtttctaaggttctttaatcaggatgttcttcttctccctggacttcgctctccaaatatttttccttgcaggatgaattgtaaaagggcatatctggattcatttccgttaatgttttgactctacttttcggatttgatgaaggttagtcttcttccttcttcggagaacatcttcattaatggaccgaaccgtccaatggatttttaattttcctccaaaaaaagttaaccccctatttttattcgcccagcccccccttaattttgaaaaggatttttat

SEQ ID NO: 19310 - DNA, 855 bp, Diabrotica virgifera
ataaaggcaaacaagtccttctaaaacagctggaaaccactgacagtggaaactataggacatctttattggaagtcaaagccctaggtgaaaccaattacgtattagtctgttctcttaatattttagaggaagttttaaagcaattgcagcaggtaggaatgatgacggatcattataactatctcatcacaaatttggatacgcaaacagtagacctgtcgccatttcagtatgcaggcaccaatataacagcgataagaatgttaaatcctgacagtaaagaagtcacgcaaattacagaaaatatacaaaaaatgagcgctttgccattttccggttttccaattcttcttcaagcatggaaaactaaactggatacagcacttatcattgacgcagtgcaactattccacgaaacaatctatgaactcaccaaggataaaaagaaaatcattagaggcgtttccttatcctgtagtaaccaaagtaactggaatgagggatatacgattacaaatctaatgaaatcagttgaggacattcgaaggcttatctggcacggtaaagtttgacggtgaaggttttagaacggattttaaaatagatctactggaattgacgctaggcggtctaataaaggtaggagaatggaattccagcagaagaagtttgaattttcacagacctgatagaaagaacccaaacgaagaagaaaatccctttaacagaacttttaaggtgctgattagtataaaccctccctatcaaatgctaaaagactccactacccagcttttaggaaatgaaagatacgaaggatacggtatagatttgatagaaaaattatcaaaa

SEQ ID NO: 19311 - DNA, 871 bp, Diabrotica virgifera
  misc_feature (443)..(466): n is a, c, g, or t
gaaatttaaaagcaaaattatgaaaacaataacagagcaaactgtaacaaagaataataaaaagaacttctaaaattgaaaataaattatacttggaaatcaatgtcagaatgatacattttgtatcctttggattatgctcaactaacgataaaaggaaagatcgagggaaagagtaaactagaagaggaaggagggaagaaatatccgacatgggccaaattttggacagtcaataagaacagctggagacagagaacagtttgcaattgtagcaactaatctccatagagaggatactttaagaagaaaatcctttggaggcttttttagtgtctggatgtataaagaaaactgttttttttctctaaaggttagctctaaattctttggtttgatgtcattagctttattctttattttgtagacgctattcttcaccnnnnnnnnnnnnnnnnnnnnnnnncctgtgctcttaccacatgacctatccatattatccggttagcttttatataatgtctgacgatgtttttagtaccatacagtcaccaatacatacagtcaccaattcgtctctttgagggccaaatatcattctgagaaccttccattcaaataccctcagcctatttattggccgaatattttagatgtggtcttaatttagatttacaaggatatacaaggagtataacgctttattccccgcagatatccttgctaagacttctttgtctatatggttgtcatctgtaattaccggattcagatattgaaacttttttgctacttctaagttgtggtcattaataattatgttttgcctatctcttggtcttggatttttggttactaacgtgtacatatt

SEQ ID NO: 19312 - DNA, 152 bp, Diabrotica virgifera
  misc_feature (2)..(27): n is a, c, g, or t
gnnnnnnnnnnnnnnnnnnnnnnnnnngaaaataattgtgtatcatagtaaagatatatacggtgactaaagagattctagaccgattttttttacacctgttttattagaaaagtagtgcttcttcggatcaatcgcacgcgtccaacggc

SEQ ID NO: 19313 - DNA, 178 bp, Diabrotica virgifera
  misc_feature (23)..(42): n is a, c, g, or t
  misc_feature (45)..(60): n is a, c, g, or t
taagattaaaaaataaatgtagnnnnnnnnnnnnnnnnnnnngannnnnnnnnnnnnnnngatcttggtttttgattataaaaatgaattctccttctcattgacaccgtgattgttttgaactttctaaatacaataagcaagaatatggccaaaaaatgatgtgttatttgaaaac

SEQ ID NO: 19314 - DNA, 462 bp, Diabrotica virgifera
tccgttttagggggtccaagttttcgttggggtgcgtggggggtcgtggttttttttttgggtctccttttttcttttttttgtccgttgttttacctggtcttttttggttaggccctggggttccccctttttgtcgccttggcggttgtccccctttgccctggtggcgtgtttgcgggggggcccccaccgctggcccttcccatcggtgggcccccctgggtggggtctgggccgggccttggaggggggctttcgggggggggggtgtggtggttgcgcgcagtggggccggttcgtttggcggtgcctcgatgcccgcccctttggttttcttctctttttttccccccccgttcggcggttttccctgctgagttttaaagcgggggtttcttttgggggcccttttttgtgtgttctgtcgctgtgacccgagggcatttggttttggggggg

SEQ ID NO: 19315 - DNA, 844 bp, Diabrotica virgifera
  misc_feature (2)..(843): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 19316 - DNA, 681 bp, Diabrotica virgifera
  misc_feature (184)..(218): n is a, c, g, or t
ggtggcacgccggggggcagcggcgcggtacccccggcttccttcacgcccccggaacaattgaaagaagacgggcaaaattgtttaaaacagagtgccacggagaagtatcgccaatagtgtatgagggccttagatagaaataattcaaatttttttccaagctcgatcccacagaaactannnnnnnnnnnnnnnnnnnnnnnnnnnnnnnnnnnggagcaagcacttctattagctactaaaataggaactcgaggatggactcccaaaaaaggtggccacgacagtgcccaaggaactggagaatggaaaggacttagaaacacagggccattgaaaaaccaaaaccgactagctaccatatacgaaaacccatctgcttcctccctgatctttatcgaactaatcgagccaccaggcaaaataaagttaatacagcacatccacacacactgagaacattacttccgatgaaaacatcactaatgccacacagatgaaagaccaaatcgatggacaaacagttatcatcaagtagaaaagagtgtttaggaaccgcccaaacaactgaatggacaactgatgaaaaaacaggagatgatgttattgacgtacgtaatgcaggaaacatagaagtaccagatgtctaaacaatcattaaaatattttttcacaggt

SEQ ID NO: 19317 - DNA, 684 bp, Diabrotica virgifera
  misc_feature (438)..(481): n is a, c, g, or t
  misc_feature (521)..(540): n is a, c, g, or t
catatattgtaaacatatatatttttttgacgtaccttataaaaagttgtctcggtaaaaaaaagtgtaccatcttcagagttagcaaatttttatacggtttaaatgcgatcaacatttaataagaacgcatagttaatatttacgttgtatctatatacaggactagacaaaagcaatgaacatcagtatctcagtaattttaaatagtctctccgatatgttatgtcaatatcgaaaagtaccatcaccgtactttatataatattccctatgactaattttattagtgttcaagatattttcttttttcatagctaattattaattattgaagtaaagttttccaaatcgtaagtatgtcatgattgaattgtctaaaactaactatttacgattactaactatcaattcggatgtcaatctaaaaatgtagcnnnnnnnnnnnnnnnnnnnnnnnnnnnnnnnnnnnnnnnnnnnncacaaaatacttaatttttgaaacagattaatatctaacnnnnnnnnnnnnnnnnnnnnatgttactattatatagaggccctaaaaacgcaatataagtgaccctcttacactttgaaaatattgggcttgacatacaaaaatgaactcccaaacctcattggccccatggtgcctttaaactttctacctattttaaccat

SEQ ID NO: 19318 - DNA, 889 bp, Diabrotica virgifera
  misc_feature (208)..(227): n is a, c, g, or t
cagaaactaaagtcagaagaaacaaaagaaaatctgaaacacgaaatcaacacaaatctagacagaaacccaggaaataattgcaacgtagaacagcagtggcaattcttcacaacctctatattagaaccaagtaagaaagtacttactacaaccaaatgtaagaaagaagaatggatgacggaggaaattctagacttgatgaatnnnnnnnnnnnnnnnnnnnncattaataagacccgctataaacagcttcaaaaccaaataagaagaaaaattagggaggctaaagaaacctacttgtctgaaaaatgtaaagaaatagaagaactgcaaaacacatatgacaacttcaacctacataaaaaaagtcaaagaactagccggaataggaaatagaagaacctcaaatatattgctcgacaaaaatggaaatattataatggagacaaaacgaaaactacgacgatggaaagagtatatcgaggaactatttcatgaccagagagaagctagtacatccgtagatagccaaacgggagatgtaggcccagagataaccaaatcagaggttagtcaggcaataaactctatgaaaaccaataaatctgctggtccagatgaattgcctagcgagctgataaagttggtcaacgagaaaaacctggacataatagtagaactgttcaacgctatctatactactggaatcatccctagagaaatgttgacatcagcctttgtgtgtttgccaaagaaggtgaatgcaaaagaatgcagtgactaccgaaccataagcttaatgtcacataccttgaaaattctattgaaaattatccacgccagaatacactctaaactggagctggatattagtgacactcaatat

SEQ ID NO: 19319 - DNA, 167 bp, Diabrotica virgifera
  misc_feature (2)..(91): n is a, c, g, or t
  misc_feature (98)..(127): n is a, c, g, or t
  misc_feature (129)..(164): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagagnnnnnnnnnnnnnnnnnnnnnnnnnnnnnngnnnnnnnnnnnnnnnnnnnnnnnnnnnnnnnnnnnnggg

SEQ ID NO: 19320 - DNA, 799 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(797): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 19321 - DNA, 706 bp, Diabrotica virgifera
  misc_feature (673)..(673): n is a, c, g, or t
  misc_feature (678)..(678): n is a, c, g, or t
gactgttttatgttttatttagtgttagttgttaaataagaacaaatcattgtgtttttcttgctttatttaaatattttagtgatattaagtttaataatgactaaagcgtagcgatatggcttgcgtacgaaccgtgtacaacctaatttcacatcagcaggtgttagactgacactagggtcaattcaaatacctatatcctgtatatgaactctttttctgttgctgaacagattgtaatggtaaattggacaatttcgctttacttaggatacgcttatacgacatgcagattaactgcaaattaaaaataagctctaagatagagccattggtatgctgttgcgatggcaggaaaacctgacttatcctctgcctctggcatccaaaatgttatagtatatgtctctgatgacaattttgctcaggcttactctctgggacaacaaacagttcaagaatccaatcatattgttcaaggtgaaggatataatgtcctttctgcaccaaatgcttccctagttggacctgttaagtccttcagagagaaatcaactgttaaacttgtggactatgcagttaagcaaccacaggttgaaaatgttcaacaaagggaatattacaataatacattacctcagaacagaggttgtacctatccccctttacncacangtggttttccacaaaatgatgtcacttt

SEQ ID NO: 19322 - DNA, 954 bp, Diabrotica virgifera
  misc_feature (26)..(44): n is a, c, g, or t
  misc_feature (268)..(280): n is a, c, g, or t
  misc_feature (283)..(296): n is a, c, g, or t
  misc_feature (766)..(766): n is a, c, g, or t
ccatttcccagcaattttgtttaccnnnnnnnnnnnnnnnnnnnggtgttatatttttttgaatacctacatattaaaatgaaaccagaaacagattatgcagaaaaaataaacgaaatttcaaaacagtttttgtgcgtatacccattaaacaattttaattggcagaatattttcaatatatttttgctagaagatgtacaagagctacttctaaataagactgttaattcagaattagtattaaaatatccaattcaaataaagnnnnnnnnnnnnntcnnnnnnnnnnnnnnggataaattggaaagcctacaggctgcctcagaaatagatttagaggaatctacaattcacgacgacctatattcggcgtacggccgcttggtagcagcaggggacagtgtggaaaagaattacaaacattactcattgggtaaggagtacaaggtcattaccttgaaagaaagtaatagtttgatatcagatggaacgacgggactgagaacctggcaggcttcgctagcattatccgagtggataattcaaaatagcaactcatttaaacagcaaactgttttagaattgggttcaggggttggtcttacaggattagttttaaataatgtttgtcaaacaaaaaccatatatcttacggattccatgaagctgtgttaaaaactttgtgtgaaaatgtaaagctaaacgttaatggaagtcaccttgataccacagacgatattgagagtcataatgactgtagcgntttaaaaaactgctgcgtttatagcaatactgacacttccactatatctatcttaaatttaccatggggaaaatgttacgcccagtatatgcaaagatctcggagttatagaaaaagttatagcagccgatattatctatgaacatgatctcttttcatcgttaaataaacgctatgaaatggctcaa

SEQ ID NO: 19323 - DNA, 789 bp, Diabrotica virgifera
  misc_feature (430)..(516): n is a, c, g, or t
  misc_feature (518)..(566): n is a, c, g, or t
  misc_feature (568)..(587): n is a, c, g, or t
  misc_feature (591)..(631): n is a, c, g, or t
  misc_feature (643)..(659): n is a, c, g, or t
  misc_feature (661)..(673): n is a, c, g, or t
  misc_feature (694)..(717): n is a, c, g, or t
  misc_feature (719)..(758): n is a, c, g, or t
  misc_feature (760)..(788): n is a, c, g, or t
attaccaataattgttgagctatcaaaatacctacgtagttatgatagttggtgcgattaacaattgagcacaaattaaagcagttaggtatggggaatgcttaagaagtgaagaagtgccataaaatgtcatttagttgcaatactaaaatgcagggtgttctatttgggaaggctcaggaaatgctcattccgagtttcgaccaaccctatatacaggaattacaaatttggctatactaatagttcttgacaatggtggactgtattggggaccatttgaccataaatagagtttttgatgtcaagctgctacagttctacgtagtgttaatgttgctacttttttagtatgaaactttaattatcttttatactgccctgtgatttattgctaagactcatgtttaggaatgttcatattctaagnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnngnnnnnnnnnnnnnnnnnnnnaatnnnnnnnnnnnnnnnnnnnnnnnnnnnnnnnnnnnnnnnnnaattaaatatcnnnnnnnnnnnnnnnnnannnnnnnnnnnnnatcgtcgtcgggtttttttgnnnnnnnnnnnnnnnnnnnnnnnncnnnnnnnnnnnnnnnnnnnnnnnnnnnnnnnnnnnnnnnncnnnnnnnnnnnnnnnnnnnnnnnnnnnnnc

SEQ ID NO: 19324 - DNA, 942 bp, Diabrotica virgifera
  misc_feature (105)..(124): n is a, c, g, or t
  misc_feature (262)..(277): n is a, c, g, or t
  misc_feature (280)..(294): n is a, c, g, or t
  misc_feature (409)..(421): n is a, c, g, or t
  misc_feature (423)..(456): n is a, c, g, or t
  misc_feature (568)..(581): n is a, c, g, or t
  misc_feature (584)..(597): n is a, c, g, or t
  misc_feature (806)..(806): n is a, c, g, or t
  misc_feature (837)..(837): n is a, c, g, or t
  misc_feature (905)..(927): n is a, c, g, or t
ttttgataatttaggatgtatttatgttgaatgtttgggtagttatgtagtagaatgtctagctgatacatctgggaattatttctggaattttattttgagttnnnnnnnnnnnnnnnnnnnncattaaagggagctgaaaatatttcataggttataaagtttggaatttttgtatagtttttactatttacattgtagtttttgcagcctgcttgttttcagctcttggaacattaaaaaagaagtgaaatagtctgtnnnnnnnnnnnnnnnnggnnnnnnnnnnnnnnngcttccatccacagctttttgtttaaccttccgttactcgcgccaatattttgtgatcgaatacttgcgcacggtgcagaagactgggtccaaaatatgggtcagcactatatgnnnnnnnnnnnnngnnnnnnnnnnnnnnnnnnnnnnnnnnnnnnnnnngggccttgcccacttttagtacaataatttacagtttaaaaacctcaatagaattagtcaaataataaaatcttaatataaaaacaatctaaaaacagtcaaagtgcttagnnnnnnnnnnnnnnagnnnnnnnnnnnnnncaatacaacattgatataatataaaactgacaggtacaaatacaatacatcacaatatatcacattgaaaaatttatatcacaatttgctttaacaggctcacaaatttactatagctttcattaaaaaaatctaaactatcagcataacagttagccattcgtgacactctaggtatataagaattaaggccaacattggttctcctnaatggctgatgaaatacgttaactgatctgntgtttcttaatggaactgaaaacaacattgtgaacatcaatgaaggacagtcaatcatggttattaannnnnnnnnnnnnnnnnnnnnnngatcctgcctgatcc

SEQ ID NO: 19325 - DNA, 919 bp, Diabrotica virgifera
  misc_feature (771)..(807): n is a, c, g, or t
  misc_feature (814)..(833): n is a, c, g, or t
  misc_feature (848)..(869): n is a, c, g, or t
  misc_feature (881)..(914): n is a, c, g, or t
ataagttaaatggttaaatggcattaaatgggtaaaaaataaatgatctaactaaacgaaagtaaacaaatatagaatctaagaaatgaaaactaaaactaaagttagtctaatacttgtttaataagtaaagaggataaaactacagtacttgttacctgttgtcaaaagtcaaaatcatttccaaatttttaagtgaacttggaatgttcttatgatgtaattttttatttaaacaatggttatttgacataaacctcaattttacagtgtaaagtttttaaaattccaataaatcatgctaaatcttttaacataataataggcaagcgattttttaacatgaacttcaagtcctttccatttagactaattttaaatcatatacgtcttaaatccaccagtgcagcaagaaagagccattatgacgctcttggattatcacccaaatctactcaaaatgaaataaaaggcgcatatatataaattgtctatggtttaccatccagacaagaataatgatgaagcttcattacaatagtttaggactattactgaatcatatgaagtacttgagaatgtatatactaaaaaaatgtatgatttatctctctattataaaaacgtcgtattcactgataaagataatgactcatcttgtcactgcacctaatttgaatgtccacggcatcttgtccgtgttaacgtaacataatcattagactttttattgaaagctgaaatgcagctttggatgactaacgaactgcnnnnnnnnnnnnnnnnnnnnnnnnnnnnnnnnnnnnncaaaacnnnnnnnnnnnnnnnnnnnncaaaagaccctatannnnnnnnnnnnnnnnnnnnnngcttttttaacnnnnnnnnnnnnnnnnnnnnnnnnnnnnnnnnnnggggg

SEQ ID NO: 19326 - DNA, 717 bp, Diabrotica virgifera
  misc_feature (100)..(118): n is a, c, g, or t
  misc_feature (235)..(265): n is a, c, g, or t
acgcgattaatgaagcttgacttaatgcctctctttataacgttataatattcttaaatttgtaggcaggagaattggtactcttttagaagtctgttcnnnnnnnnnnnnnnnnnnnaagaaaacaccattcccgatcaagatccccacacaagggaaagaaagataaaaagaaacataagaagagaagcagcagctcgtccagttgtagctctgcctcaggcgaagacgaagnnnnnnnnnnnnnnnnnnnnnnnnnnnnnnnatgcgctgaaagacagtcgagtagatcacattcgagaggaagacattctagatctcgatcaaggtctaaacatcatcataagatgcaccaccattcgaagtctccagctacccatcatcattttcattattctccttgttggttggcggaaaattcttctgaaggaccctgtcacaaaagccatgatggtaaaaggaaaaagcattcccgtagactgcgctgcatgaaattttactacaaacagggaccagctacatctgatgaaaatgacgaacaagaaaaagactgtgaactaacgaaaaattttgaaaacttggaggttgaagataataatccctcagctcctcttgtgacaatatcaacagaataatgatatcgacttgcgatatgtccagcaaaatttgattcatggtcttcaatatatacagaaactttttttatgtttaactaac

SEQ ID NO: 19327 - DNA, 536 bp, Diabrotica virgifera
caggattcgaaaaaaattaatccccatttgaatagtattgcagccgaaaatacgtaccaatcgctcttaacagttcaattgttgctaagctgtttattgaatttccatcggcttctggaattatgatctatacaaaatgagcttttatattactttaagtatgtttaattattgataaacaattacttatctgaaatttcgggtgaaaattacagattttgctggaacaacccgccttttccgcttaaaatgctcgacagagatccatcgaaaaagaatcgtctcgatgattaatttgattactctatgattattccagtgcagctgcagaacgtatccacgttcccgggtacagatacgatccaggtcacagagatatctactcgtactcccctttctttattgacccacacaagtatgattctctagatatatatcgctatgtatatcacttcatccaaaccataaaattgtctacgatgtagagaaatgctgaaaccacaattgatcgtggaatagttgttaattagtcatga

SEQ ID NO: 19328 - DNA, 201 bp, Diabrotica virgifera
aaccttagggataacagcggtattttattggaaagttcaaatcgattaaaaagattgcgacctcgatgttgctttaaagtttatatttggggagcagctatttattaaccctgtccactttaacctcttcctggttcctggttaaacccgcggggacccggctgcgcccactcttacttttataaaaaatcttaactccca

SEQ ID NO: 19329 - DNA, 75 bp, Diabrotica virgifera
taacagcgtaattttattggagagtcaaatcgataataaagattgcgacctcgatgttggataaagtttataatt

SEQ ID NO: 19330 - DNA, 727 bp, Diabrotica virgifera
  misc_feature (2)..(46): n is a, c, g, or t
  misc_feature (53)..(726): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 19331 - DNA, 181 bp, Diabrotica virgifera
  misc_feature (2)..(131): n is a, c, g, or t
  misc_feature (134)..(177): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnngggg

SEQ ID NO: 19332 - DNA, 464 bp, Diabrotica virgifera
  misc_feature (184)..(201): n is a, c, g, or t
gcaaatgcatattatcagaagaaacagttctacccatctgttgtgtacattacaaaatccaatcccagtatggctgtaatatatctacaggcttttatatgtgtttggataagtggaaaaatcatgagaaggatattctttggacagttgagaaccacagaatttgagcatctgatggaaagannnnnnnnnnnnnnnnnngaaacatgcctggctttcactgtatttagagatgacttcaatccaaaatttgtagctctttttacactattactctttttgaaatcttttcattggttagcagaggatcgagttgattatatggagaggagaccagtaataagatggcttttccatattccaggcctctccctacttctccttctaggatacttagacttacatttcatccaacacatattatctttcaaacgtatctatagttgtatctgtacatctataat

SEQ ID NO: 19333 - DNA, 957 bp, Diabrotica virgifera
cggacgcgtgggctaatagactcagatgggcagggcatgtgatacgcagtaacgacaatcgccttataaacaatgtgttctgggaaaggccagatggaagaagttctgtagggcggcctagaaaaaggtggaaagatgcagtcaaagaagatctagagaaaatgggagtgcgacaatgggaattagtggcacaggaccgacaaacatggaaggcaatagtaaacgcggcaaaaactcacgaagagttgtagtatcgccattgatgatgatgaatttatatttgggtcctctcaatagatatccgaagtgtttcaggtgtttcttcttgatgttttctataatctcctaggtctttctaagaggttttagatagtgaagttttaaatcatttccacccaagaatcttttaaaattctccatagcaccacatttccaaagcctcgaagcgttttagaccacttttattctcgactcgacaccataaagcaagactgagaacacagcagcgaagtaggctgatccgcaatgacaagtactttagttctttgtaacataataccttttcacatccctctgagagctgatctggtctgcttagttctggatctagtttcaccgtgactctctgcgttagaatttaactgatatctatttaggataaacaaattgatcaaattgctcaagttttattattctgttcatctgtgcgcagtgtacctatgaagtttcttatgactatattgtatatacaatttttcctttcaatcaatgagatttccacatcttttcgaaaaaattaattgtttagaatgggccttgtcaaaaacaatttttacgaaaatccactttttttttcctttcaggcaccctgttccgagtattcgaacggttgggcggattattattggccccctaatgacctcttgtgtttaccggggcccctaaaaaaaaaaatta

SEQ ID NO: 19334 - DNA, 878 bp, Diabrotica virgifera
cggacgcgtgggctcgcgagagcgaatgtagtttatttttagtgtttgttgtttgtttgatagaaaatacttttattaagggaaggggaagggaagcaaaactattcagatgtttcaaacttaattgtaataaaacaatatgcatataaaagtatatattcaggttagcaaaataaatattagttaacatgatatatacaaaatactgctaaaataatttttatacgtaagttaattataccagtttatattggtgtttatttttatttatacagggagttgaactttttacgattttcatagaaaattggttataactttgtaaataccctgtataacataataaacctttatatttttgtgatatggaagttaagaagatttcgaacataaaataaaatatagggtgttccatttaaaaaacataagtttggtccgccagtatattatcgaacgccctgtaacattctaactaattttagtaattttgtaatatgaagctcaaagtttgctaaaatttttgatactaacttttattgctatctattactatagcggatctactgagctttatcagactattcaatcgccccgtatattttatcttattacttctgctaccgttaatcacgaatttttgtctcttatctttctcatactgttttagaatgttgttaaactcattaaaagaactaaataattgtccccactcgatatagttaattaaaaaaaaagcgctaaacaagtaaaaaataaggaaactctttacaaaacaattaaggaattccaatccacggtgacctctgggttggcaccacaaaataaaagaagaaggttatggattgttgccttattttttccatgactttttctatggg

SEQ ID NO: 19335 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (159)..(159): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttgnttnnnnnnnnnnnnnnnnnnnnnnnnnnnnnnnngaaagg

SEQ ID NO: 19336 - DNA, 710 bp, Diabrotica virgifera
  misc_feature (13)..(36): n is a, c, g, or t
  misc_feature (39)..(58): n is a, c, g, or t
  misc_feature (60)..(82): n is a, c, g, or t
  misc_feature (85)..(129): n is a, c, g, or t
  misc_feature (136)..(685): n is a, c, g, or t
  misc_feature (687)..(709): n is a, c, g, or t
tttttctcttatnnnnnnnnnnnnnnnnnnnnnnnnccnnnnnnnnnnnnnnnnnnnncnnnnnnnnnnnnnnnnnnnnnnnccnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnna

SEQ ID NO: 19337 - DNA, 860 bp, Diabrotica virgifera
aagacctgacatatttgcctgtcactgaatccaccatttacgaagtcctgaggatttccagtattgttcctatgggtaccacgcatgctccagtcagagacaccaaacttaacggtttccatctaccaccacatgcacaaatcgtacctcttctccacgccgtccatatggatccttcactatgggaagagccagaaaaattcaacccttccagattcataaactccgaaggcaaggtccacaagccagaattcttccttcccttcggtgttggtagaaggatgtgcctgggcgaaatcctggcgagaatggaactcttcctgttcttttcctcgcttctacacagcttcgatatttccgtaccagaaggagaaacgttaccaagtctgaaaggtattgcgggcgtaaccatcagccccaatgccttcaaagttacgctcacaccaaggccgatggcttgggacagcgaagaacctaacattaggcccgctggtagccattaggcaactgaagcagctgctaaatgacaaaagtacaaaatcgtgtttgggttttaccaagcatctacgagatgtccaagtcgttctcagagcacggtgttaaattgtttcctagataattccgaagagacggagtgttataagtacaagattttccttgttttgtgttttgagcagagcgattgggcgcggtacttactaaagataccacgacaaacaacgtttagctcagttttaactaattcgtttaaagtattgatacttaaacctcaaaaaaatctccatgaaaaactacaaattttttagtacgaaaaatatttgttgaagccacttttttttaactttatttttgccttttct

SEQ ID NO: 19338 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19339 - DNA, 907 bp, Diabrotica virgifera
  misc_feature (16)..(35): n is a, c, g, or t
  misc_feature (37)..(60): n is a, c, g, or t
  misc_feature (65)..(80): n is a, c, g, or t
  misc_feature (82)..(124): n is a, c, g, or t
  misc_feature (132)..(803): n is a, c, g, or t
  misc_feature (809)..(896): n is a, c, g, or t
attttcctccctttcnnnnnnnnnnnnnnnnnnnncnnnnnnnnnnnnnnnnnnnnnnnncaacnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagttnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaatttat

SEQ ID NO: 19340 - DNA, 898 bp, Diabrotica virgifera
  misc_feature (293)..(310): n is a, c, g, or t
gttgtagattatgtagattagatattctacataatctacaacccgtttgactgcaagtggattgtagattatgtagaatatctaatgaattttcttaaggtagacgtggacattcctaaaaatttggcgaaatgtccacatatagatagtctcgacaagaaattattgtcagaaataagaactagaaaacgcaaaaaacctgttgtgttctcttcgaatcccattaaagattgcattgcaccaaatttctacacgacaaacggaatgagagctttactggaaagaaattttannnnnnnnnnnnnnnnnnttggaaagatttttggtaattatttggatgaacctgacatctcattacagaaattcaagtgtgaaataaataatgatgattcggaaagtaccattttgtttaaagaaacgatagaaatggatagaaaactcttttttagtagatttgtaacattatttgattggccaggtattatctcattagagtctcctcataaggatttagtaagcatttgcaaaccattgactgtagattattcccgaaaaagtacacctaccaacgttacaaagacttacagcagaaaaagaggtagtcaagcaacaacggacacaagtcaggagcagcaatctaacaaagtaataattgtagaggaagatggttctgaatcgcgtcattctaaaaagtcattttcaaataaaacatatgggacggctcaaaagatattaaccaagaaaatggatttgaacattttcacatcagtacaaatggatgaaagtaaaccttgttccagcacaatggctggcataattaaagattggtactcggatgatagtgatcatgaatcttacagtgccaaagaatcaacatcggcggaagacctgtgtgatg

SEQ ID NO: 19341 - DNA, 931 bp, Diabrotica virgifera
  misc_feature (451)..(472): n is a, c, g, or t
  misc_feature (474)..(495): n is a, c, g, or t
  misc_feature (840)..(840): n is a, c, g, or t
  misc_feature (842)..(842): n is a, c, g, or t
  misc_feature (850)..(850): n is a, c, g, or t
  misc_feature (866)..(866): n is a, c, g, or t
  misc_feature (885)..(885): n is a, c, g, or t
  misc_feature (894)..(894): n is a, c, g, or t
agcgtatttacaaagttataagcaattttctacgaaaatagtaacaagttcaacttcctcgtataaataaaaccaataaacacaacagcaatggtttctcggtgccatatttttttaagtttcaaaaggtttcaaaatttttaagaacggttgctaattttcattgtatcaaatacagggcgagtcaaacgcaagtacatcattttctcagtaattttaaatggaccaccctatattttatgtcaatatcgaaaagtaccattaccgtactttatataatattccctatgtctaaatttattagtgttcgagatattttcatttttcagagcaaattattaattaggagtctaaatttttccaaatcgtaagtaagccatggctgaattgtctaaaactaacaatttacgattactaattttcaattcggtaatcaatctaataatgtagnnnnnnnnnnnnnnnnnnnnnngnnnnnnnnnnnnnnnnnnnnnncacaaaatacaaaatttttgaaacaattaaatctaacaataaaaaaaaatgctaaaagctacttttaaatgaggcccttagaacacaagataagtgaccccttaaattttagaaaattgggttttaaatacaaaaatggactcccaaacacattgaaaacatggtggctttaaactttctacataaactaacaataaaatgaccaaaaatgacatgtcattgaaaacatgctaagtacttaaaaaaacataattttggtctgccactatgttatcgaacaccctgtaatattttgactaattttgtaatgtgaagctcaaagttagctacaatttttttgtattntnccttttgnctctctattactatgncggatctattgagttttgncacactagntaatcatcctgtatatatcgttttacaaaataccctg

SEQ ID NO: 19342 - DNA, 180 bp, Diabrotica virgifera
  misc_feature (2)..(63): n is a, c, g, or t
  misc_feature (88)..(155): n is a, c, g, or t
cnnnnnnnnnnnnnnnnnnnnnnnnnnnnnnnnnnnnnnnnnnnnnnnnnnnnnnnnnnnnnngatgcccgcggtatttttgaccgcnnnnnnnnnnnnnnnnnnnnnnnnnnnnnnnnnnnnnnnnnnnnnnnnnnnnnnnnnnnnnnnnnnnngtcttttattaacttataacgattt

SEQ ID NO: 19343 - DNA, 906 bp, Diabrotica virgifera
  misc_feature (131)..(148): n is a, c, g, or t
caaaagtgtaaaagtcatatggaatatctaattaacaaaaacaatgcataaaattccattagaagttaacaaatacttaaagtatatattcgaacagaaaatatataatcgcaaattttgttcttacttcnnnnnnnnnnnnnnnnnngaaaatggagcctcctctagagccccttgaatcagactgttgcaactctggatgtaatccatgcattttagatatttacgaagagcaactcaagaaatacaaccaaagaaaaacccaagaaaaaaatcaaatactgcataggaactgtatactacctacagcttatacagtatttgtagtaaccaacatagaaccacattgtaaagacgcagtttttataactttcaagtatagtcgattgattaaacaaattgaccatgaaaatgatacgaaacctttaaaggtaatttttaacccaggacaatacttaatgttaaaaacagggccaacaaaccaagaattccaaagaccatatacccctctacctatagaaaatgctgaaaatttgaagtttacagtgttaataaaattatacgaaattggacaaatgtcttcgcatataagaaaattaaaacttggttcaaatacgatatggcgaggaccatatggcaatttttctataaattattcatacaaaaacatcctttttatcgctcaaggtgtgggcattacatccctttatggtgtcatctgtgatataatcaaaaacgaagattgtgactcatttttaaaactttattttttgtgtaaaagttgtgatactatttatttaagaaataagttatatagtttactgaatcactggaatttcagctacgaaatatttttaagcaatccagaaaaatgtggatgagaagtacaacgagactgttcacaaa

SEQ ID NO: 19344 - DNA, 105 bp, Diabrotica virgifera
  misc_feature (18)..(30): n is a, c, g, or t
  misc_feature (33)..(51): n is a, c, g, or t
ctttattggggtcgatcnnnnnnnnnnnnnacnnnnnnnnnnnnnnnnnnntaatttacaaattttttgctccccctttttttgacaaatacgaaaaaattcccc

SEQ ID NO: 19345 - DNA, 234 bp, Diabrotica virgifera
  misc_feature (7)..(30): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (154)..(154): n is a, c, g, or t
  misc_feature (166)..(190): n is a, c, g, or t
  misc_feature (200)..(223): n is a, c, g, or t
taacagnnnnnnnnnnnnnnnnnnnnnnnntcgataaataagattgcgacctcgatgttggatnnnnnnnnnnnnnnggnnnnnnnnnnnnnnnnnnnnnnntggtcgannnnnnnnnnnnnnnnnnnnnngagttaaccggtgtgagccaggntgggttctatcnnnnnnnnnnnnnnnnnnnnnnnnngaagggacannnnnnnnnnnnnnnnnnnnnnnnggataattatt

SEQ ID NO: 19346 - DNA, 812 bp, Diabrotica virgifera
aaatgatcgtttgttttctttataaatagaaacaaatgtttccgaattcgtatttagatcatctcataaatccatccttttggtcccgttcttcttgcggcgtagaaagattagtaaaacatgtggagtttatcgaaaaacatagcaaaatagttctagaaaatactcctcatgaactgaacgttccctatggaaccgagtcacgggaaattttaaacataattggaactgatttacccgagggttctcccatttttattcatgttcatggtggtattggcaggaacaattagtaaggagcgacaatggcatttttatcgcaaaaaatttatactctaatggcataaaatctatttttgtaggctatgaactctgcccaaaagtgacactggagaaattaggtctaaacatcgaaattgctttgaaaaaatgtttagaatacgcaaaaaagcatggaactagtggcatttaccttgctggccattcggcaggagctcaaataatcagcatgctgttcaaatcttttattccaagtctttcaaaggaagaccaatctttattcaaggcagcgtttcttataacaggagtatacgacgtaaccgcagtattacacacaaacctcaacgacttacttcacttggatcaacacaccgctgccaatgctagtcccttatatccaggacttaagaaacattatttgccacatgaaactaatgacggcaaagattgatacctcccaggttaatcctcacaggagaagcactttattaattacccttaaaggcaaaggttagtcaaaagattataatttt

SEQ ID NO: 19347 - DNA, 686 bp, Diabrotica virgifera
  misc_feature (2)..(83): n is a, c, g, or t
  misc_feature (86)..(100): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnnngtacataagagcctagatcgtttaagaacattattaccacgctttattaatattatagttatatacttaatctagtgacgaaacacaagatatacgggaaataactgattctattgtaatattacgagtctatttaatgttgttgtgttatatggatctatataacttattgtatataagcgtggtacaggaaaagtcaataacattgatgacgaacctgcataaaattattatgttatgactaataaattttctgagttctagaaggatgaggatatatatcaaattttgtatagatctaacagatgacccgactcttgcacctttaccatgtcaacatgttgctctctgttgctctgtacaacctgatttcctcatggtgataatatctccccgtctatcctcatcaggctatacctagtgatgaaaaactgcattgaaccccccctcctaaaaacatgcctgaaaatccagatactattaatccattaatgcttgtgtctcggatgctaccccaagcacaatttgacgaaactgggaaaactgaaaaccccccaagtgatctttttttccatcctaactgtat

SEQ ID NO: 19348 - DNA, 330 bp, Diabrotica virgifera
  misc_feature (7)..(38): n is a, c, g, or t
  misc_feature (40)..(67): n is a, c, g, or t
  misc_feature (69)..(91): n is a, c, g, or t
  misc_feature (111)..(134): n is a, c, g, or t
ctaatannnnnnnnnnnnnnnnnnnnnnnnnnnnnnnngnnnnnnnnnnnnnnnnnnnnnnnnnnnngnnnnnnnnnnnnnnnnnnnnnnnaggagatgaggttataaaannnnnnnnnnnnnnnnnnnnnnnntgaaacaactattacaattttacaatttcatatagtaatatatgttattatgtacagctagatatcattatgtttaatagatcgccacgccaatcctaaccgtacgattcgcaaattgttgaaagttaggatggacttaatgccttgtgaatgaatgcttggaattccctatcctatttgtccaggactggctttg

SEQ ID NO: 19349 - DNA, 158 bp, Diabrotica virgifera
gaatattcagtatcagcttcactgagatcaacagttaaggagtggcctcgtcttggaatagcaactagttaacgcctcataaaatgaccacatgttatgtgtttaagcaatatactgacattacacaatctaaataaactcttcagtaagtcactatg

SEQ ID NO: 19350 - DNA, 77 bp, Diabrotica virgifera
  misc_feature (9)..(67): n is a, c, g, or t
ggggggggnnnnnnnnnnnnnnnnnnnnnnnnnnnnnnnnnnnnnnnnnnnnnnnnnnnnnnnnnnncccatttttt

SEQ ID NO: 19351 - DNA, 919 bp, Diabrotica virgifera
  misc_feature (702)..(717): n is a, c, g, or t
ataatttcaattggtattttttaaagcatagatatattaaatatcgagtaaatgtatactgtaaatttgtgttgaaataatagtacataaattcattcgtgtgcttgtagtcgaatagagaataaaaacgtcgggaataatgtcttttatgactgtagctcattacctgcaaattctagacagaagttggagaaatcaagacggaagcaaagttgcacagtttatttctttgagacatgaccatgccaaatttccaaattaccaggtagagcagcctgaaggtattgtagatagattcttgacgtctcctttagatgaacttatatgccaccatttgagatgtcttttttatattggaaaacaaaactacttggaagcctataaatctcaaagtaccctagtacaaacttttgccaaaatattaaagtcacaagtagatgaaaactggtctctgccaatattgtatgtaatatcatcagatctaaggttaatagctcagcaagcagaaaaacaaagagttagtaacactgaaaatcctggagaaatattagaaaaagctgctgaatgcttgattggatgttttcgagtactagctgcagataacagatcatctgatgaagatactaagagaattggaatgctagggttggttaatcagctgtttaaagtttattttaggatcaacaaattacatttgtgtannnnnnnnnnnnnnnncattgaggcatcacaatataaagatgtgtttcccttaggacagcaagttacgtataagtacttttttggccgaaatcgatgtacgatagcaactacaaagccgcagacaaacacctaacctacgcattcgaaattgccacaagtctagcagaaaaacaagagactaatcctcatataccctagtccagtcaaaatgctactt

SEQ ID NO: 19352 - DNA, 184 bp, Diabrotica virgifera
  misc_feature (5)..(27): n is a, c, g, or t
  misc_feature (35)..(73): n is a, c, g, or t
  misc_feature (93)..(112): n is a, c, g, or t
  misc_feature (136)..(153): n is a, c, g, or t
  misc_feature (169)..(182): n is a, c, g, or t
ggggnnnnnnnnnnnnnnnnnnnnnnnccttttcnnnnnnnnnnnnnnnnnnnnnnnnnnnnnnnnnnnnnnnggtcccaatcttttttcggnnnnnnnnnnnnnnnnnnnnccccttaagggaaaaacccggccnnnnnnnnnnnnnnnnnnaagctccaaacccccnnnnnnnnnnnnnntg

SEQ ID NO: 19353 - DNA, 51 bp, Diabrotica virgifera
cccctttcggcggccgcggacgagtggggacgaaatgaacggatttttaga

SEQ ID NO: 19354 - DNA, 53 bp, Diabrotica virgifera
  misc_feature (22)..(51): n is a, c, g, or t
cgagaaagaccctattagaggnnnnnnnnnnnnnnnnnnnnnnnnnnnnnncg

SEQ ID NO: 19355 - DNA, 422 bp, Diabrotica virgifera
  misc_feature (6)..(24): n is a, c, g, or t
  misc_feature (97)..(125): n is a, c, g, or t
cgcccnnnnnnnnnnnnnnnnnnntaatgaagcctttttacccgaaggcaatacgaaaagttatattgagtgatacaaaatgaatatacgcgagacnnnnnnnnnnnnnnnnnnnnnnnnnnnnnaccttttgcacctagagtaccacgcaatattgattatatcagttacatatttactatgctgcgaagataagatagacacagaatgaatgtttctattgtaatataaacactcaatttaactttctagtgatgagacgatataccgacctatgcatatatatgaatcgtcttaagaaagaaagttacagattaccgatgaagaacctgcatataattatcaagtcctgcatgatagatatgatgtattgctagggatgaggataaatatgaaccatgttaaaagctaacgacgaccaa

SEQ ID NO: 19356 - DNA, 852 bp, Diabrotica virgifera
  misc_feature (342)..(370): n is a, c, g, or t
  misc_feature (420)..(439): n is a, c, g, or t
caaaacgggacacttataagttggataaaatgggatacagtatacagtttcttatgtcccgttttatctacctatttatttgttggcctattaatttttaaatagagatatgaagcgttttctcataccgcagagaagaacaacatatttgtatgtgacttttgttctgatatacgtacctatagtcctagataaaaggtcttatttcccattttgccgtaaaacataaataacatctatttttaagtttctggctactgaagatattattctttcaagagtaaattttactatacagtttaatgtctacttaatttagacataaattaagttttagataannnnnnnnnnnnnnnnnnnnnnnnnnnnncctatcccgttttatccaacagtggttcgataaaacgggatgtgcaggannnnnnnnnnnnnnnnnnnnttttccagttattaaaaatagctaaagatatgtgttttgcgtgctgcaataaatgttttacctataaaaaataatattatgataacttctttaacatattttccgtagtaaaagtaaacaagaatggtatcccgttttgtccaactctcccctaggcctcacctaattgctctcagttctgtcggccttaaacttcctgcggccaattcacatcgattcttttaacatcatctgtccatcgtgcaagtggtctacctctgctttttctgtctgtctttctttctctctttttttctctaactatgcaatctcttataatataatactcccctacatcacagatcaaagtggcgaaaaaatttaatcacttttcaccagccctctgctggagaaacgaagcacatacgtcacgc

SEQ ID NO: 19357 - DNA, 173 bp, Diabrotica virgifera
  misc_feature (20)..(53): n is a, c, g, or t
  misc_feature (55)..(92): n is a, c, g, or t
  misc_feature (99)..(137): n is a, c, g, or t
  misc_feature (145)..(163): n is a, c, g, or t
cgagaaagaccctaatagannnnnnnnnnnnnnnnnnnnnnnnnnnnnnnnnngnnnnnnnnnnnnnnnnnnnnnnnnnnnnnnnnnnnnnntgggggnnnnnnnnnnnnnnnnnnnnnnnnnnnnnnnnnnnnnnncacattannnnnnnnnnnnnnnnnnncccaaatttt

SEQ ID NO: 19358 - DNA, 720 bp, Diabrotica virgifera
  misc_feature (194)..(208): n is a, c, g, or t
acagcggcaagctccgaacatgctcatgcacatgggcccttgccttttgatctaacctggaccaaacctcggtgacgccatggacgcgatcaaaagcaacatgcaagcgatgaaacctgaaaaacatgaagtggctgatccacaccatgatccgttcggccactataagacaacatagcatgtgctgaaaacgnnnnnnnnnnnnnnnaccaccttcaacataaactctctcaaatggaatgtgaccgccccaccgacaagaatgtgttaaaaaatgccaagcagcaactggaaaagaaagaaaaactagtagctcacgctgaagctgcattatctctcctacccgtactgaacgactatatctgaagaagaacttgttaccagaacccgaggaaacacatatgggaagcatgtctaccacgaacattggatagaagcttcccaagcttgccgatagaaagctcccagtaatgatgcaaagccatcgccaaccgcgatccgaattcagatgaaaaacgtatggaccatctcgccaaccagttgattagaagcccggctcttcgttgaagacgctgacgacgaatctgatgaaacatcccgtaaacttgccttcgacgcagaccaccttgaagaagctgatgaccgtgtccagagagtaaaagtcaagactgtgtgactcgacaatgaacagtcagtcatattatctctctcaaatctctc

SEQ ID NO: 19359 - DNA, 835 bp, Diabrotica virgifera
caggattcgaaaaaaattaatccccatttgaatagcattgcagccgaaaatacgtaccaatcctcttaacagttcaattgttgctaagctgtttattgaatttccatcggcttctggaattatgatctatacaaaatgagcttttatattactttaagttgtttaattattgataaacaattacttatctgaaatttcggttgaaaattagagattttgttggaacaacccgccttttccggggaaaatgttcgtcaaagtagatcgggaagacgcgtctctatgcataatttgattacggtgaatttttttgggtgtttttggtgtaaagttggaatctttggagttatagagcaaaaattgagagaaacacgattttcgggcgccattttctttatagaaaaagtagcgcactatctgcgtactttgcatacctatattattagtatatacaatcataagattggcttccagcagtaaaattgctggtaggtaacttttccttgtattttgctaattagcccagagtataagtggttcagggggacgttcaggaaggactgcattgcagcactgtattgttttacagaagtttaaagcaacctggaaatggtttattaatactctgtaagactttaacaactaaggatgatgcaagatagcctaaaatgttttatttagctatagggcagtcttgaaactttctcttcatagaggaaatccttggaaagttttggggacgatccagaactgtcctgaagtgcctttgttacatctagttagctcgagtgtaaccctaatgtttcaaaatctttgcagcctgaaatgtctcatc

SEQ ID NO: 19360 - DNA, 886 bp, Diabrotica virgifera
  misc_feature (223)..(242): n is a, c, g, or t
  misc_feature (497)..(516): n is a, c, g, or t
aattgggaacggatcatcgtacattaaacttcctgaacaaattcaaaagcgtcaagcatgtataaatatcaaaaattacgatcaaaattgcttttattgggcgattattagctctctttatccagctaaaatacacaaagaacttacatcatcatatccatattacagcactgttttgaaaacggaggacatggaagctccaatgcctttaagtcatatcacnnnnnnnnnnnnnnnnnnnngtatatcagtgaatgtttatgctttggaattaaatcaagttaaggaaaaacaattttacgatgtagtacctgctagacttacacaaaacaagcttgataggcatgtaaatttgcttctaattcaggataaatattttccaaatttaaatgattacgacgctcctcctagtgacgatgaaaatattgaaataaaatatcattactgctggattaaagatatgtctaggttggtaagttctcaggtaagtaagaacnnnnnnnnnnnnnnnnnnnntgatcgctgtatgaattatttctacagcgggaataaacttgctgagcatgaagagttctgcagagacataaacaaatgtaaaatgactgttcccaaatacgattatgttgcttttagaaatttcacatacaaacaaaccactccctttatcatatatgctgattttgaatgtcagttacataattttacagattctaatgtaaatctgagcaaaacaacaaaataccaaaagcatgtaccttatagtgcaggctattacttaaaatgtgcttacgatgacagcttatcatattttcgaagctacagaggtgaaaattgcttggagtggccggaaaaaaaatggctgaaaatatccaaatttgtcaattct

SEQ ID NO: 19361 - DNA, 326 bp, Diabrotica virgifera
cctttgaatctccattctttttgtctactacaggagactcaccattatcttgtttccttgctttttttgtattttttggggactcttctttcttccgtttttttgagagctttataggatccagagataaaggatcccgatttttggtgactgcatagattaaagctaggactgaagactagagaagagaatagcttgtgaagaaaagagcggggagcgtgatcaaactactcagagtgttataaagaagagggtaagaaagaaaggataagaaattatccatacaatcataaaatgatactagtacaatttaacgatgtatgaga

SEQ ID NO: 19362 - DNA, 533 bp, Diabrotica virgifera
  misc_feature (95)..(113): n is a, c, g, or t
  misc_feature (257)..(279): n is a, c, g, or t
ggctcaaagggacccaagtttacgaacgggggatggggaggtcaaagttttttaaaagggcccccaaaattaaattccggggccggggtttaacnnnnnnnnnnnnnnnnnnncccgggggttccccaattaaaccgcttgggagaactcccccttttccccagggggggaaaaaggaaagaggcccgccccgatggcccttcccaaaggtggggaacccggaaggggaaaggggacgggcccggaaggggggaatnnnnnnnnnnnnnnnnnnnnnnnacgggaagggggaccgttacattggccggggcccaagggcccgctcttttcgtttttttcctttctttttccgccaggttcgcgggttttcccgggaaggtttaaaatggggggtccccttaagggtcccaattaagggttttagggccccccgcccccaaaaaatttgattagggggggggttcaggaaggggcccttcccccggaaaaaggttttttgccccttggaggtgggagccccggttttaaaaagg

SEQ ID NO: 19363 - DNA, 1012 bp, Diabrotica virgifera
  misc_feature (86)..(117): n is a, c, g, or t
  misc_feature (137)..(160): n is a, c, g, or t
  misc_feature (316)..(335): n is a, c, g, or t
  misc_feature (480)..(503): n is a, c, g, or t
  misc_feature (659)..(678): n is a, c, g, or t
  misc_feature (788)..(809): n is a, c, g, or t
  misc_feature (825)..(848): n is a, c, g, or t
atggtgtcaaagttttcttctaatcgtctctattttctgctcgtgttctttcaattcgacgaagttcctggagcacttgcatcgcnnnnnnnnnnnnnnnnnnnnnnnnnnnnnnnnataaaagcatcgttcctacnnnnnnnnnnnnnnnnnnnnnnnnaggtaggaaatacatttacgtatcatcaggactaggtgaccagcctggtatgtcggactcgtgagttacaataccgactaaaacccgtcccctttcttctgcctctgtttcccccgcggacctaccgtgaggtattactgcgcggggggagggtcnnnnnnnnnnnnnnnnnnnnctttcttcatggtgtcaaagttttcttctaatcgtctctattttctgctcgtgttctttcaattcgacgaagttcctggagcacttgcatcgcaaaggtgcttatggcatcccaagctgctgtcgataaaagcatcgttcctacnnnnnnnnnnnnnnnnnnnnnnnnaggtaggaaatacatttacgtatcatcaggactaggtgaccagcctggtatgtcggactcgtgagttacaataccgactaaaacccgtcccctttcttctgcctctgtttcccccgcggacctccccagaggtattactgcgcggggggagggtcnnnnnnnnnnnnnnnnnnnnctttcttcatgtggtcaaagttttcttctaatcgtctctatttttctgctcgtgttctttcaattcgacgaagttcctggagcacttgaatcgcaaaggggcttatggannnnnnnnnnnnnnnnnnnnnnagcatccgttccaacnnnnnnnnnnnnnnnnnnnnnnnngggcgaaaaaaatttccttatcccgggcttagggggcccacccgggttggcggatccgggagtaaaaaacccggaaaaaacccgtccctttttttttggcctttgtttcccccgggggcaacaccggggggctattaaaggggcgaggggggggggcacccaaa

SEQ ID NO: 19364 - DNA, 177 bp, Diabrotica virgifera
ggattaaaaagtttcctatgttaataaatgttataatttatatttatattatattacgatcatgtccaaaatattgattacctataacctaacttgacgaacgaggagaaaggaagaataaaaccatgtatcgtatagtcatagagattggtgtaacaatgaaatgagcaacatttt

SEQ ID NO: 19365 - DNA, 59 bp, Diabrotica virgifera
tcagtttaaactatttaaattcagcagtgctgacatcattacccttctagctattgcat

SEQ ID NO: 19366 - DNA, 701 bp, Diabrotica virgifera
  misc_feature (2)..(44): n is a, c, g, or t
  misc_feature (52)..(623): n is a, c, g, or t
  misc_feature (625)..(655): n is a, c, g, or t
  misc_feature (667)..(700): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnaagctgaatgannnnnnnnnnnnnnnnnnnnnnnnnnnnnnnnnna

SEQ ID NO: 19367 - DNA, 659 bp, Diabrotica virgifera
  misc_feature (485)..(511): n is a, c, g, or t
agttatttgaaataatcacatatttgttcaatttactgaggaatcttgttatttaaggatatgtcatgaaaaatgtgtaagaatattatatatctatatattacaaattaattctttcggctccgggtaatccttatgtattgaattagtatattatctatttattattatcactgacagagagatacaaaaaataaaaagtttaatgtacttaacatatgattttatcatagaattctctgtttagaaatggaattcgctttgaatgaatcaaaatctttactatgtatgacctctctagttatgatcaatagattcataagtaaccatatgtatattattaatatgatagattgttaaccatcaatgtaaatataacaccctattaaattataattcttgaaccttaattacagataagaaatgttcatacttatagaactgtaattactctcttatatatagtagtattcttattctttccnnnnnnnnnnnnnnnnnnnnnnnnnnngttatttaagctaaatctggatatcaatataaagatcatttcatagaatatctctacaaaataaactttaattagtctgagaactgaaatgaccttcttttcacctgttcactctatacatggctctttgaatgacatattacttctc

SEQ ID NO: 19368 - DNA, 450 bp, Diabrotica virgifera
ggcatcatttatttattggcggactaggtcctaagaattaacattaatctttttaagattattaaaggcttatcataatattatattggtgcctatacgtaaagaaaaaaaaccataaagggtgttaaaatacgaaataaggaagcatagtttcgaaaactcattttaccctggacctgtaaaaactttctaacaatttagaaacataacctttctacgacaaaaggtcgcttaaaccattggagattgctggcgaccgatgattgccaaagagtcgcaaaggacgacccctcatcaatgggaatggttagtgaccgaagataaactttacttcgaaactgccccacaaatgtttgagaagttgagtatgaccccctgtaggccaatcctcacgaatgcggtcaccatacttgacacagctttaagcaactcgcactgagctattgagcg

SEQ ID NO: 19369 - DNA, 478 bp, Diabrotica virgifera
ggtaaaaatacgtgtattattatttcacagttgtcgttgaaatcaaaatcaaaatacgaataattattctgaataatgatcgtgtcctgtaagaataaagtttttctactctgtcagcaagacgtgctagaacaaatgtcagtcatcactcacgccgcggtaagcgatttcttatatatccattagagacgattctcttgagacggtacctcagaccagcccgagaccatacaacagaaatcagaaaataatactgttatgtcggaggccagttatgcagtgaacatgggtaaggatcgcaatcgccgcatcgagcatataccaagaatcgagatacacgaccccccgcaatcgtgcgttaaagaccgcaaaaaatcagcggaatttttccacacccacgagattgccagatgactacgtctgcattggtaggacaccgtggcaattcctacaaaacagccggactactcttacccta

SEQ ID NO: 19370 - DNA, 127 bp, Diabrotica virgifera
  misc_feature (2)..(43): n is a, c, g, or t
  misc_feature (45)..(112): n is a, c, g, or t
gnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnncattggggggggagt

SEQ ID NO: 19371 - DNA, 407 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(322): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaacccaggttaacaaccgggggatggcaaggcataactttttctaaagggcccccaaaatcaattccctggcccgccttt

SEQ ID NO: 19372 - DNA, 941 bp, Diabrotica virgifera
  misc_feature (536)..(553): n is a, c, g, or t
  misc_feature (665)..(686): n is a, c, g, or t
  misc_feature (801)..(801): n is a, c, g, or t
cctctgttcaaaagttggagagagtgcaaagacggttctttatgcactgtgcctttaaattacacagaccttattcatattctgatatgatgagatacttagaacttgatcctctgtctactagacgagttaatttcgatctcatcttcatttttaaattgtttaacggaatgatatattcacctgaactgcttcaattggtttgtttccacattccttcccgtgtccttcgtgagaatacactatttcatattctttttcgtcgaactaattattctgtgaatataggtctggtcagacttcttgttcatgctaatcggttgcctcataaaacagatttttttaacttgtccttaagtgcctttaaacaatctctgaagcgttaaatttaattgtaattctatatacctacatatttattttatgatcttgtatttttcgcatagaccaactggtctatgcgaaacatactggcaatttaaatagctggtctatgaggacgaaacttgaatacccccttggcagcaaacatgttnnnnnnnnnnnnnnnnnnctcatttatgcgattagttatcattgtagtcaccaacaattttcaccaaatcacatagcatttataacccaataatgtcaatgtaatatttgaataaaacatgtttttgacnnnnnnnnnnnnnnnnnnnnnncaacgcagcaaaagacaagttctatacagtttttctgtgctgtaggtacaattgcagcagaggatttagacatttaccccttggtagggggcttccaatgaaaacacaaccatcncatgaaaaacaaagacataaaaaaacagcctatatgctttcagttgcaactgtaaaaccggaagactgaggtcaaactcactgttaataccaccttttgggtttgacaaaatgtcatttgtcattatatctgtttttaat

SEQ ID NO: 19373 - DNA, 512 bp, Diabrotica virgifera
  misc_feature (2)..(425): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtatcgatacatagctttaatagaggaatccggaaacattttttgcgcctgtccattaaagacatgtgttctatggattcagatc

SEQ ID NO: 19374 - DNA, 886 bp, Diabrotica virgifera
  misc_feature (11)..(28): n is a, c, g, or t
  misc_feature (30)..(47): n is a, c, g, or t
  misc_feature (59)..(84): n is a, c, g, or t
  misc_feature (86)..(103): n is a, c, g, or t
  misc_feature (133)..(229): n is a, c, g, or t
  misc_feature (257)..(344): n is a, c, g, or t
  misc_feature (346)..(422): n is a, c, g, or t
  misc_feature (424)..(488): n is a, c, g, or t
  misc_feature (544)..(558): n is a, c, g, or t
  misc_feature (561)..(622): n is a, c, g, or t
  misc_feature (624)..(678): n is a, c, g, or t
  misc_feature (861)..(881): n is a, c, g, or t
caatatttaannnnnnnnnnnnnnnnnncnnnnnnnnnnnnnnnnnncaattaccatgnnnnnnnnnnnnnnnnnnnnnnnnnncnnnnnnnnnnnnnnnnnncacctcgcgtatcagggatcattaattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattcgctcttaaatatctccaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnngttatttacatttacgaacgatgctactattagtattaacaacttgtatatttacnnnnnnnnnnnnnnnccnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnncgctaacgtagcataatcattagtcgctttattgaaagctgccatgaagggatgtatgaaaaagcaactgtctttatttactttatagagaactttatttttaagttaccaagcttacatcttcttacaagactacgagacactatagagtttgataaatcattaacaagttcttctcgtacnnnnnnnnnnnnnnnnnnnnncttat

SEQ ID NO: 19375 - DNA, 324 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattacaggttagcgaatacggtcaatatgctaaacgatactatctccaagaccatcaggatattccaagtattaaaatgcgcctcaaa

SEQ ID NO: 19376 - DNA, 935 bp, Diabrotica virgifera
ctaaaagatcacactacactctttaagatgttgctaccatcacttaggacacgttttatattatgtatccttttaataacattgcatgttctctttacttcggcagaaatagagccaaacgaagatgacaaaccgacgctgacagcgaccattgctccacctggcagcacagcaaactcagaaaatgtgggatttactcatgcatttgtggctagtcttagtgtcattctggtatcagaaattggagataagaccttcttcatcgcagctattatggcaatgaagcatccaaggttaacagtatttgctggtgccattagtgctttaattctaatgacagttttatctgctgtatttggttggctagtgacggttatccctagagcgtacacctactacatcagtacagctctctttgccatattcggtttgaagatgttgtgggagggataccacatgacaaaagacgaaggaagggaggaattcgaggaagtccaaatggagcttaggcagagagaagagcaacatgaagcgactttaccggatatagaaattggtagtagcaatagaagacccaccaaatcagtatggtatgaagtctctcgaatattattgcaatcctttaccttaacctttttagccgaatggggagatagatctcagttaactactatacttttaggtgctagagaaaatgtatatggtgttattattggtggtatcctaggccattgtgcctgcactggtttggctgtgttgggtggtaggatgattgcccaaaagatttccgtgcggacagttaccatcattggaggagtggtcttcttgatcttcgccttctctgctctcttcatcgatccaaccgcgacgtaaactcaaaacaaactagggtttagcttttttttatttgaatagaatgaatatatggtacccca

SEQ ID NO: 19377 - DNA, 1011 bp, Diabrotica virgifera
  misc_feature (467)..(645): n is a, c, g, or t
  misc_feature (655)..(678): n is a, c, g, or t
  misc_feature (680)..(700): n is a, c, g, or t
  misc_feature (707)..(740): n is a, c, g, or t
  misc_feature (773)..(810): n is a, c, g, or t
  misc_feature (814)..(866): n is a, c, g, or t
  misc_feature (868)..(880): n is a, c, g, or t
  misc_feature (882)..(917): n is a, c, g, or t
  misc_feature (921)..(962): n is a, c, g, or t
tattttttcaaaaaatttgagaaaaaacacaacattaaaaagtgttcttttttattttcttatccagcctttttattctgtgttgactcttttgtagttttttcgtactttgtgttttttaagtttgctgttgtggcattgaaagagaattacccgttatccacaactacccctgattcgtaaataaaagtttcattattaaaatatctatgtatctaaattgtcagtttcgaaattagagtatgaaggctacactaagattaataacgtaaacaagctatttctaatggatctgtatcgtacaggtataaagttgatattactcgtatcacaattatgtccgtgtacttatctgaccgtctactcgataatttatttattaccaccgactttctaaataaaatatatgattaaatttttctgtattctacaatatcttattattctatttttacatatgattatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtctcggnnnnnnnnnnnnnnnnnnnnnnnntnnnnnnnnnnnnnnnnnnnnncggtatnnnnnnnnnnnnnnnnnnnnnnnnnnnnnnnnnnctgaaggtttggatgcaaaaaaaactgtccttnnnnnnnnnnnnnnnnnnnnnnnnnnnnnnnnnnnnnncgtnnnnnnnnnnnnnnnnnnnnnnnnnnnnnnnnnnnnnnnnnnnnnnnnnnnnncnnnnnnnnnnnnngnnnnnnnnnnnnnnnnnnnnnnnnnnnnnnnnnnnncggnnnnnnnnnnnnnnnnnnnnnnnnnnnnnnnnnnnnnnnnnnccaaaattttttggcccattttttttgatcataaaaaataatttaacct

SEQ ID NO: 19378 - DNA, 111 bp, Diabrotica virgifera
  misc_feature (6)..(28): n is a, c, g, or t
  misc_feature (34)..(103): n is a, c, g, or t
  misc_feature (107)..(107): n is a, c, g, or t
aaagcnnnnnnnnnnnnnnnnnnnnnnngacccnnnnnnnnnnnnnnnnnnnnnnnnnnnnnnnnnnnnnnnnnnnnnnnnnnnnnnnnnnnnnnnnnnnnnnttgnggtg

SEQ ID NO: 19379 - DNA, 933 bp, Diabrotica virgifera
  misc_feature (823)..(838): n is a, c, g, or t
tactgctttaatcttctaatagcactattatcatctatttggtcgtagtctagtggtctctgcgtgtttaatctctaagtattcctcccttggtatttcttaatattttcgttctggctgttctcattatcctgtttgttgtgatgcatcttgttgtgatgatgtattatgtggcgcatgtgagaacagacccctctggtataccctgacgcttagtggccctccaattaggttccatttttgatactgctactcctatttaattccatctgaacatcgtgtgagtgagttctacagatattaacattgatttgatattttttattgggaaaattaaattgaatttatttcatgtgatttgacgaataaagtactagagtactgtggtactagaataaagctatcagcatatcacagtatttgaagctatgggtctcccatcacgcttctgatgttgaatgaagaacctttacactaatgtgacctttctcagataattttcgttttatatttactcttgttatatttttcgtcatatctgtcataattatttggtatttttagtttatgttatgcggctataaaatgttgattacattattttgtcacaccctatcaaacgctttagtaagatcaaaaaactgatccactattgattcgcacaatttttgttgttaaaacctgtacgcgtccactgctggacataggtctacctcagctctttccgtctttgtcttgtgcttttccttgtggcctccactcgacaatacgttttgtccatcgtttgtctgaaaatctgaaaaaatgtaggtaatacccaatnnnnnnnnnnnnnnnngatatttcaatagcgtctgttgtttttattctatgacgtatttcttcgttttaggattcggtctctcaaacatacacccagcatctaacgaaacg

SEQ ID NO: 19380 - DNA, 634 bp, Diabrotica virgifera
  misc_feature (2)..(408): n is a, c, g, or t
  misc_feature (410)..(484): n is a, c, g, or t
  misc_feature (486)..(534): n is a, c, g, or t
  misc_feature (541)..(553): n is a, c, g, or t
  misc_feature (555)..(611): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnntaagctnnnnnnnnnnnnngnnnnnnnnnnnnnnnnnnnnnnnnnnnnnnnnnnnnnnnnnnnnnnnnnnnnnnnnncatttatgtatataataaattta

SEQ ID NO: 19381 - DNA, 972 bp, Diabrotica virgifera
  misc_feature (62)..(76): n is a, c, g, or t
  misc_feature (464)..(464): n is a, c, g, or t
  misc_feature (541)..(541): n is a, c, g, or t
  misc_feature (582)..(582): n is a, c, g, or t
  misc_feature (853)..(853): n is a, c, g, or t
  misc_feature (862)..(863): n is a, c, g, or t
  misc_feature (917)..(917): n is a, c, g, or t
  misc_feature (925)..(925): n is a, c, g, or t
agccattaagcaatcttattgatgacagtagtaagtaaattgagcattgtgcccatttgctnnnnnnnnnnnnnnntcatttcttccagcttggctaagttgttattaggttggttaggtcctggtattgtttggttgttatagctacactgtggttgatttttgttgactatttgagcataggttaaatcaggttgtatttgttgagtattatttgtttggatatgcggttgcatgattcttttctctcttagtgtaggatatagcttctgctgtagttgaatgtgaacttggcatcctctatagttagccgggtggtcaccgttacaattgacacattttactttgtcatcacgtgatttccgaggacaatcttttgtttcgtgattgcctgtacattttacgcatctgtgtactttgcggcagtatgttttggtgtgtccgtagtcttggcatcttgtacnactgggggattgttcttttcgtacgaggaggttcgcatttgatgatattgtttcctaatttttctattttataaacnctctttgttgttttccttcgatacgatatcaatgaaaaacnattggcaagggggtttttgatacataatgttttatattgtgaatgttcactgcttcgtggccttgtgctgctagatttgtctttatgtcattagtatctgtaccatgatgcagtccttttatgacaaacctgaatgttttctcgctttttggcctaaaagtatggtattgagtattccttttatcaagttcagtgatcaattttttaaaatgttcggcctcaacgacttgaacttttactgtttcataactaatggttttaatagtgtatntatctcccnntgtggttgtttcagtagatcatggatgtgttggacaacacctacattatatatnggtatcgntgggggcttgggtacatgtttttgtattgttttctttgatcttttgc

SEQ ID NO: 19382 - DNA, 181 bp, Diabrotica virgifera
  misc_feature (2)..(160): n is a, c, g, or t
  misc_feature (165)..(165): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattnttttgatcaatttttt

SEQ ID NO: 19383 - DNA, 724 bp, Diabrotica virgifera
actgtgtgacggaccgcggattagatgaattaacaagatctgctggtaatcctaaaagcttacatggcaaactggacactctccccgagacacactgatcatcatgctatcaatgagcttgactaaagaagcatccagttgactacatgccaaacaaagtgtctctccctacattgttatatcgtatcgcccttcaaagaaaaaaaatgtcgcgaagcttctactcttacctacataacctgagaaaggacttgcacgaacttaacaaaactgctttagttgcaccaataattgaaactacaatcttcgaagaccgacataatcttggaggctcataccaaaaaattcacccgactcctgatgatgactatattactcactctggaactatcgaattctatgcaacaagatgttgagtcaggttctccagctcatgatgaacatgacctacctgatgacataccagacactactacatgaaacggttctaaaccagagacagagcttcaagatgtaccaggagatcctgatttctggatctcaccttgcaagaacgccaactcatatctgcttgtatcgcttccatgctcctgcaaggtacaccagctcagatgtttagaattatatcgagactcttggttgccaagatccaatgaaattcattgttgtatgtcacttcacaatagttgatgacttcactagctcctaggtcacaaaagatgat

SEQ ID NO: 19384 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (162)..(193): n is a, c, g, or t
  misc_feature (195)..(195): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtgtgagccaggttggttnnnnnnnnnnnnnnnnnnnnnnnnnnnnnnnngnaagga

SEQ ID NO: 19385 - DNA, 238 bp, Diabrotica virgifera
ctctggtttggtaacactttagaaaaagtcacgcgtcgccactggatttcaggcggatttgagccgtgaacattaggataattatggtcataaaagatccaaatgcatttcggtcacattggacgcttagagtgactgaatgcgactgatcttgcgcattgtttttattagtgtggggttggaagaacacgttccctggggaatctcgaaatgaaattgaaaccgctgcgagtaggta

SEQ ID NO: 19386 - DNA, 198 bp, Diabrotica virgifera
  misc_feature (7)..(44): n is a, c, g, or t
  misc_feature (109)..(131): n is a, c, g, or t
  misc_feature (161)..(192): n is a, c, g, or t
taacagnnnnnnnnnnnnnnnnnnnnnnnnnnnnnnnnnnnnnntgcgacctcgatgttggattaaagtttataattggtgtagcagctaattattaagtctgttcgannnnnnnnnnnnnnnnnnnnnnnagtttaaaccggtggagccagggttggttnnnnnnnnnnnnnnnnnnnnnnnnnnnnnnnngaaagg

SEQ ID NO: 19387 - DNA, 674 bp, Diabrotica virgifera
  misc_feature (117)..(180): n is a, c, g, or t
  misc_feature (376)..(390): n is a, c, g, or t
gctaggactgatacatatcaaaactattggaatgagccgtgaatatcgcgtgttgacacaagatgacgatgtgactcctccatcgtcggatggatgtgagataggatggaaaattannnnnnnnnnnnnnnnnnnnnnnnnnnnnnnnnnnnnnnnnnnnnnnnnnnnnnnnnnnnnnnngttctaatgatgctatattgcaagaatacagatcactaagagaagctcccatactgaacataggaagaggcgcataaaaatttgtattggcattcataggacgtagagaaattctaagagaaagaccatcgcatctcgcttacaacgtacgattggaaaaaggtatcaaaatcatttgtgcttcgaattcagcgannnnnnnnnnnnnnntatagaaatatcctcgaaatatgatttctcatatgaaatgatgaaactagtggaaactatggctaatacaaatacggagcataataaaaacaaagtaatggatttaaatcgagaaaaattagaatgatcgggcacatgaatacccatgattttggatgagtagtataccattacctcgtcggcattcaaagaacgataaagatgcagaagtagtgcaaaagagagttcttaggattgtctctcacacatccacatgaacgttattgaaagaactacttatgtca

SEQ ID NO: 19388 - DNA, 176 bp, Diabrotica virgifera
  misc_feature (2)..(15): n is a, c, g, or t
  misc_feature (24)..(44): n is a, c, g, or t
  misc_feature (110)..(128): n is a, c, g, or t
  misc_feature (139)..(163): n is a, c, g, or t
cnnnnnnnnnnnnnncagagctgnnnnnnnnnnnnnnnnnnnnngatattctcaacatggcatatttttttctcttgcttattctttttataatggattaattcgagagnnnnnnnnnnnnnnnnnnnattgattaccnnnnnnnnnnnnnnnnnnnnnnnnngaaatttttatat

SEQ ID NO: 19389 - DNA, 206 bp, Diabrotica virgifera
  misc_feature (21)..(43): n is a, c, g, or t
cattgctgtagtgcacacgtnnnnnnnnnnnnnnnnnnnnnnntgtctgcaaataattaattataagatgtctaaagccccagctgaagatcttgaattttaacaactacatactagaggtggggtaccgagcgaactggatccaataccttaagattttaatatttcctatttacaagttgtattgaaggaaagttatttgtcct

SEQ ID NO: 19390 - DNA, 733 bp, Diabrotica virgifera
  misc_feature (7)..(28): n is a, c, g, or t
  misc_feature (49)..(89): n is a, c, g, or t
  misc_feature (99)..(205): n is a, c, g, or t
  misc_feature (222)..(328): n is a, c, g, or t
  misc_feature (330)..(488): n is a, c, g, or t
  misc_feature (502)..(521): n is a, c, g, or t
  misc_feature (530)..(542): n is a, c, g, or t
  misc_feature (544)..(578): n is a, c, g, or t
  misc_feature (580)..(594): n is a, c, g, or t
  misc_feature (642)..(662): n is a, c, g, or t
  misc_feature (672)..(700): n is a, c, g, or t
gaaaagnnnnnnnnnnnnnnnnnnnnnngtaggtaattaggattggggnnnnnnnnnnnnnnnnnnnnnnnnnnnnnnnnnnnnnnnnnaccttggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggaatggtattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatggtggtaatnnnnnnnnnnnnnnnnnnnntatttaggnnnnnnnnnnnnngnnnnnnnnnnnnnnnnnnnnnnnnnnnnnnnnnnngnnnnnnnnnnnnnnnctttttggattaaatataaaggctcgcctggccactggttaatttggnnnnnnnnnnnnnnnnnnnnngggtaagggnnnnnnnnnnnnnnnnnnnnnnnnnnnnngtggaatggagggttggatggaaaaaaaactgg

SEQ ID NO: 19391 - DNA, 106 bp, Diabrotica virgifera
tagttatacgtcgtgacgcttacttgctggagcgtctgtaccgtcgatcttttccttcgggtattatgttttctaggactcttgtatttttacgctgaatatttaa

SEQ ID NO: 19392 - DNA, 145 bp, Diabrotica virgifera
  misc_feature (15)..(34): n is a, c, g, or t
tcgattgtgatcgannnnnnnnnnnnnnnnnnnncacatatcttatttttagcaccctgtggatcaggaattactaatgaatacttatatatctattattttcggatttattagagctaatatgtcgctatttctattgttaata

SEQ ID NO: 19393 - DNA, 936 bp, Diabrotica virgifera
  misc_feature (2)..(730): n is a, c, g, or t
  misc_feature (737)..(774): n is a, c, g, or t
  misc_feature (840)..(862): n is a, c, g, or t
  misc_feature (864)..(864): n is a, c, g, or t
  misc_feature (896)..(921): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgggacctcgatgttggattaagtttataattggtgtagcagctatatatattaagtctgttcgannnnnnnnnnnnnnnnnnnnnnnangttaaacccgtggaagccagggtggtttctannnnnnnnnnnnnnnnnnnnnnnnnnaagggacaaatatat

SEQ ID NO: 19394 - DNA, 201 bp, Diabrotica virgifera
  misc_feature (14)..(85): n is a, c, g, or t
ttttcagggtccgnnnnnnnnnnnnnnnnnnnnnnnnnnnnnnnnnnnnnnnnnnnnnnnnnnnnnnnnnnnnnnnnnnnnnnnngtagagaatgaatttaaagtatttggattttttagtggagattatagaagtgttggaaaggtggaggggaataagatgtgtggagaggttagtatgtagtagagaagaatggtttg

SEQ ID NO: 19395 - DNA, 869 bp, Diabrotica virgifera
  misc_feature (287)..(310): n is a, c, g, or t
  misc_feature (768)..(785): n is a, c, g, or t
  misc_feature (815)..(828): n is a, c, g, or t
  misc_feature (831)..(847): n is a, c, g, or t
atcaaattcctaattgtatgtcaaaaagtgagcaatagctacctcttaaaactcaccaaatttcatttgcatattttaaccgagcaataaataaatcgtcagtttgtaagaaaaatttcaacaacccttatctcggaaacgaagcatttgcggacatacgttggtggagcgggctgtcattgttttttcattcagaattaccccttaaagtttgccttacttatgtaaaaacaccctggtattgatacaaacaaggctagttgtttaagggggggggtatggtttgnnnnnnnnnnnnnnnnnnnnnnnncaaataaaagtgcatactttcaagaatactctctgaaaatttcaaaataattggagtaaaattaccggagatgcagggtgttgaatatccctaccttcgattcgctttgccgcggcttcgcttcagcacgcttgagcgtagtgagaaacgttaaacaactggtcggcttctcttttgtagattactccgccattcaaaaaaacatattccaatggtcatcactttacgatttggcagacaataagaagatgaagatggaggtgtcaaaactttaaacgcatttttctcaaaactgcttttttcaatacggtggacattgtaactgaaaaactacttgaccaatctaccctgaaatttgcatagattttctttagcatttgggcgagggaacaacgtcgagaaattttccgtttgtgcttaagtttttgttcagcaatattaaatctgttggttttcannnnnnnnnnnnnnnnnntttcgtatttttgacttctgagtgataccnnnnnnnnnnnnnncannnnnnnnnnnnnnnnncgacggtgttacctcgggaaac

SEQ ID NO: 19396 - DNA, 904 bp, Diabrotica virgifera
  misc_feature (422)..(440): n is a, c, g, or t
catgtccattttcagtaaaaaatctctaatagttttcgatatattgaaaaaaatcgattttcattttgtaacttcaaagggctgtaattttttttatgtgcacatttctactaaggtaagttaggtaagttttctgcatttttgttacaccctgtataatttgaaacattgttttactatgctcctacatttttgacgattgtgttatgccgttacaaaatgtcaaaattcaacgctcaaattttaagactccgaaattgtaagccgtagtccatacatattgttttcatagtgtcgcaaaacaggggacaaaaaaaagctgaaaaataatacgatgtaaaaatcagttaaacttgtcttagttcagcaacccatttattaatttaagtttatgtccagaaaaatttgtggaataaatttcnnnnnnnnnnnnnnnnnnnccatatgtggcaaaaaaatacagtcaaaaatcagaaaagagaagatatgcaccggttctataagatgattaagaaggaatttcacgttgcgcattgaggttggcggaaaattttgtattacttttgtttccctactattactattgaactaataataatttttctcaaaacttgcaggacatatttaactagcttgatgtgtatgcctaaactcgtgatatatgttatgatttgagtatgaaaattgttttaaaacactctgatcaaaattatatcgtacctgaattagaaagtgccaaaataacgtttgtatgtagatcaaatatatttgataataatagggatcaactgcgctgttgtttgaatgaaaatgtatatttatgtatatttaattaatgtaactttttgtgaattggtagaagtattttgaaccacccacattaaagttcatggtactctcaaaa

SEQ ID NO: 19397 - DNA, 862 bp, Diabrotica virgifera
  misc_feature (130)..(151): n is a, c, g, or t
  misc_feature (291)..(339): n is a, c, g, or t
  misc_feature (502)..(520): n is a, c, g, or t
  misc_feature (827)..(827): n is a, c, g, or t
  misc_feature (833)..(854): n is a, c, g, or t
ccttacgcggccggtaatattggcaattcagaatatctgtcttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcagcaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctagagtaccaaaagcttctttttttcttctctcttgcctaacaatatgagaaattaatccaaatccctggtaaaattaaaatatatacttcangatgannnnnnnnnnnnnnnnnnnnnncccgctct

SEQ ID NO: 19398 - DNA, 241 bp, Diabrotica virgifera
  misc_feature (2)..(174): n is a, c, g, or t
  misc_feature (185)..(185): n is a, c, g, or t
  misc_feature (191)..(192): n is a, c, g, or t
  misc_feature (194)..(238): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttttaangtaaanngnnnnnnnnnnnnnnnnnnnnnnnnnnnnnnnnnnnnnnnnnnnnnatt

SEQ ID NO: 19399 - DNA, 106 bp, Diabrotica virgifera
  misc_feature (23)..(48): n is a, c, g, or t
atctttgtagggggtcccatagnnnnnnnnnnnnnnnnnnnnnnnnnntgagacttttatttacacacttaaatgtgggtatctaaataaacatcgtttttaagtt

SEQ ID NO: 19400 - DNA, 102 bp, Diabrotica virgifera
  misc_feature (5)..(20): n is a, c, g, or t
  misc_feature (22)..(35): n is a, c, g, or t
  misc_feature (43)..(89): n is a, c, g, or t
attcnnnnnnnnnnnnnnnngnnnnnnnnnnnnnnagacgagnnnnnnnnnnnnnnnnnnnnnnnnnnnnnnnnnnnnnnnnnnnnnnnctcattatataat

SEQ ID NO: 19401 - DNA, 117 bp, Diabrotica virgifera
gtattttttatagagttttaaattcgagtgtgtatttttagacacaaagggaatgggtgggacaaaattgttttcaaaagaatgttaataaagacaataaaatacatattgatctac

SEQ ID NO: 19402 - DNA, 158 bp, Diabrotica virgifera
  misc_feature (2)..(30): n is a, c, g, or t
  misc_feature (37)..(90): n is a, c, g, or t
  misc_feature (97)..(157): n is a, c, g, or t
annnnnnnnnnnnnnnnnnnnnnnnnnnnngaaggtnnnnnnnnnnnnnnnnnnnnnnnnnnnnnnnnnnnnnnnnnnnnnnnnnnnnnncgttacnnnnnnnnnnnnnnnnnnnnnnnnnnnnnnnnnnnnnnnnnnnnnnnnnnnnnnnnnnnnnc

SEQ ID NO: 19403 - DNA, 93 bp, Diabrotica virgifera
  misc_feature (12)..(58): n is a, c, g, or t
  misc_feature (71)..(71): n is a, c, g, or t
  misc_feature (75)..(75): n is a, c, g, or t
  misc_feature (81)..(82): n is a, c, g, or t
ggggtggatgannnnnnnnnnnnnnnnnnnnnnnnnnnnnnnnnnnnnnnnnnnnnnngttaaaagcttanattnttttannagacgagaaac

SEQ ID NO: 19404 - DNA, 197 bp, Diabrotica virgifera
  misc_feature (45)..(64): n is a, c, g, or t
gttaatacgttttatttagtcttatccctttataaatctttaacnnnnnnnnnnnnnnnnnnnntaattagctctgtattgaaactgaaagtaccttgtggaaaatcgaagaagaacatctgtgaactcacatgtctgagagtactgcgttgcagcgaagaatttactcagtgtcgaagttgacagagcgatgaaat

SEQ ID NO: 19405 - DNA, 912 bp, Diabrotica virgifera
  misc_feature (64)..(894): n is a, c, g, or t
aaggtgacgataacatcgtcgtcatacactacacctaaccttcaaaatatcagattgggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggagtccagtactcta

SEQ ID NO: 19406 - DNA, 652 bp, Diabrotica virgifera
  misc_feature (6)..(41): n is a, c, g, or t
cctccnnnnnnnnnnnnnnnnnnnnnnnnnnnnnnnnnnnncacttttcattaactgtgactcagtgatatgattgaaagccatggacgtcattgcgagaattggggctgatggtattaccataactagttaaagcgcactgggcctgacactgctactagtgatgtcagatcaacgagtgccagcaagatgataaatgagcgctcaaaaacaaaattactaatgtcttataaacaaagcgaaaagaatctcccaactacaagatgtccctggtgactgtttgtggtagagctttgacattctcagaaagtccccggagcacgtccatgcactagacgccaaacatagataccatgaaccattgtgttgactcatgtagatgaaggagtataaatcctagatgacatctcatttatcttgcccacaatgaggaacacgaacagctaagttccatgccaaaggatatccctgtttgattggacagtcgtaccacgtctggaagaccttggcataggcgccgacaagactgatgtctgatggtttgccgaggtcgctggacttagttttcaaaggtctattacttgataagtgtctctcgtgaatgtccagcgatgatgcaactcgattatcttgaatgtgtggctagatcttc

SEQ ID NO: 19407 - DNA, 897 bp, Diabrotica virgifera
  misc_feature (4)..(767): n is a, c, g, or t
  misc_feature (790)..(791): n is a, c, g, or t
  misc_feature (847)..(869): n is a, c, g, or t
  misc_feature (871)..(871): n is a, c, g, or t
agtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggganngagtcaatcgataataaagattgcgaccctcgatgtggatttaagttataattggnnnnnnnnnnnnnnnnnnnnnnntngtcgactttttaaatttacatgatct

SEQ ID NO: 19408 - DNA, 556 bp, Diabrotica virgifera
  misc_feature (6)..(19): n is a, c, g, or t
  misc_feature (22)..(34): n is a, c, g, or t
  misc_feature (401)..(432): n is a, c, g, or t
  misc_feature (434)..(450): n is a, c, g, or t
caaagnnnnnnnnnnnnnnttnnnnnnnnnnnnnccccaaaactttcttctggccccaggagggggacggaggggccttaccaaatatcggaacccaaaaactactccccccccttcaacggaaaaaaaagggaagccagccccgttttcggggacgattttcaaagaggacccatttaacccttcaagaaaaagccctggggtttcggggggggggacgactgggggggggcccccccctgggtttcttccattaataggaacgatcgggggggaaaaagcaggggtcccaggattaacaacgggggatctatcaggaacaaggggtttacgaagcatagggggacgcataacccccctggggcggggcatgggcctacatggcccaactggggggctannnnnnnnnnnnnnnnnnnnnnnnnnnnnnnntnnnnnnnnnnnnnnnnnaccttgagggggctgttggggagctggagggggctgttgttgagctggggggggctgttgtagacctggatgaacaccacctggggggggaagatggcccccttga

SEQ ID NO: 19409 - DNA, 177 bp, Diabrotica virgifera
  misc_feature (11)..(89): n is a, c, g, or t
  misc_feature (94)..(172): n is a, c, g, or t
atgaagggggnnnnnnnnnnnnnnnnnnnnnnnnnnnnnnnnnnnnnnnnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnnnnnngggtt

SEQ ID NO: 19410 - DNA, 243 bp, Diabrotica virgifera; identical to SEQ ID NO: 16769
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (241)..(242): n is a, c, g, or t

SEQ ID NO: 19411 - DNA, 199 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (116)..(116): n is a, c, g, or t
  misc_feature (174)..(175): n is a, c, g, or t
  misc_feature (179)..(179): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgacttttanaattttacatgatctgagtttaaaccgggtgagcccaggttggtttctatctttattnnatantatattttagtacgaaagga

SEQ ID NO: 19412 - DNA, 146 bp, Diabrotica virgifera
  misc_feature (113)..(113): n is a, c, g, or t
attttattttacctaacgggtagtccttggtttctcctgttgcttaacacttagctttttttactagatgtagtagtagttatttttggttttacccatcacctttctccccntccctcagatgacagcactcctttcatcatttt

SEQ ID NO: 19413 - DNA, 204 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (148)..(148): n is a, c, g, or t
  misc_feature (163)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtngagccaggttggttnnnnnnnnnnnnnnnnnnnnnnnnnnnnnnnngaaaggacca

SEQ ID NO: 19414 - DNA, 298 bp, Diabrotica virgifera
  misc_feature (7)..(99): n is a, c, g, or t
  misc_feature (106)..(143): n is a, c, g, or t
  misc_feature (163)..(176): n is a, c, g, or t
  misc_feature (179)..(201): n is a, c, g, or t
  misc_feature (209)..(231): n is a, c, g, or t
  misc_feature (261)..(292): n is a, c, g, or t
caccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 19415 - DNA, 95 bp, Diabrotica virgifera
ataacttatgtataaatacaaatcttgtgtatattagcgatttttcttgaaacatcgaagaatctagatgttaagaggcatgtagagaattcaat

SEQ ID NO: 19416 - DNA, 881 bp, Diabrotica virgifera
  misc_feature (425)..(443): n is a, c, g, or t
  misc_feature (658)..(679): n is a, c, g, or t
  misc_feature (710)..(727): n is a, c, g, or t
attgattattttattaagattttgcttataattttgaggttgtattgactgtcaatattagtttccttattttctgcttccgatagttccacaattatcgtgtagatggcgctagattaatagattaattctacaatatataataatataatgataaaaaacaaagctttagtatgtatttgagacgtaagtaaatttaagataaaaatatatgccacagctttggccaacaaaactttttctattaatgtttttaatttcaatgttttaaattattcactttcacattttatgtcaaatttccaaccgaagttcactgacttgccactattggcgctcgcgaacttttaagtattccctgtacctacgagctcacagcggataaacacacattgcattgaatttttttctcactttgatttttnnnnnnnnnnnnnnnnnnncaacgcgcaatatcaaactgataaaacacttcagaaaatgcaatagccacaaggactattttaaagatagtcactcgcacatatttatctaaatagatatttagtggtgtgtaggaacgaatattggtaaaacttgttaaaactttaaaatacggcacggagtaccgcagtgtggacaccggaggtttaatatgccttttataaggtatttcaannnnnnnnnnnnnnnnnnnnnnctacactcatcggcacgaagttccgccaccnnnnnnnnnnnnnnnnnntttgacaatctgtaactttgttatttgtgctccgattttcaagtttcttcctttcacccctgtatggtcccatgcaagcaaaatttttttgttatcggaataataggtaccaaataataccaatacatgcacctgcggactggtgcaagaatgt

SEQ ID NO: 19417 - DNA, 721 bp, Diabrotica virgifera
cttagtaaacttaatatgttctgcaagttttatttactctttttagttggtattagcccttttgttctaaggaaccacgttgtaacaggagcacctacaaatggtgaaccatctaaaccagagatttcaatagatatactaacgatactctcaagcgcttttccaagcttactatctattgaaggcgcgcctgaatttatgtccaacctaggattactgacagctgtaaataaatgtgtagacccaaaagttttagctaatataatggcttctctgatggatgcattccaaaacgaagaaggtattaatcaaccgcacgtttttatgttgacaggaaaatcattcctaaaactgcataagatgttaatgtgcgtacttattacaatgtacaaagaaggctcactgcagagtttagcatctcctttaaatgcaagactaggtgctttaactcgaggttataacatggtctcgttggcaaacagtttcaatatgaaagactttaaagataatgtggatattaaagcacttgctaacggaaatatgcttgatgcattaaatggtggtgcagtggatcttaatggtctttctaagaatattaatttagatactgtagcgaaaggcctccaagcatttttctgaaaataatgtgtaaattagtaagatagttatttatataatctgtataaatgtactcgtggagagaaatatagaatatttatgt

SEQ ID NO: 19418 - DNA, 666 bp, Diabrotica virgifera
  misc_feature (3)..(27): n is a, c, g, or t
  misc_feature (54)..(82): n is a, c, g, or t
  misc_feature (91)..(119): n is a, c, g, or t
  misc_feature (122)..(138): n is a, c, g, or t
  misc_feature (173)..(197): n is a, c, g, or t
  misc_feature (212)..(231): n is a, c, g, or t
  misc_feature (314)..(337): n is a, c, g, or t
  misc_feature (483)..(513): n is a, c, g, or t
  misc_feature (523)..(552): n is a, c, g, or t
  misc_feature (557)..(571): n is a, c, g, or t
ccnnnnnnnnnnnnnnnnnnnnnnnnncccaattcccaaattataacttcccannnnnnnnnnnnnnnnnnnnnnnnnnnnnaaagagggnnnnnnnnnnnnnnnnnnnnnnnnnnnnnccnnnnnnnnnnnnnnnnnggaaatttttaatcccccccaaaaaaggggtttcnnnnnnnnnnnnnnnnnnnnnnnnnccccggggggggtcnnnnnnnnnnnnnnnnnnnnaaccccccatttttcccccaaagggacccgggggggttgggaaatggttgggggtcccccccggggtttttggggcgggattnnnnnnnnnnnnnnnnnnnnnnnnggggaggacttttcccccaaagaaacctggcctggttgggggggggccccccattttttgaaacctttttttttcaaaacctttaacccaaatgggttggccccctcccaaagggggttggtaaggggaaggaccccccccccggnnnnnnnnnnnnnnnnnnnnnnnnnnnnnnngggggcgggnnnnnnnnnnnnnnnnnnnnnnnnnnnnnncaatnnnnnnnnnnnnnnntggccccgggtaaaaccccaagcccaaacttaccttcaaaaaaacccccaaaaacaaccgggaaacaaacccccaaaggggacccccccccctcg

SEQ ID NO: 19419 - DNA, 122 bp, Diabrotica virgifera
  misc_feature (6)..(34): n is a, c, g, or t
  misc_feature (39)..(100): n is a, c, g, or t
  misc_feature (102)..(118): n is a, c, g, or t
taatcnnnnnnnnnnnnnnnnnnnnnnnnnnnnngaagnnnnnnnnnnnnnnnnnnnnnnnnnnnnnnnnnnnnnnnnnnnnnnnnnnnnnnnnnnnnnngnnnnnnnnnnnnnnnnncgag

SEQ ID NO: 19420 - DNA, 896 bp, Diabrotica virgifera
  misc_feature (71)..(97): n is a, c, g, or t
  misc_feature (437)..(461): n is a, c, g, or t
  misc_feature (676)..(706): n is a, c, g, or t
  misc_feature (807)..(807): n is a, c, g, or t
  misc_feature (819)..(819): n is a, c, g, or t
  misc_feature (858)..(858): n is a, c, g, or t
  misc_feature (873)..(873): n is a, c, g, or t
  misc_feature (879)..(879): n is a, c, g, or t
gaaggagaagacgtttcagagactataaaagaagtcgtcttaatatccggatcggtctgtcgccacattgnnnnnnnnnnnnnnnnnnnnnnnnnnnccatgtaactcagtaacgggccgcattttctttaagtgattggggttaaatcttaatattttgaggtctagaatctacaactcagagattggacattcttaatgaattaccctgtatacatttcacagttttaggtattcctactgtaatatagattatatttaatcatatattagtacaataaacaaatgattataattattattttgacttttcaagcttttataaacataaatttatttttccattatattataaacagtattcaagttgggcatccctgtggcagtggcggatctagacatttgccttgggggaggggacttacaatgaaacaccnnnnnnnnnnnnnnnnnnnnnnnnncttcattttcttaactggccgatttattgggttgaatttgtctgtctatggtttaagtttcatgtcagctaatatatttttgtttcaaatttgttttctttatttggacctcgttgggaaaaggggtattatccccgtagatccgccgctgccctgtgacagaactctcactattttgtattattaaaagagctataaaagcacatataagtgannnnnnnnnnnnnnnnnnnnnnnnnnnnnnngtgtagtggtaccaaaatgatctcagtttgttttagtacctacctctttcttttgtgtaaaagttcacaattcaactatttcacaaattttacttaattgnggggaagactangtatattttctgcactgtaatttcagcactttgtatganttgtatttataattnagcgantataattttttacccat

SEQ ID NO: 19421 - DNA, 98 bp, Diabrotica virgifera
  misc_feature (2)..(28): n is a, c, g, or t
  misc_feature (36)..(52): n is a, c, g, or t
  misc_feature (54)..(96): n is a, c, g, or t
gnnnnnnnnnnnnnnnnnnnnnnnnnnntatagagnnnnnnnnnnnnnnnnngnnnnnnnnnnnnnnnnnnnnnnnnnnnnnnnnnnnnnnnnnnntg

SEQ ID NO: 19422 - DNA, 63 bp, Diabrotica virgifera
  misc_feature (10)..(37): n is a, c, g, or t
  misc_feature (58)..(58): n is a, c, g, or t
gttaaaagcnnnnnnnnnnnnnnnnnnnnnnnnnnnntatagagtttataaattattnaatag

SEQ ID NO: 19423 - DNA, 402 bp, Diabrotica virgifera
  misc_feature (114)..(131): n is a, c, g, or t
  misc_feature (181)..(202): n is a, c, g, or t
ctagttctagacgtttactttgcgcatgagccaagacatatgccctctacttcatcggatgcgtaaagtaaacgtctagaagttaattcaatatcagtgttatctcagaaagtnnnnnnnnnnnnnnnnnngttaccggccaacaacttctacaacatcagtcagaattccttaattacgnnnnnnnnnnnnnnnnnnnnnncgccttagtactagttcacatcattaaatgaatttttctagatgaaacaccaacacacattactaacaggtgtctaaattacaaaacaattttttttagcaatttgttgttttttttttctacaaacttcaggtctggctatttattttgtgattgttatttataaatgtattatacgtgttatgaaataaacagacttc

SEQ ID NO: 19424 - DNA, 923 bp, Diabrotica virgifera
  misc_feature (96)..(113): n is a, c, g, or t
  misc_feature (116)..(131): n is a, c, g, or t
  misc_feature (573)..(573): n is a, c, g, or t
  misc_feature (805)..(805): n is a, c, g, or t
gactatgctataggtgtacatgacaatattatacaaatctaataagtgaagcttgtgtaattcaacaaaatatgaagtatagtgttagtgtattgnnnnnnnnnnnnnnnnnnggnnnnnnnnnnnnnnnngcttttacaagaaaagagatattcagataattcgaaaaacaaaatctttgggatacctccaggataatacaaaaggagtatgaaacaaaatcaaccctacaattttttgacagaattttttaaaatttggagaaaatacaacgcttccattcacccccctctaagaaaaaacatttttgttaccggaataataacaaacaatgtcaatacatgtatgtacctacaagcagatgcaagaatcttgaaaatcggagtacaagtaataaagttataaattgtcaaacttaatcaaaaattttgggtggcgaaattgtgtgccagtgagtgtagatttctatacttgaatccgtatacccaggaaacgaagtacatactacatactcacaaaaagcattgaaattttagatgtttatggtggaatttggaatgcatgggacgtaangttattggaggtgtttgctcaaaaaacactacgaatgtccagataataacattagatattacttgtatactccagaaaatggcgaaaagaggattactatagatgttcgaaatcctcactccctcaattattcgggttacgattataagaaaaataatgtgattattattcacggatttaatggtacggaaagcagatccccaataacgatattgagaaatgcttacctttncagaaaagattacaatatttttacaatcgattggtccacaataacgcatttcccttgctatatatcagctctatcaacacccgattaataggtcagtgcggagctaactttacgcttt

SEQ ID NO: 19425 - DNA, 966 bp, Diabrotica virgifera
  misc_feature (89)..(102): n is a, c, g, or t
  misc_feature (105)..(117): n is a, c, g, or t
  misc_feature (457)..(484): n is a, c, g, or t
  misc_feature (753)..(753): n is a, c, g, or t
  misc_feature (800)..(800): n is a, c, g, or t
  misc_feature (802)..(820): n is a, c, g, or t
  misc_feature (828)..(858): n is a, c, g, or t
caaagatttatgtaccactagaaagagagggatcccattttttgaattgacaaaatttcttatgcaatttttaagaacttggtcggagnnnnnnnnnnnnnngtnnnnnnnnnnnnnaagcttaaaaaaacatctacaacacatgggactttcacaaaaaacacatacaaatttgatgatggtaaggttacgactgaaaaccttccagttctgctgattgtttccacttcagatggtaggttcttaaccttgccatgatcaaaaatttgtctaaaataactctccaaacatttatgcttcagttgtccgctccttttgctccaggaacgtcacactcagctatgtttgtaattgagtgatctctagcttggctttgaatggattctatgcagcttgatgtgttatttcttctttttgaattaattggtgccacatttagattttccgtaacactaannnnnnnnnnnnnnnnnnnnnnnnnnnngtctccaaactttaatgatgctgcaaacattatttttctctaactttgtctataacaacgataatattttcactcacaattagtaatttgaataaagataaaagtcacaaaatttatatcttataatttttgaaattcgggattctattttcagtcatcttcacattcgacactatagatatataatttcttataaatattaacaacttaaattatattaaatacataattataaaagtatgtagaactaactgtttatcatttccttntatttggtatgttaactaaagttacaggttaacaaaggtaaacttanannnnnnnnnnnnnnnnnnngtcagtcnnnnnnnnnnnnnnnnnnnnnnnnnnnnnnnggtaaatatacagtgcacttaatattctaataggatattctaaacaatgctaaaaattttattgacagaaaagtaccttatttactgtttctattaacaaaaatcttt

SEQ ID NO: 19426 - DNA, 118 bp, Diabrotica virgifera
  misc_feature (4)..(64): n is a, c, g, or t
  misc_feature (76)..(115): n is a, c, g, or t
gctnnnnnnnnnnnnnnnnnnnnnnnnnnnnnnnnnnnnnnnnnnnnnnnnnnnnnnnnnnnnngtatcaatctannnnnnnnnnnnnnnnnnnnnnnnnnnnnnnnnnnnnnnncac

SEQ ID NO: 19427 - DNA, 762 bp, Diabrotica virgifera
  misc_feature (5)..(558): n is a, c, g, or t
  misc_feature (565)..(602): n is a, c, g, or t
  misc_feature (622)..(635): n is a, c, g, or t
  misc_feature (638)..(660): n is a, c, g, or t
  misc_feature (668)..(690): n is a, c, g, or t
  misc_feature (720)..(751): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggaccag

SEQ ID NO: 19428 - DNA, 116 bp, Diabrotica virgifera
  misc_feature (13)..(13): n is a, c, g, or t
  misc_feature (24)..(45): n is a, c, g, or t
  misc_feature (48)..(48): n is a, c, g, or t
  misc_feature (53)..(53): n is a, c, g, or t
  misc_feature (56)..(56): n is a, c, g, or t
  misc_feature (71)..(72): n is a, c, g, or t
  misc_feature (84)..(84): n is a, c, g, or t
  misc_feature (94)..(94): n is a, c, g, or t
gctggaatggaangggtggatgannnnnnnnnnnnnnnnnnnnnnttntatanagnatttttatttttaanngtaaaagcttanatttttttanaagacgagagacccctatagag

SEQ ID NO: 19429 - DNA, 634 bp, Diabrotica virgifera
  misc_feature (140)..(189): n is a, c, g, or t
  misc_feature (194)..(302): n is a, c, g, or t
  misc_feature (305)..(350): n is a, c, g, or t
  misc_feature (358)..(443): n is a, c, g, or t
  misc_feature (474)..(528): n is a, c, g, or t
  misc_feature (534)..(575): n is a, c, g, or t
  misc_feature (591)..(626): n is a, c, g, or t
gattatgctaccttagcacggtcattatattttttacattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnntagatatatttaaaaacgaataacatttcannnnnnnnnnnnnnnnnnnnnnnnnnnnnnnnnnnnnnnnnnnnnnnnnnnnnnnctcttnnnnnnnnnnnnnnnnnnnnnnnnnnnnnnnnnnnnnnnnnnccctgatacacaaggnnnnnnnnnnnnnnnnnnnnnnnnnnnnnnnnnnnnattcttat

SEQ ID NO: 19430 - DNA, 931 bp, Diabrotica virgifera
  misc_feature (228)..(247): n is a, c, g, or t
  misc_feature (282)..(302): n is a, c, g, or t
  misc_feature (503)..(523): n is a, c, g, or t
  misc_feature (792)..(792): n is a, c, g, or t
  misc_feature (822)..(822): n is a, c, g, or t
  misc_feature (844)..(844): n is a, c, g, or t
  misc_feature (855)..(856): n is a, c, g, or t
  misc_feature (870)..(872): n is a, c, g, or t
  misc_feature (904)..(905): n is a, c, g, or t
gtaaattagaatgattagaatcgagacccggaaggagaatgtaacaattaatcagcaatctttttctatttctatccttaatattatggaatggcgagatcggataaagattgctgattaattgttaaattagaatgattagaatcgagacccggaaggagaatgtaacaatgtcatcggtagcattttgtaaagatgaaatactccatgattttatttctgtataannnnnnnnnnnnnnnnnnnncttctttctgtagcgttgaaataatcagaagggcnnnnnnnnnnnnnnnnnnnnngggtgggattgggtggattgtatgtcatgtgctgcttgaactactgttgtcgacaataaaacatgacttaaaccactttggagaacttcaatatgtgtaggacagatttgtctttaatacaaacaattttagaaccatacagaccataatatattatgtacttcatatcttgaacaactttgcatagatataatagattgnnnnnnnnnnnnnnnnnnnnngttttataacaggaaacaacttggtagtgatacagaacagatttttacataggaaatctgttgtctgtagtctagattgacactttttgttaatttttttacaacatagatgtacagtatggtttttattggctatataccatgtgacatttgaactactatctgatagtggtctgtaaacaggttagaatgtgtcttgaacaccttttgaaccttataacagatatagaacacaaattttatttatgaacacattttcaggataatanaaagcaagtattgtatagaaaatgtacctngtacgtgaagtgtcacctattnctgtcagattnngtgtacatactatnnnttattgcttgtgtcatgtgacttttgactacnnttttggtagtgacctgaaaacacttc

SEQ ID NO: 19431 - DNA, 941 bp, Diabrotica virgifera
  misc_feature (16)..(30): n is a, c, g, or t
acggaaagctgaggannnnnnnnnnnnnnnagaagcaaaacttgcggaagagaggaagaaattggaagcagaaaaacaaaagttagagcaagccaagcttgatgatgaagctagaaaagcagaggaagccaaattagcgcagacaaggaaggctgaggaagctaaattagccgaagaaaaacgtaaactggaggaagtgcaagccaaacaaagacaagaggcggaacgactaagactcgaagaagaaagacagaatgcagagaaaataaaactagaacagaaaaaacattctttagagataacagagataaccgatattcaaaaagtagaaattcaggaatctaatagaggtgtaccgtcaccaataccgattgtagaagacgctagtgaagcaccagtttttacatcacctctaagtgatgcagttatccaagaaggcaacaaattcacttttatttgtcaagttaccggacaccctacaccagtggttcactggtacaaggctggtatatccatacaaaataatcctgactacagaacaacgtttgaaaacggcctgtgctctttaaccatcgaagagacctttgctgaggattctgcaagatacacgtgtagagctagcaactctgctggtgaagacgaaactactgccgtacttactgttaaagaaagtgaacctgaagacatcctttcagctccttcgtttctcaaacctcttcaacccagcagtgccaaagagggatcggccttccagttcgaatgccaagtggatggaaatcctttaccaactgtgcagtggttcaagcatgctgagtgtattgataattctcctgactatagtatcacttataaatatggaaatgcagtcttgagatttgataaagtgagattggaggataaggctgagtacagctgcaaagcatccacccaaatgggaactg

SEQ ID NO: 19432 - DNA, 927 bp, Diabrotica virgifera
  misc_feature (46)..(66): n is a, c, g, or t
  misc_feature (76)..(94): n is a, c, g, or t
  misc_feature (733)..(733): n is a, c, g, or t
  misc_feature (774)..(774): n is a, c, g, or t
gaaaggttgtaggtgagagcacacttaaaaaaatcaatttggtagnnnnnnnnnnnnnnnnnnnnngcattcgttnnnnnnnnnnnnnnnnnnngtgatacacatctaagtaatacggagaatctgtattttaccagactttttgagttttattgtagtcgtaataggtatcagcaaatatgcctagaggtagattcccatcgtctcctagaggaggctacaggggcagttccagaggttccagccgaggactttcgtcctggaatggctcctcgcggtcaggagggtatccctccagcagatcctatccacccgcaatggaatcgaggaatccctacgagcccaagtattcgacttcagagagatatagagaagaatataagccttacagagctgaatatagcaccagtatcatggtacgtgaaagaagatcccctgaacgtaaacgtttgagggtggaaggccattgcaagaagacatgccatagaagaagctgaagctgaaaatggagatgaggatataaaagcagaaattgaggctgaggaagcacaaatcactgaagaaagtaaggataatgaagagagaaaagaacaaagcaaggctttcatcaaacttcaatgcccccattgccatatgcgggctttgacctacaagaaatatgaattgcatttgggtagccgtacccattctcttgcaatgagaagagttgcttttaagcagaaagctatcttanatcagatgcgccgtgctcagaggaacactcaaaatgaattnggaaaagggtgctgcggatctcgacagtgtaactacttactgtcccctgtgcaaactgaaatttcagcaaaagaaagctgtgcatccattatctgagtcacaggtaaaccatgaaagaagttcttgatgcccactttgcaaagtttgtaccct

SEQ ID NO: 19433 - DNA, 938 bp, Diabrotica virgifera
  misc_feature (905)..(905): n is a, c, g, or t
aaaaatctttttataaaaaaacatgtaactcacacagtatacgacattacgtgaaatatttccaaatttattgttgaaaatcgatctgaatttttaccttacttaatctggccttttatcgcgcaaattatacacgatattcaaaacttttgggatgtttagtagcttcgcattgcatgttatagtagtaaataagatatttttctatatttaggactataaaatactctagtgatcattgtgatttttaaagaggttgcttaaagtggaataaaattttaatacagacgaaatgagttatgattacaagaaaaactaagataattagttgcggcaaacaaatcaaatgctacacttttgctgagacattcaaccctcaactccgtataacagtgtagacagtgttaggtctctattgcaaaatagtgctttgtccttgcactgttcatttacaccctttttttggttcctttgatttgccttttaatgattttgttaattctgttatgttcatctttgttatcttcttgtagttttctcttttccatcagctgtagggttccataggtcatccaatcttttcttttttgtttacttgcttttcccaggatatataatgtagtttcttttgctgtgtctctaatatttgtcctattgtatcacctatatctggcggtatctatgtgttctttgaatggttgtatttttggttaagttgtatatatagcagacgactacagagcgtaaaatttgagtttgttaatctatatgttaattatcatttttcaattttatcaatggtatatcgtattcgtgaaacttatcacgtgatatgtcgtacgtcaccattggaccaatagcaacagagatacagcattaatgctccacgtaccaatccgccatantttatttttctatataattgtattcctctccct

SEQ ID NO: 19434 - DNA, 904 bp, Diabrotica virgifera
  misc_feature (315)..(349): n is a, c, g, or t
  misc_feature (731)..(731): n is a, c, g, or t
  misc_feature (765)..(766): n is a, c, g, or t
  misc_feature (858)..(858): n is a, c, g, or t
  misc_feature (864)..(864): n is a, c, g, or t
cctttttatgtcaacgttgtgtgcagtatctgccatgtggttcttcttacataaagcaatatcttggaagaaaacggcggcacaatcgagacaattcaacgtagaatgcaagctgttccatttctacgactcccatgacatttggcactttctaagtgctacagggatgtttttcacgttcatggtgttactaacactcgatgacgacttatcgcatacgcaccattcgcaaattccagtattttagagcatctacggatgaaaaactagtctgaaagtatttttattgatatgagtatatgaacatataaaggnnnnnnnnnnnnnnnnnnnnnnnnnnnnnnnnnnnttaaactgtttttgtaccctctactactatattttacagctcccggaacgaaccatggccggtgacaaacgctgtcgtcggtcgtacacccacttaatctttacgcagacagggtttctatgaccggccatggttcgctccgggagccgtagtcttctttcggtcttgtgtcgtttcaggcattggcagattccgtaatatcaaactacaacactcttcagctacagctataataaattttattgttaattgtgctatctttactggttatattggtcagatgttggtgtcttagttatttttcgtcggcgtatcgtataagatgaaacatattccattctagaacgaccagttaataaccatggtgtaaacttaccactanaaattccaatatcaacatctcgccatgattttgnngagataatttttttatactttttatttagtagatatacaattgcattattatacaaaaataaccaatttttatacagttattaatgaataanaagtangatattcgcccaaatccgtccagataggtgtacagtacgt

SEQ ID NO: 19435 - DNA, 927 bp, Diabrotica virgifera
  misc_feature (2)..(64): n is a, c, g, or t
  misc_feature (70)..(92): n is a, c, g, or t
  misc_feature (283)..(356): n is a, c, g, or t
  misc_feature (361)..(426): n is a, c, g, or t
  misc_feature (444)..(462): n is a, c, g, or t
  misc_feature (471)..(485): n is a, c, g, or t
  misc_feature (487)..(503): n is a, c, g, or t
  misc_feature (506)..(524): n is a, c, g, or t
  misc_feature (539)..(559): n is a, c, g, or t
  misc_feature (697)..(746): n is a, c, g, or t
  misc_feature (751)..(795): n is a, c, g, or t
  misc_feature (805)..(859): n is a, c, g, or t
  misc_feature (862)..(881): n is a, c, g, or t
  misc_feature (889)..(908): n is a, c, g, or t
tnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnngaaatacacnnnnnnnnnnnnnnnnnnnnnnnnnnnnnnnnnnnnnnnnnnnnnnnnnnnnnnnccnnnnnnnnnnnnnnnnnnnngattttgnnnnnnnnnnnnnnnnnnnngctcatcccctaaaaatat

SEQ ID NO: 19436 - DNA, 471 bp, Diabrotica virgifera
  misc_feature (70)..(93): n is a, c, g, or t
gcaattttattatcagaattcatatttacaccctaaaacctaatcgctgtacctccttgtaccgtcccgnnnnnnnnnnnnnnnnnnnnnnnncccaaaagtatacatctaaacctatcaataaatatatcacaacctaaacttaactatggcctattttgaaatcacacactaaggaaaagtgatccgatgggtaagaaaagctgggtactctgttctctccaatttcctctcccgtcggcatatctaaaacggcctctagttctagcttattcttggaataaaacacgtaatctatggtatggcagacctctccttcacctctgatcttccacgtggtgtatgaaggataccttggaggtgaggaaatcgtatgatcgatatcccaggcttgataaatagatcctacctctaggatagagaaggagttctactgtacactcttcgcagataacattgaaaatatctcct

SEQ ID NO: 19437 - DNA, 878 bp, Diabrotica virgifera
  misc_feature (572)..(643): n is a, c, g, or t
ccttgaattcaccacctgtgaaccggtcgaaccacttacctgtaagaacatgcactctccaccacaagtatctcctgctatctgtcactctggttgccaatgtaaagagggatatgttctcgatacaacaagccgaagatgtgttaaacctactgaatgtccatgtcaccacgccagtaagagctacaaggaaggtgctatcgtccaaagcggatgcaacacatgtacttgtcaaaatggtaaatggggatgcactgaccgtcaatgtgcagctgaatgtagcgcatggggagactctcactacaaaaccttcgatggaaaacgattcgactatcaaggagaatgtgactatgttttggctaaaggaagtcttggacaagattctttccacgtttcagtccaaaacgtaccatgtggatcattgggtaccgcttgtttcaaatctgttaccatcaaagtaacctcaagtggaacatctgatgttattactttagaaaaagacaagcttttgccaagtctcaaaacctataagcacatcactgttagagaaaagagtatgtttgttattgtcnnnnnnnnnnnnnnnnnnnnnnnnnnnnnnnnnnnnnnnnnnnnnnnnnnnnnnnnnnnnnnnnnnnnnnnntggaaggatacaactaaaggtttatgtggtaattacaacgacaatgaagttgatgatttccagactccttctggaggtcttgctgaagtttcagctaatatctttggtgactcttggagattacaatcatactgtactgaagctccagaaattaaggatacctgcgaacaacgaccagatcgcaaagtctgggttacaagaaaagtgcggtgtattaaaatcatcagtcttctcc

SEQ ID NO: 19438 - DNA, 218 bp, Diabrotica virgifera; identical to SEQ ID NO: 7300
  misc_feature (6)..(28): n is a, c, g, or t

SEQ ID NO: 19439 - DNA, 60 bp, Diabrotica virgifera
  misc_feature (13)..(13): n is a, c, g, or t
  misc_feature (17)..(54): n is a, c, g, or t
gttaaaagcttanattnnnnnnnnnnnnnnnnnnnnnnnnnnnnnnnnnnnnnnattatt

SEQ ID NO: 19440 - DNA, 694 bp, Diabrotica virgifera
  misc_feature (17)..(61): n is a, c, g, or t
  misc_feature (82)..(111): n is a, c, g, or t
  misc_feature (119)..(182): n is a, c, g, or t
  misc_feature (195)..(296): n is a, c, g, or t
  misc_feature (303)..(363): n is a, c, g, or t
  misc_feature (366)..(378): n is a, c, g, or t
  misc_feature (381)..(461): n is a, c, g, or t
ggaaagtaattaagaannnnnnnnnnnnnnnnnnnnnnnnnnnnnnnnnnnnnnnnnnnnngaccctggggaaccgggaatnnnnnnnnnnnnnnnnnnnnnnnnnnnnnnccaaattnnnnnnnnnnnnnnnnnnnnnnnnnnnnnnnnnnnnnnnnnnnnnnnnnnnnnnnnnnnnnnnngaaaggtaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaggnnnnnnnnnnnnnnnnnnnnnnnnnnnnnnnnnnnnnnnnnnnnnnnnnnnnnnnnnnnnnccnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnngaatggaggatataataagaataaaaaattggataattaagaaaaataatataggttaataaagggaatccggaacctttttttcccccggttaataaaaacctggccttttggaataaaaaataaggccccgccggcccccggataatttgaatgggccgcggaatttgaacggggtaagggaacattatccataagttttttaatggaaggcggaatggaggggtggaagg

SEQ ID NO: 19441 - DNA, 65 bp, Diabrotica virgifera
  misc_feature (6)..(6): n is a, c, g, or t
  misc_feature (8)..(54): n is a, c, g, or t
aataangnnnnnnnnnnnnnnnnnnnnnnnnnnnnnnnnnnnnnnnnnnnnnnnggtgataaaaa

SEQ ID NO: 19442 - DNA, 911 bp, Diabrotica virgifera
  misc_feature (753)..(753): n is a, c, g, or t
ccttccttcacctccggattatctaaaatggtctgagaagtctcctctacaacggaaagtcgagaatagaaataaaataaatgttgagaaactaactttgtctaagtcacagccggatctatcgacggtcggtgttattaatgatgacaatttgtttagaagaggagtatcagcacccaggccacctaccaaggggagagaggagaacgaatctaaaggagaagagatctggccttcagctgagatggtagaaattcttattaaggaaaatagtgctctcaagcaggagttagagaacttgtatcaaagagtcgaacggacgcaaaggttggaacacgaaatcttaaaagttcacaagggacacgaagaattagttcagtcttgtgagagaagagaaatactcgaaagagctgccagggcacgcctccagtctgattgtgttagatatcaggagttaaacaaagctctgagggagcaagtggaattgctctcaacacagatactgtctcgttcgcctgtgcctgattacggggtacccgagaaccttaggagagagctggctaagagagaaggattaatcaagcaactcatatcgcaaaataaagaattatctgcagccaaagaaagacaagaaatagagctagcggctcaacgggccactttacaggaacaaaggactcatatcgatattttagacactgctctaacaaacgctcaaggaaacgtcgtacgtttggaagaagagtgtcgtanaaaacaagtatacgtagaacgagttttccaacttcagaggggcgttgtcgtcaatgcaaatggcgagtgaacgacgagaacaaacagaaaagaagcttcgcttggcacttgagcgcgaactgcagcgcgccaatcagcttcaaggtggatgggattct

SEQ ID NO: 19443 - DNA, 867 bp, Diabrotica virgifera
  misc_feature (174)..(197): n is a, c, g, or t
  misc_feature (210)..(227): n is a, c, g, or t
  misc_feature (261)..(283): n is a, c, g, or t
  misc_feature (509)..(529): n is a, c, g, or t
  misc_feature (608)..(627): n is a, c, g, or t
  misc_feature (692)..(740): n is a, c, g, or t
  misc_feature (764)..(764): n is a, c, g, or t
  misc_feature (833)..(833): n is a, c, g, or t
cccacgcgtccgctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctncacattttttaggattaataggaatacctcgacgatattcagattatcctgatgtatttatattatganatattgtatcttctattggatcactaatttcttt

SEQ ID NO: 19444 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19445 - DNA, 953 bp, Diabrotica virgifera
  misc_feature (908)..(908): n is a, c, g, or t
ccaaagtctttaagctcctcccaattttgtgacgtcagacgtaggctatcaagtaaaaacgtgcatttaaacgtattttaacgtcattaatcttacgtatttgaaatcacctacaaaagacgtttctacgacgtaatgttcaaacacgtgtatatattcaaccaaaaactgacgtttcctcggcgttattgacgtcacttggttgcctggggtcggaccctgtggcctcccccagcatccgcctccaagtatctgtgtccctggctgctctcctccagttgtccaccctctatatgtctttagcatcgcttcttctatccacctcttccttggtctttctactggtcgacgtcccatcatagtaccgctaagctatttcagttcaatatttactaatacaaagattttatgctcttcataaaaacctctctttagaatcttgtgtaacaccaaaattttgtagtcttctggtttggtgtacagtaagggaaaaaaactccttactgtgtgatgtagtatgtatcgaaggatgtctataattttaaataagtgtttcgcggggtagtcctttaggacacccttctcgcaggacggctcactagcatagtaacgatctgaataataacactactacaattatcctatctcaatccctctgtgggctatttatatctccttataatttgaactttgaaaagtaaaactatacgtgatcgtctacgaggttatacaaacaaaactgtcttaatcagccttcgttttgtttgcatatttagaaacaatatcttttgtaacaactgaaattatttaaaattatatacatcttttgatacatattaatattgtacaggtgggggaagtttttttcccttggcttcggggctaaaatgttttgttctatccccttnacgagccttttttttttatgggaagccatttttttgtgttaaatc

SEQ ID NO: 19446 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19447 - DNA, 408 bp, Diabrotica virgifera
  misc_feature (2)..(115): n is a, c, g, or t
  misc_feature (136)..(168): n is a, c, g, or t
  misc_feature (194)..(194): n is a, c, g, or t
  misc_feature (201)..(231): n is a, c, g, or t
  misc_feature (239)..(240): n is a, c, g, or t
  misc_feature (248)..(407): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttaagtaaaatatataannnnnnnnnnnnnnnnnnnnnnnnnnnnnnnnnactgggttattaaaacatgtcttttntgtattnnnnnnnnnnnnnnnnnnnnnnnnnnnnnnnttgatggnncgcggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 19448 - DNA, 116 bp, Diabrotica virgifera
  misc_feature (75)..(75): n is a, c, g, or t
gtgcatggggggggatttttgttgttttgttgtgggttggttcttcaggggttttgtattttttgtgagggtttntgtgagttggttttgtggtgttactagtagtctcctttttt

SEQ ID NO: 19449 - DNA, 275 bp, Diabrotica virgifera
aagtaatcccctccctgcagaaaaaccaccctgatcatttggtttcaaaattcatttagaaaaatggaacacaaaattggtttaaatttctcggaccccccttttcccccttttcttggtaactttttcccccagaacatttctccccccacacacccccccctattacccaacaacccttgacttctttcacgcatctctagattggggtggccccccctacctatccccccgcacttaccactccctggcttactttcccccccctctctacc

SEQ ID NO: 19450 - DNA, 268 bp, Diabrotica virgifera
  misc_feature (156)..(175): n is a, c, g, or t
tcctttaaggcgtttgaaaaaaaagacgcgaacaaggggggcccccttttaaaagttaaagtggtatagacagaactggaaaatctaataacattattgtagaaatgctaaaaaatgaaatcccctcaaatttgaaaaataacttcaagtccatgnnnnnnnnnnnnnnnnnnnngatcgagacttttgccattttaattcgaagatgataagatattaaatagtaagtgtaagaaggccaatgatagcaagaagataaaagagaaat

SEQ ID NO: 19451 - DNA, 607 bp, Diabrotica virgifera
  misc_feature (29)..(29): n is a, c, g, or t
  misc_feature (54)..(54): n is a, c, g, or t
  misc_feature (56)..(56): n is a, c, g, or t
  misc_feature (68)..(68): n is a, c, g, or t
  misc_feature (130)..(130): n is a, c, g, or t
  misc_feature (237)..(237): n is a, c, g, or t
  misc_feature (284)..(284): n is a, c, g, or t
  misc_feature (312)..(312): n is a, c, g, or t
  misc_feature (352)..(373): n is a, c, g, or t
actatacaggggaagatgaggactagaanaggagcaaagcatactaagtgttgntntatgaatatttnttggtagaagggtaagagttaaagaagatggaagtgtatgtattttcccctatagaggatangaagtagtaataataaagagtgttggagataaaagtgaagtagaagttgttatgagaagtggaaagagaagaagatagatgttgaaagttggggaatgaattagaantggagaagttattgagggttgtagtgtagatggtgtttttgtttatnaaaagtaaaaagaagatgatattattantgatattttgggtgagtatgaaggtattgttgatgatttnnnnnnnnnnnnnnnnnnnnnnagaattgaaatgtgaggtgaagttggagttattaatgaaagtatataggatgtaataagaaagtgggatagtgaatatggtatggaaggaattagtgagattgtttttgtgttaggagtatgtactgttggggaatatgttgaagaagtaggagatgttatggatattggataaaatttgtaatatggaaaaaaaagaaattggggttttgaggaaggattgttgtagaattat

SEQ ID NO: 19452 - DNA, 731 bp, Diabrotica virgifera
  misc_feature (23)..(23): n is a, c, g, or t
  misc_feature (29)..(29): n is a, c, g, or t
  misc_feature (145)..(146): n is a, c, g, or t
  misc_feature (223)..(249): n is a, c, g, or t
  misc_feature (471)..(526): n is a, c, g, or t
  misc_feature (573)..(591): n is a, c, g, or t
accggcggatattgtttgtccgntgtagnttttcccatgctccctgagtcattttcaagtaaattgagtcataacatggggtgaaacgcacgccgatgtgtgtagtatatagtttactttatagaaaatgcatatatgttgcagnncaagaggattagccagttggagttgactattcctagttcgagtcaactcaaacggctggttttagtaaaagttgatnnnnnnnnnnnnnnnnnnnnnnnnnnncaacgtttactagtaaaagtagactccaactagaaaaagtatactcttcccaatgccatttagtaaaagttgattcacacaaacaaacgattctagaaattaaatgtgactggatatgtttatatctggatatgtaagtaaatcagagtgaatctgcgccccaggtaaggaaattaatcccgaatcaaaattattgcataaaaattaatcaaaaaaaagagnnnnnnnnnnnnnnnnnnnnnnnnnnnnnnnnnnnnnnnnnnnnnnnnnnnnnnnnttatatggaattgtacacacgacgtaaaagtccaaaaaaggaaatcnnnnnnnnnnnnnnnnnnngaatgcttgtcagaataaaaataaaaacgggaaaacaataaaaaaaccgtgtaataatacaaacgggccgaaaaaattaaaataaagggaacccctacacccccccaacaaaaaaagagacaaagatccaaactttctag

SEQ ID NO: 19453 - DNA, 780 bp, Diabrotica virgifera
  misc_feature (238)..(263): n is a, c, g, or t
  misc_feature (421)..(438): n is a, c, g, or t
  misc_feature (561)..(587): n is a, c, g, or t
  misc_feature (757)..(761): n is a, c, g, or t
  misc_feature (763)..(767): n is a, c, g, or t
  misc_feature (769)..(778): n is a, c, g, or t
aatggtatggacacattaacagaatggatcagggaagactaccaaagcaggtgatggaatcgaaaagatatggtaaaagaaggaaagggaggccaaggaagagatggatcgatcagattatagaaattggacaggaaaaaggaaaaacacatcaacaaatgaaagagttagcaaagaaccgcaagaaatggaagagatggatagaagatgaataaaacctccgaaggagtttcgagannnnnnnnnnnnnnnnnnnnnnnnnngttttctcaggattcgaaaaaaaatgaacacattgaaagttttgacatgcttcaaagttttgcattttgctctgtttccctgaagtgtttaaatgaagattttttgattgtgatattcaagttaaaaactatctcttgataatttctgaaataattgnnnnnnnnnnnnnnnnnnggaaacacgaaatttgataatttgacggttcgaacatttaaatttgaaaactgaccaatacgtctgtaatattattagaaaaaataggattgctttggacctcctgtagtctaatgtatatcnnnnnnnnnnnnnnnnnnnnnnnnnnngtattatcatcataatattatattgactaaagacaaaatgactgtacttttaatttattttcctggttatagttgtaaacgattgaatttttaagtaacatttattcactggttatttacatttgtattatgtaaattcaatctattttttttcataaattgttatcttnnnnnannnnnannnnnnnnnnaa

SEQ ID NO: 19454 - DNA, 63 bp, Diabrotica virgifera
ttgttccccccccgaaaaccctgggggaaaagaaaaaaaaggttgaaaaatcaaatggggggg

SEQ ID NO: 19455 - DNA, 133 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (105)..(105): n is a, c, g, or t
  misc_feature (110)..(131): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgntcgannnnnnnnnnnnnnnnnnnnnnag

SEQ ID NO: 19456 - DNA, 60 bp, Diabrotica virgifera
  misc_feature (34)..(51): n is a, c, g, or t
tccttggtttttggttccccccaaaaaacgcggnnnnnnnnnnnnnnnnnngttggaaga

SEQ ID NO: 19457 - DNA, 719 bp, Diabrotica virgifera
  misc_feature (33)..(50): n is a, c, g, or t
  misc_feature (411)..(428): n is a, c, g, or t
tttcgccttcgattcgattttgtacgcgtttgnnnnnnnnnnnnnnnnnncgtgatatattactacacccccttgtgatatttcgtgattttttatggaccgctcgccccctttcgaacctcgcgtgattaatggacagcccctaagaagttgtcctatatcatattttatcttattgtcctgtagtgtttttgtttcctttacaattgtctagactgacgggttctgtggttttttctcaagttactttatccaatttttaggtattgtttttttcttccttctcaacacttttctcgtttctgttctaattatattctcatttgttggtcttgttagtagcttcattcttttgttagtttttagctttaacctttgttcacattcctggtcaaaccactttttttctcnnnnnnnnnnnnnnnnnngtctgaaacctattttttatttgcaattagtattcttggtctttctcatgtgattcaagattctctatattccactccttgtattgtgagttctgttttgttactactactgattctatctaaaatatattgtggattctgatcaaattactgggtaaattctttacttggttgttcattactagagagcgggatatatggcacacaacattaccaaaatatgcgcatatatatgcattattttttactacaaatatgcagtatttttttctaaaattggcctaaatatgc

SEQ ID NO: 19458 - DNA, 823 bp, Diabrotica virgifera
  misc_feature (6)..(23): n is a, c, g, or t
  misc_feature (31)..(51): n is a, c, g, or t
  misc_feature (81)..(148): n is a, c, g, or t
  misc_feature (150)..(162): n is a, c, g, or t
  misc_feature (213)..(232): n is a, c, g, or t
  misc_feature (243)..(274): n is a, c, g, or t
  misc_feature (277)..(305): n is a, c, g, or t
  misc_feature (313)..(353): n is a, c, g, or t
  misc_feature (361)..(374): n is a, c, g, or t
  misc_feature (376)..(406): n is a, c, g, or t
  misc_feature (444)..(462): n is a, c, g, or t
  misc_feature (490)..(541): n is a, c, g, or t
  misc_feature (551)..(590): n is a, c, g, or t
  misc_feature (654)..(681): n is a, c, g, or t
  misc_feature (694)..(755): n is a, c, g, or t
  misc_feature (772)..(791): n is a, c, g, or t
  misc_feature (797)..(815): n is a, c, g, or t
ggattnnnnnnnnnnnnnnnnnncgtaagcnnnnnnnnnnnnnnnnnnnnngtttagaatttattgtaattgctttatatnnnnnnnnnnnnnnnnnnnnnnnnnnnnnnnnnnnnnnnnnnnnnnnnnnnnnnnnnnnnnnnnnnnnannnnnnnnnnnnngttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggttgaggttatcaaccagaacgtttagaggctgnnnnnnnnnnnnnnnnnnnnnnnnnnnnaatatcattaccnnnnnnnnnnnnnnnnnnnnnnnnnnnnnnnnnnnnnnnnnnnnnnnnnnnnnnnnnnnnnnatttaagtttaaatagnnnnnnnnnnnnnnnnnnnntaaatnnnnnnnnnnnnnnnnnnnttctatat

SEQ ID NO: 19459 - DNA, 956 bp, Diabrotica virgifera
  misc_feature (816)..(816): n is a, c, g, or t
  misc_feature (823)..(823): n is a, c, g, or t
  misc_feature (858)..(889): n is a, c, g, or t
  misc_feature (896)..(896): n is a, c, g, or t
  misc_feature (907)..(907): n is a, c, g, or t
atgatttcttgatcaggatataacctaacataaccttattttattttatatgtaagattaaatttaaacctatgtagttttttaaatgcgtcattatatatgtttttacccaaaaagaagtagtcagtgtatctattgattgagatatacttttatgtccacaaataaatttaatcacggaagttttctgtaagtgacagaatcagttttatgatccatgacagtaatcctcacttaacattacctcaatatacttccaattccaattttttcttcatctttgtttgcctgcgtaaagaaacactcgttctaagggaatgatcaatttatttggacaaacaaaagcatagtatacgaaatgaaggcatacattttatcttgttgtcttcactacgtttctgccatggacatataatacctggactgtgtactgctgtctagggttgttcccctagtgcgacggagaaacatgtttgtgtttgggggggacatccctttctggtcgacggggtttatcacgtggtcgataaccaaacgtcattggatagaccccgcccattggagggggatgcctgccctaaatacaaacatttttctttgtcgcactggtcgcacagttttagattgcagagcgcagtctaggtattatgtgtctatggtatcttcatatattgttgaaaattcttgcttgagtgatccaagtactaagacaatcctttgtcgccttatgtcatatattataagttcctgctcatatctctatgtatatacctactgactttgaaaaatgaaggtaaaaatggtaaactaagcttnccttctngtgtattggtaaagaactgtgtccagtctgatgannnnnnnnnnnnnnnnnnnnnnnnnnnnnnnngtgcacngtatttcctanagtctatttatttacagtagttaaatagtttttccttttatatatacac

SEQ ID NO: 19460 - DNA, 852 bp, Diabrotica virgifera
  misc_feature (230)..(264): n is a, c, g, or t
  misc_feature (688)..(705): n is a, c, g, or t
  misc_feature (824)..(824): n is a, c, g, or t
cgaaaattgttttgcagttgatgattttttgcacccggaatataagttttctttttaaattttttgtactttattttcagttttatccgtgtataacttgtgataaaaaaaccttagcaaatttataggcgttatggaagaagtactattgtacttcaaagtacctcctagaagccactagaatcagaatacttgaaacatacataggtcaaactagttggtataataannnnnnnnnnnnnnnnnnnnnnnnnnnnnnnnnnntttgaaagtatcatagaattctctaatagatcaaatctaccgctgctaactagccttttatagagaaattctagtattgtcaatactacatccagttttctaaaaacgtagattataatgtataaaacataaatcattcgtatcatgaaacataacgtcgacaaacacaattgctgcaattgtaggcaaccggtaacacacagtgtattggttgccacactgttgtacaattatatttatacacaatttacagtaacttttgtattttgaagtatttgattcttgtgaaaaatatactaataaaagtgtgatttttaccaaggtctgtcagcttgcatgtacagtttgtttttgaatcattttcaaagtttacatgtgcaataatatattatgacagttaggaggcaagctgagagattagtgnnnnnnnnnnnnnnnnnngtactataacctagtgatgttacaagtcatgtgcttaacgaagaaacaatttacttttatttcactccggcaaatgattttaatcaaattagataggtagaacaatcaagatgcaaacnaacggataaaacaaaatgacaaaaatca

SEQ ID NO: 19461 - DNA, 901 bp, Diabrotica virgifera
gtaatatggtccacatatattttgtttgtgatcttctccgggctctagctccttgcatcatcccctgtaatgtcagcttcttcagaccatctcttcgcaccacatgaccaaagtaagcagtgatttttttgaggcctacctgtaacgtctataatgcgtttatcaacttcctttaaataccattcagatccaatagaaaaatgtagaaggtcattgtttttaccaagccttatatttgtatccatggtgatgttctggcttttccatactttggtgagctttatcattgacggccatgcttccgaactgactcgttctatttgttctaacatatccgtcaattcttccaaggattcgacaataagcgttgtattgtatcatctgcataagttgttgattcttctgccgccaatggatatgccctgttcccagtaacagttccctaaacaaccccagtaacacgatcctgccaggtcaccatatgccgatcttggtactgggggttggtacccccgatgatggggttgattaagttgaaaacactatttaccagatatatttatttggaacactaaatacgccaataactagttggtgaacaaagtctatgatctaacaccgtcgatgtctgaataatgaatcaatccctcttttaatttctccgtatctataaataaatcgtaattgttttgttatggttgactacacccgaatgtgaccgtgaattactaataatattagaatcgctgacttcggagttttcaaaacgagtggcctacattgcaacatcaatgtcacccatttacgtaatgtaacaatgcatgtagacaatgtttgtttaagacttttaaaaataaatcgatatggagtactcttattttttgatgctaatataaatcct

SEQ ID NO: 19462 - DNA, 931 bp, Diabrotica virgifera
  misc_feature (54)..(72): n is a, c, g, or t
  misc_feature (428)..(447): n is a, c, g, or t
agcaaagtgaagatatactaatatacttttatgttgcttttattctaactttannnnnnnnnnnnnnnnnnngtagcatttattagtataaaactacaaacatgtattattaaacagttatattttgtaacgatattcctaccttaagagagatcagatgtaaaaatctacaatgttacttaaactcttagaaaacaaatattgcatttttggcttaactgctctagctataataccatggaagatattttacagcaaatataaatattatcaaaatcagtatgaagagaagttgttattccaaaataggcataattgtgttgttacttacacagctacaaaaggaattgctggatggcccccacataatgatagaatactacctgacattacatccaaagacggtctgtgtgctctgtatgacccgnnnnnnnnnnnnnnnnnnnnttcagaaaagagtatagacgtagcttacatgttcattttgattcaagaaattcttgatgcactagtagaagctcatgaacgcggagttaaagttcgtatattattaaattttgaacataacaagactgatactggacctatccataaattaatcagtaaaggaattaaggttcagctttatatgtaccccaaacaaaacctagaaagcatcatgcattataaatatatggtaaaggactacatcgaggaaaaagaaggatatacattgataagttccttgaatattagtataactgcattcacagaaaattatgaaaacgtagttctcagttctgactactacttagctacatctatacacaagaactttgaggattgttggaactatgttgaacaagaaaatcagagtcttctaaacaaaactatactggtagatcttatttaatatgattgttggccattttttttatcatatattactggt

SEQ ID NO: 19463 - DNA, 62 bp, Diabrotica virgifera
  misc_feature (6)..(7): n is a, c, g, or t
  misc_feature (10)..(61): n is a, c, g, or t
atgagnnggnnnnnnnnnnnnnnnnnnnnnnnnnnnnnnnnnnnnnnnnnnnnnnnnnnnng

SEQ ID NO: 19464 - DNA, 819 bp, Diabrotica virgifera
  misc_feature (286)..(303): n is a, c, g, or t
attatggtcaaaatgtaattttaaaacaaaaaaatgggtgaagattgtgatcctctggaccttctgttgttagcagcagctgaagaactagaagactcatctaagaaccaaataaaaccaaaatctttaaaagaaactaacttatttgaacaggaatctaatattaatattaaacctcttgccacaacaacaaacaatagtataattcatacaggagatacagactcatcagacgacgaagacagacgaaactgggaagaaaagaagtatacagaaagtggtagannnnnnnnnnnnnnnnnngatgttcccacaaaaataggcagcaacaaaagccgaatatctagagtatccaattggaagaaaccctcagtatctgttgtaaaagaaactaataaaaagactgtgaatcctttgactaatccgaatccctcagtattctcacaagccgatgtaatattcggaattcgtgttattaacccactagtttcatctgcagtgatcgcagagcgaatgataggtcgtgaagctatacagtttaacaggttgggtagatttttacagataaaaactgacgaaaaagactgggtaatagcgggagttgtggttcacaaaagcgctgctaagacgtcacaaaaggtaaccagttcagcgtatggactttaactgatttaagagacgatattaaaacagtagcagtgtttctatttggaggagctcatggacagttatggaaaacgagtgttggtaccgttgtagggctgcttaatcctaatgttttggagaaaaagaagggagagatgaggcaagtctcagcat

SEQ ID NO: 19465 - DNA, 733 bp, Diabrotica virgifera
gtgggccggctggaggcggcgcgggagttctccgcgggaccccccttttgagccgactcttttctgtatatgaatgacatggttgctcttcttattgtccttgttatcatcgtaactgtttctgatgatggagcagtatctctcttctattctagaggataccgactcgctatcagccagatagtatctgatctaagacttcccgaggctgatctgagtatccaacacggaataaagcatatgttaccaatagtgaatacaagtgagaatgaagcaagctatagtccggctaatgctcgctgtggtttcagcgtcaccagctagaccaagatgatattctaactgtgatttttcgtacgcatgaaggctctcttgaggacactacttactatgtgcttcttcagaggacttaattgacaagtgagggtgaagtcagacaaacaaaccatctacagagctcttaaaacctgagtatgtgaacaccgacatgcatagggctatagttattgcccccgatctaagagctcaatgccttagcggatttgaagattatgacactagtagagatgacttctgcataacatttgccgaacagatagatcaaccaccgatggctttgactgagatagttagatattctgattacagatacctctattcctcaattcgttgtcaaattaaagttcaaaagaagaactggtcattgtttttttagcggtttgtttttacccca

SEQ ID NO: 19466 - DNA, 998 bp, Diabrotica virgifera
  misc_feature (720)..(720): n is a, c, g, or t
  misc_feature (784)..(802): n is a, c, g, or t
  misc_feature (867)..(867): n is a, c, g, or t
  misc_feature (932)..(932): n is a, c, g, or t
ggttatgctacctcgtgcttgcgacagtattattatcaaaatggggggtggggacggttgtaacgattttcatggggacggttgtaacagtaattttaattgtaaaccggcgttactacagtacataagcctgacagggttgttgcaagacgtggcacaaggcaggtgggtgcaattacttctgctgaacgaggctctttggtcacactagcatttgcagctaacgcattaggcaacgccattccacccatgttcgtgtttcctcgaattagatatcaagagtatttcattagagacggaccagtggaatcaatcggtgccggtaatccatcagggtggatgcaagaaaagtcattcattatatttcttaaacattttcaaaaacatacgaatgcctctttgtcgcataagatattattagtgctagacaatcattcgccccatatacatatcaactccttagattgttgcaaagataatgggatagtattactgtcatttccgccccactgctctcacaagctacagcccttagatagatccgtttatgggcctttcaaaaaagccattaatactgcctgtgatgcctggatgcgaaatcacccaggaaaagtcatgactatttacgacataccgggtattgtaactatcgcaatgccacttgttttcactcaggtgaatatccaggccggatttcgaaagagagggatcttcccattncaccgcgatttgtttcaagtaattgattctgcgccatcgttcgcgacagacaggcctaatccannnnnnnnnnnnnnnnnnngcatttctaatcaacatagcattagacttgctcctgatgacgaatcactatcaccttcgttactngaggaggattcacctttcatcagcgcagtaagccccactgagcccgaaactagagctttcactanagaatttactaacagtgatcctaaaagggaacattcattgaccgtcaaatgctcacactaattgaa

SEQ ID NO: 19467 - DNA, 374 bp, Diabrotica virgifera
cccctccaccctttttgaccgcagaggttacgatggaacgcctggatttgaaggtttatgagaccacctggtcttaaaggagatgctggtattccccgacaatctggaagatcgataattccaggtcaatagggtgacaaaggtacagcgtgcacttcaaggaggtccaggtccagaaggagatagaggatttcctggaattcatgggttaccagcatagaggtgacctggatgcctctgactcaataccagtagttcacgttactgaagggagccaaaggtgagataggattcagtggtattgccagatcgccggtgctacagggataaaaaggagatgtacgtatcaaaggagaaatatgaattcttggtac

SEQ ID NO: 19468 - DNA, 701 bp, Diabrotica virgifera
tacgcctgcagggaccgcggcaggaattcccgggcccgccccctttgtccgattgacttttaagatcatagatgataaacataacagtatctcttatctttataggtataaagttaggagataaacttattcctatggtgttgagtgacttgatctttatgatatgcttttacccttattgaagcttgtgtctgatggattgctagagataaactatatacgacatgatatacttgtatacatgagactcttctcacagtgtctaaatgagatgtatgatcaaagatagtattcatgtattgacatgtgcttaatttatttccgtatccaattttttattcatctctgttagtctatgtattaaaactattcgtataatatagatagatttatattattattgctcactaattataggaggccaattgaaagcatacatttgatgttattgaattcattatgtcacttccatgtacagatgctcccatggatgtgtgatggtgtgacctaggttgattccctaccacgtctatccgtcatgtctgagtatgcatgcaatatcactgactggcctacctcgttaatgatgtgcacagataacttaacaatctgggaaagaaccacgaccataggagatggatgaatgaactcactaacaactttttactttgcctcagtgaaacctgcggttttagagtgca

SEQ ID NO: 19469 - DNA, 794 bp, Diabrotica virgifera
  misc_feature (158)..(179): n is a, c, g, or t
  misc_feature (273)..(290): n is a, c, g, or t
gttttggtgttgtgtttgattttaggtcaaattatttattacttccttaactttctataatacattagtgataaacaagaacaagctccagacggctccagttattgatattgtgtgattaaaactgtaaaatattatcagtttcaaatttttacatnnnnnnnnnnnnnnnnnnnnnnggctttaaggttataatttaaagaattacattttaaagatgaaggacgttatcgatgtaatggaactgcaacgtgagaagtcccggaagaacgnnnnnnnnnnnnnnnnnncgcttgagttcaataatggatacacggctgccaggtttatattcgaatgtggcattaagttaaatggacaaccacttacagtggccactgctgccatcattatgcaccgattctttaaagaagttgatcctaccaattatgatccgtttttgatagcttcttccgcactatacctggcaggaaaagtcaaagatgatcccctgaaaattagagatattatcaacgtagctcacaatacactgcatagaggaagcagtctactggaaattggcgacgaatattggagtatgagagacgccattgttcaagccgaattgttaataatgagaatattgaagttcgaagtcagtacaactcatccccacaagttcatgttacattatctgaggtccatggaagggtgggttgggtaaagaacagttggaaagcgtcccagtagcaagagcagcagcaactttccttccagactaccaccacgatcccagtatccttgactatgaccct

SEQ ID NO: 19470 - DNA, 878 bp, Diabrotica virgifera
  misc_feature (816)..(816): n is a, c, g, or t
  misc_feature (852)..(874): n is a, c, g, or t
gtgattttttgctagtgtaaactcagtgcgactgaaggtcttcgaatttacaaaaatggagaaaacttctctcttaggtaatatgaaaaccaagcaaccacccgtgggatcccccatcatgaaatccatcgatcccaacatcaacaacaaacccgaatataacaacgcatgcggggacaagttacctgaaggccttatgtcgttagatgtaaccgctgacatagacgatgagtacaaaagtactctactcctcgacgacaacgaaaaccttaggatacattcggaagaggagttcctcaaagctttgaacattccaccgaatgaaaaagttaaagtggtgtcaattttcggaaataccggtgacgggaaatcgtatacgttaaataaagtgttttttgacggcgaggaagtgttcaagacctcttcttcgcaggattcttgtactctgggtgtgtgggcaatgtataatgcgaagatgaaggtgatttttgtcgatactgaaggattcttgggtatatcaaaacgagaacaccaacggactcgactgctactcaaagtattggcgatatcagatattattatatatagaactagagcagaaagaattcagcgagatatgtatacttttctcggaggtgcttctaaggcttacaaggaccattttagttctgccttaaggaaggccttgaataaggcggacgctcaacaatttgctggtgcgcttggacctggcgttattattttccatgaaactaggcacacggatactttacacgtgaagtcaaaggtaacgcagtccactgaggacattctcanggcggactttgcagcggtgggattgtcgtacgatgnnnnnnnnnnnnnnnnnnnnnnncggg

SEQ ID NO: 19471 - DNA, 642 bp, Diabrotica virgifera
  misc_feature (12)..(51): n is a, c, g, or t
  misc_feature (152)..(175): n is a, c, g, or t
  misc_feature (391)..(414): n is a, c, g, or t
  misc_feature (427)..(444): n is a, c, g, or t
  misc_feature (478)..(500): n is a, c, g, or t
gattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttatgaataatttatgctataatagcaattggcttattaggttttattgcttgagctcatcatatatttacagtaggaatggatgttgatactcaagctcattttatctcaggaacgataactattgggtgga

SEQ ID NO: 19472 - DNA, 147 bp, Diabrotica virgifera
tcactcactataaaagaaaggtaggacggctggaggggcggggaggaatgggcggcccccccttccgacagaatacgactacatcgatctctgctactgcccccttactaggccggatagtacgaaaaaacatgagacaaatcggag

SEQ ID NO: 19473 - DNA, 390 bp, Diabrotica virgifera
  misc_feature (2)..(37): n is a, c, g, or t
  misc_feature (40)..(60): n is a, c, g, or t
  misc_feature (67)..(120): n is a, c, g, or t
  misc_feature (139)..(275): n is a, c, g, or t
  misc_feature (286)..(332): n is a, c, g, or t
  misc_feature (342)..(387): n is a, c, g, or t
cnnnnnnnnnnnnnnnnnnnnnnnnnnnnnnnnnnnnttnnnnnnnnnnnnnnnnnnnnngggatgnnnnnnnnnnnnnnnnnnnnnnnnnnnnnnnnnnnnnnnnnnnnnnnnnnnnnnggttgaaaaatttcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggttaatnnnnnnnnnnnnnnnnnnnnnnnnnnnnnnnnnnnnnnnnnnnnnnnggtttttttnnnnnnnnnnnnnnnnnnnnnnnnnnnnnnnnnnnnnnnnnnnnnnggg

SEQ ID NO: 19474 - DNA, 509 bp, Diabrotica virgifera
  misc_feature (116)..(136): n is a, c, g, or t
aaagagaggggaacaaaagcaaaaggggacaggagcaagcacgccaagcccgagagacccaaacgcaaagccgaacaagacaaacaaaaccggggagacaacaaaaaccaagagannnnnnnnnnnnnnnnnnnnncagcagcagctataatccacagtgtaattacagctggcacttgtatatactttgtgatacttagacttcaaaattcggtactatcctaatagtggacttgaacttatacctgtaataacttgaggcttctaacgagtactgcctatagtttatgcggtaaaaggattcaagccatcttagactacattggtttactactacagaggaacctcgataacaccgtattaatacgggtatcgaaaaaacgggacagccggagagcatggtaaaagttacttaaagactgcaaacttatagatacgagaagctattgttaagataaattgaatattatatatatgaagaagacgcctctaacttacctataatttgt

SEQ ID NO: 19475 - DNA, 678 bp, Diabrotica virgifera
  misc_feature (8)..(614): n is a, c, g, or t
ttctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttccctggttattaaaacattgctttttgcataaaataaaaaggcccccctgccccct

SEQ ID NO: 19476 - DNA, 611 bp, Diabrotica virgifera
gatagtttagagtctgtaaatgctctcacaactccgtctcctaacgacaaccagttccaagacttataccaagtaaaagaactgttaatggtaggcttaggaaacaatggctcaagaccagtgttgctggtacgtcttcagaaagatttatatatttacgaagtatttagatttcccagaggaaatttaaaattgaggttcaagaagatgaagcataatattttatacagtcctaacgtagataccggtgtcgaaactgaaaattccgattattttgctctacaagagaagattatgcggttaagatattttgataatattgctggctataacggagtgtttatttgcggagcaaatcctcactggctctttttgacgtctcgaggagaactaagaactcatccgatggtgattgatggtgaaattttcagctttgctcagttcaataatattaactgtcctcaaggttttctgtattttaacaaaaagtcagaacttagaatcggtgtgttaccaacacatttgacgtacgacgctccttggcctgtaagaaaagtaccgttaagatgtactccacactttggaacgtatcacttggaaactaaaaccta

SEQ ID NO: 19477 - DNA, 831 bp, Diabrotica virgifera
catgatggtaatatttattgcacaatatcaattaatattgatcaaaatcttgttctaccacaaactattgaaattgagggggtcaaacgtaaaagggttcaagtgcaagtttgatagttctgagataatcaatttcaaagttgtttaagttttataaattctgggagtcattaaacatcatgtgacgtgcaagatgtagtaagtaacagcatcagctattatccacagtgtaactacaactggcacgttgcataatacttttgcataattagtcttcaaaattcggtacaaacctaatagtgtacttgaaattaatcctgtattaacatgaggtttttacagagtactgaaaatagttttgtggtaaaatgattcaagcccacttacctacatccgtttactactacagtggaacctcgataacccggattaatcgggttatcgaaaatccgggttagccggagagcatggtaaaagttaataaaatacggtatacttatagataaagtccgttataattaaaataacatgaaatatattatatatgcacagtacacatcaaccttacctatagttgtatatagtatagtatatagagtattgttcatttctaggtaaaaaaactcagtcagtttcggttgtgccaataggaacgatgtgatgttattttagaacattggctctttcattgtttaaaagaccattgtaagaattttttaaaagacagttggaaataaatcaaagaatatcaggtgcctgttgtttgcgatagcccgaaataatgaacgtcgctctaccgccgcagccgtgtgccatgagtcatttttacat

SEQ ID NO: 19478 - DNA, 265 bp, Diabrotica virgifera
  misc_feature (122)..(260): n is a, c, g, or t
cggacgcgtgggcttagggataacagcgttattttcttaaagagttcttatcgataagaaagtttgcgacctcgatgttggattaaaataagtgataggagcagaatattatttactaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttt

SEQ ID NO: 19479 - DNA, 926 bp, Diabrotica virgifera
  misc_feature (38)..(50): n is a, c, g, or t
  misc_feature (52)..(70): n is a, c, g, or t
  misc_feature (796)..(796): n is a, c, g, or t
  misc_feature (853)..(854): n is a, c, g, or t
  misc_feature (881)..(881): n is a, c, g, or t
ccattgatggatgtacgatgtacttaaatgttattcgnnnnnnnnnnnnntnnnnnnnnnnnnnnnnnnnagtatttttgccgccctctcataatttgccgccctaggcaactgcctattgcctaatggataaagcagccctgactagatcagtaaagtctgactcaaacggctcatctacttggggaataatcgttacttgcatatatttgccatgttgtgtgagtgggttactagtacaattatttgtcactcgttggttttttatttgttgtcggtaaaaatgacccaagtcaaagagatcacgattattcttacacttgccgagtacatacttgtctatttttgcagaggcgcttaaacgaaatgcacaaataattggcatatactgcgactgctgatggagatattaaccaatattggaataaacacatatatagaaaaagaatatcagagaagattgctgataatgaaatactagaaaatgataacatcgatgaaagctgggaaaaacttaaacgtaacataattaacgcagcaacagaatcacttggagagaggaaagtaacgaataccaatatatcaaaaaagaaaacctcatggtttcgagaggaagtgaagataaaatgttaagaaaagaagaaagcctttttacaatacagaacacaacaaacacaacaggcgtacaaccactataaaagaattataaacgaaacaaacactttagtcagacaaataaaaagagaacactgggagagtttctcaaaacagatggaacacgatttctatggaacancaaaggaaatatggagaaatatcagaggacaagaaaagagatgaacgaactaataannaacgaacacattcagaaggaaacttgngcagactattttcgatctctgtttgctaaagataactatacgaac

SEQ ID NO: 19480 - DNA, 790 bp, Diabrotica virgifera
  misc_feature (178)..(217): n is a, c, g, or t
  misc_feature (386)..(407): n is a, c, g, or t
  misc_feature (738)..(755): n is a, c, g, or t
  misc_feature (760)..(780): n is a, c, g, or t
gatgaattggtgactgtgtgtggtggatgtatcatcagacatatcaaagctaagataagatgggcaggtcatgtggtaagatcaaaggaagacagagtgttaaagacagtgtttttggaacacttttttttgtaaatatggaaggatgatgaagaattgaagtatcctgaaatagtannnnnnnnnnnnnnnnnnnnnnnnnnnnnnnnnnnnnnnntgaaccattttatttcactttaaaattcgtgaaattcaaatactgagagaaaaattgaatacttttttacactttttaaataattgtttagttgcggctcgcgaaaaattccaaattttgaaaaatggctcggattatcaaggaacttggccacccctgattataaccnnnnnnnnnnnnnnnnnnnnnngaactggcactggtgggttgagttggggtgcgttctcacctattggggtggaggcgcgttggcacttgttcttcttgctacactttatatttatgacggtcagtttgacaatattgagtgaccttcttttgaaaaaaactttgagaaaatttggtttaaaagacagtttaaagattgatagaaaaatgtctacttttgaattacataaacaggtttgttttcttttttaattgaagaattttgctgttaaaatttccgtcccaaaagaattcaattgtggtttggaactaattattttggatggtggttttattcttttgttcccaattgnnnnnnnnnnnnnnnnnnggacnnnnnnnnnnnnnnnnnnnnncttaaaaacc

SEQ ID NO: 19481 - DNA, 814 bp, Diabrotica virgifera
ctctagaggctacacctgcaggtactggtaccggaatccccagggtgcgaccctttttgtgcgggtacgactgtcttcattcgcgtctctttctatttaagtcctatacagaggatgcctctatcatccctatttggctcgcacatttaaagagagaggaacatggtgatgccgcgctcaccacactctacatgatacgggatgaccctcttcaacctggttaccaatggctaacaattggatgtcattctcacgagaccatttactaaagccccaatgtccactgaggcattataactgtagaatataatagctaatgatagaccactctcgtatgtaggggagattaccccactaaccggctagttcacatttacaccgcattcttgagcccgtactaatgtatcgttgtccacaccaaatactactgctcatccactagacagataaaattaatggaatctgcgctcataagagacgtcatccactaccacatcgtaaactgttatctggaattatgtgtgcagctgatgacagcctttgtacaccgtgcattgacaagatagtctttgtcattactcggcatataatgaatatgctctgtgactcgcggattgcgagctagatggaagcatgcgaactgggaaactctactgagactatatccaagactattctcaggacaaacatctatcacattctccgtgtcctgtgacatcttctgattagcgtacgtaaggtatatagcgtctacttcagatgcgacttcaacactatatatcgggagaatatcgtattgaataactattgaaca

SEQ ID NO: 19482 - DNA, 477 bp, Diabrotica virgifera
attcaacccacctatccgaatgagttgttaccgactatctacctcctctggatatttctcgtaatgcatttctcgatatctgcatttgttatgttgatggatcatgacatcttcataataccttgcgggaaactatttccaacatcttctccttatttttccgtctctgacttgtcatgcatcacgcccatattcccgtaaaggaatattgatatgattatactgcaagatcgtgctaaggctattataagatcagatatgatatttcaagatatcataactaatgtagacacacgtcctttatcctattctatgaataatgtagaactgaacgccacataatagctttctatacaatcattgaagctctattgtttcttcttcttaagatcttctaggatattgttaaaaatatcttgcatgatttactacaaatcacatatgcactagcataatagaggactgtatgaattacaa

SEQ ID NO: 19483 - DNA, 102 bp, Diabrotica virgifera
  misc_feature (11)..(52): n is a, c, g, or t
  misc_feature (56)..(56): n is a, c, g, or t
  misc_feature (68)..(68): n is a, c, g, or t
  misc_feature (73)..(73): n is a, c, g, or t
  misc_feature (75)..(98): n is a, c, g, or t
catttttttannnnnnnnnnnnnnnnnnnnnnnnnnnnnnnnnnnnnnnnnngttnttttagtattanatttnannnnnnnnnnnnnnnnnnnnnnnnggtg

SEQ ID NO: 19484 - DNA, 711 bp, Diabrotica virgifera
  misc_feature (9)..(9): n is a, c, g, or t
  misc_feature (667)..(669): n is a, c, g, or t
  misc_feature (691)..(691): n is a, c, g, or t
cccacaggnggtaaaattaattttgatctgaatttttataaaacccccccacaaaagtaaagaaaaagcaaaataaaactaatgcaatagaaaatttagaagattattccaaagaggaactaactcaaaaaatcaaaacattgtcagctcataacttccagttaaaaaacttgctttcaaaaagtacagcaacagcatctggggagaagcctgtaaaacagaccaaaccatttgatttttccaggtatcaatttcaacatatagccctacactttttatatttgggctggaattacaaaggttttgttgtgcaagaagatactacagatacagtggaatatcatctattccaggctctacagagaacaaaacttattccagatagagaatcttccaattaccacagatgtggcaggacagataaaggagttagttcattcggacaagttatttcattagatttaagaactaatgtgttgaaagctgatccttatgagtcaagtagtccattaaactattgtaaactgttgaacagagaactgccggatgatatacaatgtgttggttggagcgctgtagatgagagttttagtgcaagaattgatttgtagtccaggacctatagatattattttcccagaggggacagtaacttagagagaatgannnatagcacagaaaaattgatggngtccacgacttcagaaattt

SEQ ID NO: 19485 - DNA, 517 bp, Diabrotica virgifera
atgatctatgatttatttggtaattttcaactacaaagaataacatttttgatcttttataacataaaatagatactatttaaattgacacagtcgtaaaagctaacgaaatacgttgtatttctatatggtaacggaataacacattcttaactagctgtaactgacacctacacctaaaagattaataaataattaactgacaattaagatatgtttagtctcttcttgtcagattctgtctgcatctgttgtatggcgttaaagaattcgtcaacgataccgtcgcagtcagcttgggtgggtacagaagctacatcgcccacgaaacccaaatgaagtcggtgatcgtaactgatgacagcaaatccagtagccatctgatctctttgaagagtaaaaaagtatgcgtcttctacttcatgtccgttaaatattataagcttgtggacatcaacgcaaacaacagacaacctcaggctatatgataaacgttttgcaccagcatgatttataa

SEQ ID NO: 19486 - DNA, 622 bp, Diabrotica virgifera
  misc_feature (27)..(27): n is a, c, g, or t
  misc_feature (30)..(30): n is a, c, g, or t
  misc_feature (33)..(33): n is a, c, g, or t
  misc_feature (41)..(41): n is a, c, g, or t
  misc_feature (52)..(86): n is a, c, g, or t
  misc_feature (393)..(414): n is a, c, g, or t
  misc_feature (425)..(443): n is a, c, g, or t
  misc_feature (501)..(501): n is a, c, g, or t
tcttcagagtgttttttttttttcgantgnttnttgggttngttcttagggnnnnnnnnnnnnnnnnnnnnnnnnnnnnnnnnnnngttcgggggcgtctgtggcagttgttttttttctttgagggaagtgggggtaggagagaaggagagagggagggagagggggggggggatggtagaattgttgttttttggtatgggtgtggtagtagaaggttgtatggggtttttagtgtatgttgtgttttggttaggatgtattgatgtgtgggatttggggggtgatggagagtttttttattggtgggtgtagggttttttgtggcttatattgtggggtgagtattttttttgtgattggggggtttaggatgttggggggggatttgtnnnnnnnnnnnnnnnnnnnnnnggtatggttgnnnnnnnnnnnnnnnnnnnggataggtggtttggttaatggtagtggttgttgtagatttttgtggatgattgtagnttttggtgattggggtggattttgtttggttgtgtgtttgttggttgttatgtgatgtttttgttttattgtggtgaatttgagtggttttgggttttatttgatggtttttttttaggta

SEQ ID NO: 19487 - DNA, 122 bp, Diabrotica virgifera
agcgcgaaaaaacctttgaaaggtttcccccccaaaaacacttttccccatgtggagcccttttttaaagttcctctaatgggggcggcggctattattccccgaaatttacagcccggggc

SEQ ID NO: 19488 - DNA, 149 bp, Diabrotica virgifera
agaaatgagatgcacccggaatgtaatcattaatcccggcagatgtgagggttgcacagaaatagattaaaattctcttatgccctacacattctgcgacttacagagtgatttcatccatataatattatctactttgaaaaggatat

SEQ ID NO: 19489 - DNA, 1200 bp, Diabrotica virgifera
  misc_feature (67)..(93): n is a, c, g, or t
  misc_feature (518)..(549): n is a, c, g, or t
  misc_feature (833)..(852): n is a, c, g, or t
  misc_feature (1033)..(1050): n is a, c, g, or t
  misc_feature (1060)..(1088): n is a, c, g, or t
  misc_feature (1104)..(1121): n is a, c, g, or t
  misc_feature (1124)..(1138): n is a, c, g, or t
ccaaagtgtagaaaaaaatgcatgaaaaatagcgcatattctatttagctgcaacttcttgatgcannnnnnnnnnnnnnnnnnnnnnnnnnnttttcgtatgaaaattttataaaattcttctgtcacactggcagatgccaaactcctccgacacctctaaaagtttctttgataatttcccacctctaatagttccatctctttttattttaattttccgtcttttgtgttattttgccggttattagagcactcatcgctagagctgggctggttactgaataattgtactcgggtacagagtaccgggtacttttcatatttgaggaacgagtacagagtaccgagtacattgctcaaaaaaagcactcaaagtacaattacccgaatttttcgggtacttatttcgagtaaatttgaatctagaatccgaaaaaaggtaagaaggtaataattatctctaaacatatttatttgtgagtcatgaaaaaataaaataacgtacaattccaacnnnnnnnnnnnnnnnnnnnnnnnnnnnnnnnnatcattgattaatacagtaaaacctgtcagtaacggccactaaaaataaaggatctattggccgatatagaaaggtggccggtatttccagtttttgtagtccacaaatacataaaagataattggaactttgtttattttgttaataaaagcaaatatattttatatacataaacggaaactactaaaactactttaatatcctaatataaaacaaaaataagtaggtacataccgaaaaaacagattcatgttaagcttttaaagaaatttttcaactcacnnnnnnnnnnnnnnnnnnnncctttgataaatttgaagttaattttgagtcatactttataaataatggaaaaaacgtttttccttttacaacgcccctttacaacatttttattataaggattttaaagaacctttgggacaatcgaaccccctggagggtaattaaatccccctgtttaaggaaaaaccaaaagggccnnnnnnnnnnnnnnnnnnggaatttttnnnnnnnnnnnnnnnnnnnnnnnnnnnnnccgcatttcccacttnnnnnnnnnnnnnnnnnnggnnnnnnnnnnnnnnnggaattttttgggcgtgggtttgggggataaaaaagggggggcgcaaaaaaaacccacccac

SEQ ID NO: 19490 - DNA, 607 bp, Diabrotica virgifera
  misc_feature (92)..(113): n is a, c, g, or t
  misc_feature (126)..(138): n is a, c, g, or t
  misc_feature (141)..(156): n is a, c, g, or t
  misc_feature (293)..(316): n is a, c, g, or t
ctttatcgggcccaacaagcaaaaaggaaaagcgcgaagcaccctttttacaagaaaagaacgagagaaagcaacgacaaaagcaatacatnnnnnnnnnnnnnnnnnnnnnncaaatataacttnnnnnnnnnnnnnatnnnnnnnnnnnnnnnngataacagtttgtagaaggctctttaggtttagcaattttcattataataatacgtgtttatggtaatgattatatattaactttttcgtctttatgattagatttttatttagatcattttttttgattcctttannnnnnnnnnnnnnnnnnnnnnnngttcattgattaaaatttgtatttacatgattattttataccaatcaggatacaggtttgagttatttcgctatttcaaatattttctgcatcgatttttgatcatatagttaaatctcactacgatcttgagtttgtactctaataattttagtctgctggaaaattatattaatatgcaaatttaattccaatttactttttatttagaattattttattatactacaaactatgataataagtattttctttccctaaatcccttttcattttatattatatcttttt

SEQ ID NO: 19491 - DNA, 390 bp, Diabrotica virgifera
cccccccccgcccccttttagcctttaaaacattatatgaatacatacaacttagcatgactactactagtcgtgttaaaggggtgcacttagctgtgataggagtagaccaagcagcacaattaaaagatttctagacatcctgatcacttgctctttcgcttgcctaactgttgccccaatcatgcccatttcgccataataatttgtaaaactctcaaaatggaagacgctgctcctacaaaacacgtgaaaccccagtacgcacttggagaaggagctcaacacgtttatgtgcaaggcgacacatactgcacttgtcaagtgctatgccaactcccacatgttataagttcattctgaggactttccccaatctttcctaacaca

SEQ ID NO: 19492 - DNA, 56 bp, Diabrotica virgifera
gagcatttataatttacttaaatacttaaaatccccagaacattcttcttgcacca

SEQ ID NO: 19493 - DNA, 611 bp, Diabrotica virgifera
  misc_feature (6)..(28): n is a, c, g, or t
tttctnnnnnnnnnnnnnnnnnnnnnnntcttctttcttttttttgttgagcgctgccctatcaacacttcttgggagaaccgctctgggaacaaaaaatggaactgaaactctcccacactctagaggataccaacctggtatatatcacaacatccgaatcaagccgagacacgcctagattactctaatagagcacattgaagatgatgcatagaagccaaagctggagaagactcatgtaagagaaagtagatagctgcacatgatgcttggtgtaatggatcagcaaacaccttcccaacatacagatctagctggcacatctgtttaataagtatatctaatcgacctatttctaatagagatacagacgaaatgccagatgatagatgctgtactaactgccactgaaaagctactacaaaacaagtgatatctggagattgaaaaggatagctctgaggaaagaatgcctgcagttatcttcattgagattcgacgatcgtatttgggaccattattgattactgcagctttgtaatcttaccactaaggactctacctaactactgttatcgaaattgttgggacccgttgcgcagaagttc

SEQ ID NO: 19494 - DNA, 884 bp, Diabrotica virgifera
atataaagattatatattggttataaaacacagtaaataattaagacaacatacttgcatattttacatcgtaattgcctaacacgataaaaagatcaataaaaaatcaaaatcaaataaagtcgtctgaatatcctactagaataaatatgaaatataataatttatcgcacaccatgaccttgaacaagtcttatgctaacatctactggggaactacgttcttgagaaacatccatttcaatttcgtcctcctcttcttcgtcctgtgtttcagattcgtcatcatcgtcattgtcgtcttcgtcatcctcttcttcatcttcctcaatagtctccgaagctgtttttccaattggagtcaaatccgcatttttgtgctttatagacatcagccaatgttcatgatctttttctaattgagtaacttcctcttcatcatcacaaggttgatctacatcaaaccaagatgcatgcatcaagcgaggttttaaatttggaaataatggtatattactcattttatttaatttagatctataattttgcaccctataatttttgcggccggttgacagacgtctgggtggtgcgattttatatccagaaaatatcaaatagctgctcttcaaagatgcccatcaaaagcatcctcgctcgccaaatcttcgactctcgtggtaaccccaccgtcgaagtcgatctcgtcaccgaattgggattgttccgtgctgctgtaccatctggagccaggactggtatctacgaagctcttgaactccgtgacaatgtcaagggggaaaaccacgccaaaggtgttaaacttgcccttcacaacatcaatttccataatccccccctgaaatggataaaacaaggcctaa

SEQ ID NO: 19495 - DNA, 776 bp, Diabrotica virgifera
  misc_feature (218)..(238): n is a, c, g, or t
  misc_feature (294)..(326): n is a, c, g, or t
  misc_feature (330)..(348): n is a, c, g, or t
  misc_feature (374)..(391): n is a, c, g, or t
  misc_feature (440)..(452): n is a, c, g, or t
  misc_feature (454)..(467): n is a, c, g, or t
  misc_feature (478)..(496): n is a, c, g, or t
  misc_feature (506)..(523): n is a, c, g, or t
  misc_feature (531)..(551): n is a, c, g, or t
  misc_feature (661)..(680): n is a, c, g, or t
gatcgctttattagttctcttttctttagatgcactcgatgttgttctaccatttactacatggtagaatctaatggtagtagaagatggaaatgtatcatacttcgacactattgtataacaactcattgtactttttgagcgcttgagtatcgcgaattatctagttagtaattataatatctattatttacgagattgtgagcagctagagtaannnnnnnnnnnnnnnnnnnnntagtattgtaaataattttggtgtaatgatatgttattcactttctaactacatcnnnnnnnnnnnnnnnnnnnnnnnnnnnnnnnnngacnnnnnnnnnnnnnnnnnnnagatagtttatatctattgatattgnnnnnnnnnnnnnnnnnnatcaaaactagagttttattaagggttaatgttgaattaaaaagtaggnnnnnnnnnnnnncnnnnnnnnnnnnnngttattattcnnnnnnnnnnnnnnnnnnngttattttcnnnnnnnnnnnnnnnnnngatatatnnnnnnnnnnnnnnnnnnnnngagtgttgataatattatcattaagattgtgtatctttagtgatacatatataggtttactacaggtagtgtgcagcgtttttttcaccttgttcatgactaacatgtannnnnnnnnnnnnnnnnnnntgctcgccttgtccactgattaatttgcatggccgctttattttgacctgttgctacgtagcttaatctttagtttttctatgaaagctggactga

SEQ ID NO: 19496 - DNA, 532 bp, Diabrotica virgifera
  misc_feature (37)..(58): n is a, c, g, or t
  misc_feature (76)..(109): n is a, c, g, or t
tttttgtccgcaattatcttattttcatgatcatgcnnnnnnnnnnnnnnnnnnnnnnacagctttagttggtcannnnnnnnnnnnnnnnnnnnnnnnnnnnnnnnnncgtcggaatcttcttgacccgcaattaattggaatgatttgaactattttaagtacgattacatcaccttttattgatatcagatcattacagaggaatttatattctacgacgaaattaataaacagtaatatcagaattataattgtagggtgtctaagatactgtatagtatgagtaatctgattacggaaatgtcaaattggatgcatatatcgttacgactccgtggtttacaggcttgtgattgaggacgaatgagaggtgagctggagactgctggtccacatgaagatagtcatccgaatatgagatacgggcgctgaggcgacaaattacatgacgttattccctcgggagggagaaaacttggggcaaggctggggaagaggcggtaaggcttgtgcctgacgtatacgtgca

SEQ ID NO: 19497 - DNA, 960 bp, Diabrotica virgifera
  misc_feature (762)..(762): n is a, c, g, or t
  misc_feature (843)..(843): n is a, c, g, or t
agttttcagaatccagagaggccgactagatagataaataaaaataagaataaaagattttcatttgtggaaaattaataagtgaaaatcgccaaaatggacaacttagaaaccaatattatggataagtcgatgagatcagtcttcgtggggaatattccatatgaagcaactgaggaaaaattgaaagatatatttggcgaagttggacaagtactatcttttaagctcgtgtttgatcgtgaaactggaaaacccaagggatatggtttctgtgaatacagagaccaagaaaccgccttgagcgcaatgaggaatttaaacggttatgaaataggcggaagaaatttaagagtggacaatgcttgtacggaaaaatctagaatggaaatgcaaaatctcctcaaccaacctccagtagagaatccctatggagaggcagttcaagctgaaaaagctcctgaggctataagtaaggctgttgcatctctacctcctgaacaaatgtttgaattgatgaagcaaatgaagacaactattcagaataatccaacagaagcaagacagatgcttttacagaatccgcagcttgcctatgctcttttacaagctcaagttgtaatgaaaattattgacgcagctactgcagttagtttacttcatcccgtgaaaccagtgccagcgacacttatgcctggagacaagaatgttcctgtccaagtaccagttaataatcagtacagggagcctccagcacctggntcaccgcctgtccatccaagacaagacttccaacctgttcctcctccctgtatgcatccatctcaaaatcaagtatttccnaagtcagatatagatctgagatccattggtggtgtgccagatctaagaaactaagacccatgggtgaccaggatatgagacaaatgccatctgctattcaaatcccttaccacaact

SEQ ID NO: 19498 - DNA, 670 bp, Diabrotica virgifera
  misc_feature (83)..(101): n is a, c, g, or t
gtatattttattcatttaaattatatttctgccggaatatattattagtggagtgttaaagtgccagatatcattaaaattcnnnnnnnnnnnnnnnnnnngatcgtttgtgttaattaccgtcttcacaaaaaactttacttacctaattaatcaagtttgaagttttcatttttaacaatgaatacaaaatatttgataaatagtttgtgcttttaagtggttacatatttagaattattgtaggaattagctatgtataacaacaatcaaattccacagtataccaatacagggtaccaaaatacatacaaccagtatcctgaaaactatccacaacacaataataattatggatatcaaaattatggcagttatgagaatcagatgtcacagcctccaccaccaactcgagctttggttcaagtgccgtcggtacctcaagcacaaatttctacccatggaaacttacacactgatgactggagtagaagcaactaccatgataacaaaactggcggtttggtggaagaaagtcagcaacccaacagtcaaataatcagacaacgtgaggactacgtgaaaaaagcttcggtgcttaaaaatgagctcgatcagttgcagaaacagcaacaggacatgtatgaaaaacacataaacatcaagaatt

SEQ ID NO: 19499 - DNA, 927 bp, Diabrotica virgifera
  misc_feature (626)..(643): n is a, c, g, or t
taaaagtggttctgggtggatgatcacgaaaccatatttatttgatttacgtcgtgtctgtgagttttgaaggaggccatctttgcaatctctattagaggtcttcagcttgcgctttcattgtctggtgaaaaaccagtatttattacacacacatttcaccaaatggctttaaaacgaattaataaggaattacaagacctcggcagagaccctccagcacaatgttcagcaggtcctgtaggagacgatttatttcattggcaagccacaattatgggaccaccagatagtccataccaaggcggcgtatttttcctaacaatacattttccaacagattaccctttcaaacctccaaaagtggcattcacaacaagaatctatcatcctaacattaatagtaatggtagtatttgccttgatatattacgttctcaatggtctccagctctaactatttctaaagttttgttatcaatctgctcactactgtgtgatccaaacccagatgaccctttagtaccagaaattgctaggatatacaaaaccgatcgggaaaaatacaacgagttggcgcgcgagtggactcgcaaatacgctatgtgatggccaggcccccccgnnnnnnnnnnnnnnnnnncttatcaaagaaagtttatttaggtaatttgtaataaccattagaataaattaaaagatgctctcgacactttcgatccaagaaagccctcaattcttgcatggtacactctatagtcggtccttggaaagcgaacatcttcaacatctgatggattcgttctataggtagagtatccaggttcatcaacatacccacgatgtaagaccagaacgtctgtagttcttcttctctctgatcttgtgcgcttgccatagctgactcagtctcgtagtcttctacaa

SEQ ID NO: 19500 - DNA, 436 bp, Diabrotica virgifera
tctttgcgccgggaccgttgtgagagttaggtgtaaatctccccttttaaaaatagccaccaagagtgacgcaggagtgtatggacaaacttgcaaggggattcgcgcgagatgaagagattccaagctccaaatccctcggtaaagagactccttacccaggaaatcttagacaacctgaaaaccaagagaaaccccactttcgtcaaggcggtgctagaagtgatcaattctgggttagatgatcagtactacaacgaaggtatgtacgccccagatggtgagtcacacaccagtcttcgctgacatctttggatagccatcgtttgaacgactaccataggcgcgattcatacatcgacacgactgtgcaactccccccaagtagcatgaatatagtgcagttaaacagaaattgcagacagacattaaagag

SEQ ID NO: 19501 - DNA, 76 bp, Diabrotica virgifera
gtcccagaaggggttaacattcaactggaatttccacaaggggtaaaaatcctttgaaaagtttccccccccaaaa

SEQ ID NO: 19502 - DNA, 208 bp, Diabrotica virgifera
aaagcccatatcatataagatgcaatgcattcctgaagaatgtgattgatacacaaaaagcatgaataagaatttgttttataggtatacctatgataagtgcaggacgtgggaggggacttgtgcccttaataatacggcgctcacgatataggattcccggggataagtaacataagagccagagtgctcaccccgtattccgata

SEQ ID NO: 19503 - DNA, 631 bp, Diabrotica virgifera
agagccccaattacataaccctagagaacatgtgattgagaaatacacattttcatctaatcataacatgcaagcgcccagaaacaccgtgaatgcaatgtaaaaaacaggctaccgattcgaaccatggctaaattaccacgtaccatttaaaaaactcaagaataagtatatttgattatgtgaccatgccgagaggaaaatgatagggaacgcctgatctggagcaaaacgacggctccctaaattcctccgacgaggaatctatttatgaacactcaagagataacaccaactatttcgaaaacatgaactgcataagaatgctaggaggatgatcttctctcacacgaaccactgaaacaaaaattaccaaaaatcctcaatggactcacccaaaaatcatcccatcgattaatcaattgctactatacgctaaccaaaggatatgtctagaaatgtatgtactgaatatatcagatatcaatcacgatcacaatctgagacattataaaaatagagactgtacattagactcaagtacgaaaacatatctgctgacgactaatgcaccgatatatgggtacagatcgaatggcacaatgcacccgaagacattcgcatgctgatg

SEQ ID NO: 19504 - DNA, 1007 bp, Diabrotica virgifera
  misc_feature (10)..(28): n is a, c, g, or t
  misc_feature (58)..(89): n is a, c, g, or t
  misc_feature (91)..(283): n is a, c, g, or t
  misc_feature (290)..(348): n is a, c, g, or t
  misc_feature (350)..(405): n is a, c, g, or t
  misc_feature (407)..(427): n is a, c, g, or t
  misc_feature (434)..(471): n is a, c, g, or t
  misc_feature (473)..(490): n is a, c, g, or t
  misc_feature (492)..(505): n is a, c, g, or t
  misc_feature (507)..(552): n is a, c, g, or t
  misc_feature (570)..(587): n is a, c, g, or t
  misc_feature (589)..(653): n is a, c, g, or t
  misc_feature (656)..(678): n is a, c, g, or t
  misc_feature (690)..(721): n is a, c, g, or t
  misc_feature (723)..(737): n is a, c, g, or t
  misc_feature (744)..(769): n is a, c, g, or t
  misc_feature (964)..(983): n is a, c, g, or t
tatttgtccnnnnnnnnnnnnnnnnnnngaatgagattcgtttttttttatatctgcnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnngnnnnnnnnnnnnnnnnnnnnnatatagnnnnnnnnnnnnnnnnnnnnnnnnnnnnnnnnnnnnnngnnnnnnnnnnnnnnnnnncnnnnnnnnnnnnnncnnnnnnnnnnnnnnnnnnnnnnnnnnnnnnnnnnnnnnnnnnnnnncctttatatactttatgnnnnnnnnnnnnnnnnnngnnnnnnnnnnnnnnnnnnnnnnnnnnnnnnnnnnnnnnnnnnnnnnnnnnnnnnnnnnnnnnnnnggnnnnnnnnnnnnnnnnnnnnnnngatataaattcnnnnnnnnnnnnnnnnnnnnnnnnnnnnnnnncnnnnnnnnnnnnnnnaaaatcnnnnnnnnnnnnnnnnnnnnnnnnnngtttggatagaagaataaattaccttagggataacagggaattttattggagaggtccaatcaaaaaaaggattgcgaccccgaggtggaataaaggctataattgggggagcagcaatttattaagcctggccggcttttaaaacttaccaggaaccgggcccaccccgggggggggccgggttggttccttcnnnnnnnnnnnnnnnnnnnnggccgacgggcccatcatttaaaa

SEQ ID NO: 19505 - DNA, 87 bp, Diabrotica virgifera
  misc_feature (5)..(44): n is a, c, g, or t
  misc_feature (46)..(81): n is a, c, g, or t
cgagnnnnnnnnnnnnnnnnnnnnnnnnnnnnnnnnnnnnnnnngnnnnnnnnnnnnnnnnnnnnnnnnnnnnnnnnnnnngtgata

SEQ ID NO: 19506 - DNA, 258 bp, Diabrotica virgifera
  misc_feature (5)..(39): n is a, c, g, or t
  misc_feature (46)..(83): n is a, c, g, or t
  misc_feature (120)..(140): n is a, c, g, or t
tcccnnnnnnnnnnnnnnnnnnnnnnnnnnnnnnnnnnntaacagnnnnnnnnnnnnnnnnnnnnnnnnnnnnnnnnnnnnnntgcgacctcgatgttggattaaagtttataaatgggnnnnnnnnnnnnnnnnnnnnngtcggttcgaacttttaaaattttaacatggtctgaacgttaaaccgctgtggagcccgggtgggtttcttatctttaatttaattcttatatttttaccccgaaaggacccaatatc

SEQ ID NO: 19507 - DNA, 467 bp, Diabrotica virgifera
ccggggcggattcccggggccacccccttttccgggatatccaattaagagagattgattatatcccctattaatgatagcttgtaatactgggctctgtccatatgtggttgagtattctaatcagatacttcatagtccattttgatgaacagggagtttctgatattggaaaatacggaaattcaatattatacagataagatggaaattgattattttagagattatgtatgggatataagtgtgtagatttgagtatctaactactgtctgagagaaggaaatgttacgccatcgaggcaattatgttgattgtgttcttgttcttcagctagacatcaatcttcgacgcatcttcacgaggtaataccggtacccaactacggctgacatcagcatgtgactgtaggcagaagtggaaggttagttagagtctaaggacatgggacaacttattgctcact

SEQ ID NO: 19508 - DNA, 105 bp, Diabrotica virgifera
atggcaaataatggttcggtcgggggaaagaaccctcgataaatgcctcccataaaaatacaaaaacgggaagaatgggtatttccaccctctccggggcgcccc

SEQ ID NO: 19509 - DNA, 744 bp, Diabrotica virgifera
tgagaatccgatgaggtaacgattgcttattatgcagtcttagtgattggttgcaatactgcactctgcccagtgtgcttttcttttcttttcagctacttcttccttccttttgattaccaggtactttctggtttttgaggatacggaaatcaaatagtatacagataataaggaaattgaatattttaaacgctatatttgtatataaatttttagatttgcctatttacctactctagtcaaaatgaagtgttacgtcattctcgtaagttttttgagtgtgttcgtgttcgtgagttcggcaccattcttccaagcatcatcaggaggtaattctggtacccaactacagcttggatctggaggtggaagtggaagtagtggaggcagcggaggaggtttaggcggtttaacaaatattttatcccaaattgatttacctggattattaagaggagttaatagttttgtaaaattagttggagtattttgtccgccatgttcacagatcttagacaatgtcattcaaaacgtaaccagtacagcgtttagagtattcggtagagccatccttcaaggaggaggtttaggaggaggcagaggaggagatgctgcaaattcagtaaatgtagttcttcctaccttcccaccagatgacgatgattatgaagacgaagacgagactgaaaaacctgtagaagcaataagcagtagatctggagtaactaccgaatcagcacc

SEQ ID NO: 19510 - DNA, 1304 bp, Diabrotica virgifera
  misc_feature (708)..(726): n is a, c, g, or t
  misc_feature (782)..(782): n is a, c, g, or t
  misc_feature (1023)..(1042): n is a, c, g, or t
  misc_feature (1121)..(1158): n is a, c, g, or t
cgggggtgcacattagttcaaatttcccgcctagcaaaaggtcaaatggatagtgctagtgctagaccagtcttctgaaacgaaactcaaactcatttatttacctagagaattgtgagtggcaggtgtaaggtcatgaaccttgttcagtaaatagggagtgtagtcagtggtatcgttctgttctgttattgaaaggtcaaataacaatttatgcactttatgaaaacaaactagccaatctaaagaaatatgtgagtgtcctaatacaaaatattatgctacagttgtaaacacatttctgatgttaatattgttataaaccatggatatggaaccgactattaaaacagaaatgttaggtgacaagaatagaaataattcgaatatctgtttaactgtggaactgtgtgttgtttgtggagacagggcatcagggaggcactatggggctatttcctgtgaaggttgtaagggattcttcaagaggtcaattcgtaaacaattaggatatcaatgcagaggtaaccagaattgtgaggttaccaaacatcataggaataggtgtcaatattgcagactacagaaatgccttgcttgtggaatgagaagtgattctgtgcaacatgaaagaaaacctgtcattgataagaaagaattccctagtaataatgatattaagtttaaccaatctactgtaaatgttgnnnnnnnnnnnnnnnnnnnaaaagacttaaactcagagtatgggcttctacctccattttgtcccagtgatttgngccttcaggttttaaatcaaggaatagcaaacagcagtgctacacctgaatccttttcacctatcacctagtcatgcaagtatggaagaagatggctccctggatagtgcccatactggaactgaacttaatgatgctctaacctcctgctaaagaaaaaatgcttatttccaagggctttaaacccaagggctaaaagggcgaatgtttggatggaaactaataaaaaggcttttggccnnnnnnnnnnnnnnnnnnnntgattattgatgggacccaactccttccaggaaacaaaaatatggcttttttattttctttgatacccacgccctcggnnnnnnnnnnnnnnnnnnnnnnnnnnnnnnnnnnnnnnctaaaagcgggaactccccgtgttgtggtttttttttgtcacgatcttcccggggcgccccaaaaaaacaatccccgtgctcctctttcttgatctttttaaattttctcctgaaacgcacatactatatcgttgctttctttctt

SEQ ID NO: 19511 - DNA, 947 bp, Diabrotica virgifera
  misc_feature (53)..(75): n is a, c, g, or t
  misc_feature (713)..(748): n is a, c, g, or t
caaacagccagtataccaacagatgtaacagggttaaaaaagatatttggacnnnnnnnnnnnnnnnnnnnnnnncggcctcctccaagacatgacacaccttcatctccgtgtcaatgtacttgtggggagaagaatgaagatagtagaatagttggtggaagacctactcatgaaaatgagtttccctggatggctcgtttgtcatacttcaacaggttttattgtggcggtatgctaatcaatgacagatacgtcttaacagcagcacactgtgttaaagggtttatgtggttcatgatcaaggtcacttttggagaacacgacagatgtaacgacagcaaacgaccggaatcaagattcgtgcttagagccattgcaggtgccttcagtttccttaatttcgataacgatattgcccttctgaggctaaacgataaagttccaataacacagtttattaaaccaatttgtctaccaaaacttaaagataatctctatgtgggtgtaaccgccatagcatccggttggggaacattaaaggaagaaggaaaaccaacttgtattcttcaaaaagttgaagtgccagttatcacaaatgaagattgtagaaagacaaattattcagctagtatgatttcagataatatgatgtgtgctggatatcctcaaagcggaaagaaggattcgtgccagggcgatagtggaggacnnnnnnnnnnnnnnnnnnnnnnnnnnnnnnnnnnnnttataggtgctgtttcgtggggaaatggatgcgcccggccaggaaatccaggggtatatacaaaaatcaccagatacttagaattggatcctggaaaactctcaagaatggatgtttttggccaagactgaaggatttttaaaacaaattaggggaagtttagtactaagtccttaagtcttaaagttagaatcctaat

SEQ ID NO: 19512 - DNA, 366 bp, Diabrotica virgifera
gtagatcctattggaatctttacaaacctacatagatagcccctgtcactatgatatctggacgacacgcgcgctacagatagctagtgactcactctacgctctgcgcttagacgagctatgggaactaaaatggcatgagttgttgcattaccttgacaccgctgattacttaattagagacgaaattgaaatacgaagtagtcatcctcgcactataacaacgataaagataatactggatacaaacactgttaagtgaaatattactcacgatatcgttggtgattacgtatccgaagaggttcgttatcatgcgtgattcaacttcgcaataaacagatactaggatctaagatcatcctg

SEQ ID NO: 19513 - DNA, 333 bp, Diabrotica virgifera
  misc_feature (25)..(126): n is a, c, g, or t
  misc_feature (130)..(164): n is a, c, g, or t
  misc_feature (182)..(212): n is a, c, g, or t
  misc_feature (223)..(243): n is a, c, g, or t
  misc_feature (245)..(269): n is a, c, g, or t
  misc_feature (280)..(319): n is a, c, g, or t
aaccccccccgagaaaggggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnncccgcggaagggagggannnnnnnnnnnnnnnnnnnnnnnnnnnnnnntggtgggtttnnnnnnnnnnnnnnnnnnnnngnnnnnnnnnnnnnnnnnnnnnnnnnccatttcctcnnnnnnnnnnnnnnnnnnnnnnnnnnnnnnnnnnnnnnnnggtggtgggtggtg

SEQ ID NO: 19514 - DNA, 362 bp, Diabrotica virgifera
ctgacatgaaagtgctattgctttccgcattattagctgcctcattggctataaatgcccttataagatgaaacacggattgcgcggagatagacttccctgcttcatccgttcgcactcctcagaaacattccatgttactccacaaaacaagggtgctcaattctcatccatccttgaatagtgtatccattgctgctgcaacaaagccaacgtcgatgaaacaggacgcagtcttaaactagttgagatgagcatcgcgccgtgcctatgggtggagtaacatacaagccaatcgagatggcggaattctcctcctggtgacataggtacggtccttaaattggtacctgacgtacgtt

SEQ ID NO: 19515 - DNA, 492 bp, Diabrotica virgifera
cccttacacattatgatctcgtgactgcgcgcttaattaccctccttaatccttatggcaaactccttcttcactgactactacggtgatctccactgtcctaatggggataacattgcatgttgcaacaacagattatattcttgctcatagtctattttggatacattatgtaactgctactatctctgtatttctcgtacactgaatgactgatgcccaaattattgatccgcactgaattatgcataactattcccacctacttcaaccatgcacgattcaacacccccacaacctccagataacttaaccgtatgtaaatggagtgactaaaccctcttccttaaccaaaaaggtacatgataactgatctgaatggacatagtgatcatatcatgaccaactcttgtgagactgaatggtgtgtcttgctgaccattacatcattgtgactgtaatcttaaatccacatgaaataggacgtactgt

SEQ ID NO: 19516 - DNA, 977 bp, Diabrotica virgifera
  misc_feature (198)..(212): n is a, c, g, or t
  misc_feature (257)..(280): n is a, c, g, or t
  misc_feature (747)..(747): n is a, c, g, or t
  misc_feature (758)..(758): n is a, c, g, or t
  misc_feature (783)..(783): n is a, c, g, or t
  misc_feature (813)..(813): n is a, c, g, or t
  misc_feature (920)..(920): n is a, c, g, or t
cccaacaaaatgctttatttgcgaaaaaccattcacagaaggcgaaactgagtttgtaggaaaaggaataccgaatttagtggcagctagtaaatcaagaaaagacggaaaacacgaattactaaacaatgttgaagtgcttcaagttcacaaaaattgtaaagtagaatacacaaataaagataatattaagcttcnnnnnnnnnnnnnnnaaccaaatggtgaaacgaaatcagaagggaaacctacagtgaatnnnnnnnnnnnnnnnnnnnnnnnntgcctttgtggtaatgaaagacatcccaaggcaagagattctaaaatttttatactatgcacgacaccgagtttaaaagataaatttttagaaaaggctagtaaaagaaatgacgattttggtcgtcagattgtagaacgtatcaaaaatgtgaatttggtattgatgaaggctcgataccataaacaatgctatacacaattattctatacgccatcaaaatctacgaaaaagggacgcccagaagatcagaacttaatttcagcttttgaaaaggtttgtgagtttattaatgaatctgaagaaaggcagtttacactaaaagacttactggagaggagttgaagataacctaccgaacgatggttctatgtcaatgaaaacattaaaaacgaaattgcagaagaaatatggtgatgggtattgtatttgctacaagtttaatcaaaccctcttcgatatacttntttagattctnggtgtaaaacacaggggaagaactnaaggaagcagaaatcaatacaaattaattnaaggcattgaggtgtctttgttgaatagttataggtatatagtacagtagttttattatatcgttttagatatgaatctaactttaatgaattattgagatctgagntgaacagcaagtttgtaatgctctataatgtaaaaatcctattttaaattacaaaaa

SEQ ID NO: 19517 - DNA, 751 bp, Diabrotica virgifera
  misc_feature (712)..(730): n is a, c, g, or t
ttgaaacatgatcatgctttatttgtctctcagtagtacacacgtacaaaaatcaccagaaaaatccatataaacaataacattacaacaaatctcggttaaatctaagtcaccattgcattgattttgcataacaataagtccacaataatttttcgagaatgccacaaaaaaatttattcgccatatccattgatagggatattaaacagcttatacttccttccaacaaggcatgcatacaatatgaataagttgatgaaccaatataaggagctcattttcgataaaaatcatttttgatcatcacaataatttctctagctgttatagttgacgagtaagttttttacactttacttagaatcgaaatgcaccttctgttttcctgtatatacttcaaatttggcagatatacaaatctaaaaagacatctgtagatgccaagaagatattcaatagtttcgatcaaaatgttaaacctgcaacatttggtcatgaacttctcctttatatcaatcattaaagtgttattactggtacagttaatacaattaataaaatcattaaattacattattaaataaagtacagaaaactaacaaatttgatgtacatacataattttctcgacttataatcagacttgaatatgttttggcgatgtataagactgttaaggggctatcctagtgtaaaagtacgaaattcnnnnnnnnnnnnnnnnnnntttcctagttctagatcgcga

SEQ ID NO: 19518 - DNA, 1010 bp, Diabrotica virgifera
  misc_feature (735)..(735): n is a, c, g, or t
cctattcttacagctgtgattggtccaaaatatgtatgcgttatatactttattggattctatattcagctttattatctatttattataaaaacacatactgatcgacttttgccatactctgtatatacatttctaatatagatcatccttaacacatttgctgccacctggcaccaaaaggtgttttgcgtgcgtgagtcaggcgccaccgacgccttttggcgtgcataacctgtggaattaaatagggttcttttcatgtggctgaatatatagtggcagagaatgtgttaaaagtcattccaaatcattagatagctttcaataaagcgttatgatctaggcagattcctaatctcacagaataatttaaatctttagatgttatgaatattactggctgatatctgtcacacccgtagataaactttatgcattcctgaataaaattatcgactgaatttttataaaagtaaaatttgtcatatgaagctcacaatttttaaattgtttaaaagtacgatgtatttgtaattattgtaacttactagtgtattgtttttatactcgtttttatgtatttttagatatatcgatacattggaagaagaatgccatcttacaaaaataaaattcagaaaactgagaatttaaaggctcttttaatttgaactcaaaataccttcagaaatatttcatatttccttcaaatttcagttaaacgagctatanttataatatgaaggataaattgcaaaatttatcttcgaaataatttatacacattgtttcaaatgaaacataaattggaatatttgtaatatgcccagtttacctgatcttttcgaccagaaagtacccagtcaatccgtctaaatttgaccatgggtccgaaatttagctgaagtcagacataaaactaataccacagagtaagatactgaaatgatacataatcatttatggttaatatgattgacaatttatatttgcgtatagtcaaaatt

SEQ ID NO: 19519 - DNA, 451 bp, Diabrotica virgifera
cgctaatttagtttgttactattcttaaaatttaaatctttagaacgatttcttttaaataatctcacataaaagaatctaagggtgacagcacatgcgattatggaggtcatcggatggtttctttagttccagtctctttattttattgactagttgtggtgtttggtttagctgtctaaaggcacgtatccattacacttgccctccgcgctccctgcagctgctccaatagatacggcatgcgctcttctacctataaaccgccaccgattggagcgctgaagcaaatcgcgcaccattgcacggtccgggagcgccaacgtatccactatgtggaacagttgcaggagtgtggagcgcaagtgtcagtgtatatgtgtccatatgaacacttttcatattctcaatctcgtctttagagattcgattaagtgaattttaaggaata

SEQ ID NO: 19520 - DNA, 798 bp, Diabrotica virgifera
  misc_feature (700)..(716): n is a, c, g, or t
cttacggctgcattcgcatcactattccttttttgttctaatatttgtggatcataaaagacagctgataataattggagtaaatgtacattattggcgcgtgtttcttttacaccattgagtgaattacatccgtactcttgttcaaactagctcgaccagtaacatggcaagtgttgttttaccgctaccgttaccgccgacgatgaaaataatttcaccttgcgatattttcaggcttaatgggccgagtgtgaactgccgatcctctttatctgttgtgtaatgagggatgacatccttcaactcaagttctaccgtatgttgattatagaacgtattgggtccttcagtctgtgcggagataacttgatctatttcgtcttctagagaggagcattctgatctatgaggcttcagcttctcttatttctggaattgcaccaatcacttcgctgataaggccgaataaaaagagaacaagtaatgaaacagcacacaggtttgagggttcctggggaagacaaatctgaacgatatgaacgataatgccgatagtgacatagaatgtgactgaactgtcattaatgagccacgcatatctggagttcgacttaatgcatatattttggaatacctttgctgctggaccgataactttattgataaaaagatgacctttttgcttgttgagttgcannnnnnnnnnnnnnnnntccagactctgaaagatatagtatatttaatctacatgatcacgcatcaatatgactaaacgtaatgggcatttttcccaat

SEQ ID NO: 19521 - DNA, 669 bp, Diabrotica virgifera
  misc_feature (7)..(29): n is a, c, g, or t
aaattgnnnnnnnnnnnnnnnnnnnnnnncatgacctaaattctgccaatgttccaacggtgtgccatatgaacatgcttgtcctgctggccttcacttcaacccaatactgaatgtttgcgattggccacagaatgcaggatgcggaggctcagacccagtgacaacagaacagactattacaccaacacaagacagtggaaacaacacaaactcaactccagctcctaattcatgtcaaaaagaaggtgtcgtttgcccggcagtagatggacccgattcggtttatttccctctcagcgattgtactaaattctgccaatgttccaacggtgtgccatatgaacatgattgtcctgctggtcttcactttaacccaaaattgaatgtttgcgattggccacagaatgcaggatgcggaggctcagacccagtgacaacagaacacactgtcacaccaacacaagacagtggaaacaacacaaacccaactccagctcctaattcatgtcaaaaagaaagtgtcgtttgcccagcagtagatggacccgattcagtttatttccctctcagcgattgtactaaattctgccaatgttccaacggtgtgccatatgaacatgcttgtcctgctggtcttcacttcaatccaaaatttaacgtttgcga

SEQ ID NO: 19522 - DNA, 172 bp, Diabrotica virgifera
gagttattatactatgcccgacgagtaaatagtatccgcatactgagaatactatatggcacgagtgtcgagataactaatactatggttatatttacaaattggcccggggcggcatgatgtctatgatggactcaagatgtgatatagaaatacggcagggcaaatatca

SEQ ID NO: 19523 - DNA, 298 bp, Diabrotica virgifera
gacagttagcgagttagctggtagaatgtagaaacgtaatccgctctcaaggttcccatattgaactttctgagaagcccttactaccctggaactgacgacgtcaccctcttaatgccagatgctccaaccacaactctgccaattgctgatttcaggaccggtcaacaactggactattccaacctccacggcgtctacaaccaaggtggcaaccgggcatgatgattacttgctagatcttttccagctgtaatgagggcattgaagatgacctgaccttctacagatagatgaa

SEQ ID NO: 19524 - DNA, 670 bp, Diabrotica virgifera
tattcagggcggacaagcgagggaagccgccaaccaacgcccccttaagaaactgaatgcgacccctagagcaggccgaagacccagggagcagcgaaacacacaccgaacgacacgccccttactcagcccgtgcatcacgtagcatgcatccacacgaacaggaatgctacatacacggctgcgagacggcgttatgcttgcctgtgtcaagggccagccgacgccttgagacgacgcctaaccatgacgcaactacagaggagccttgtagacctgaggacaaaatgtgagagtcttgagaaaggtccagacatcctcacgaagaaagactcccgctttcattctaggcggtaagacgcagggagaatccgatccactcgataaaaaacgcaagcttaagaagtgaggaatattactggaagattgctgaacgaaccgcgaatgaactgtatgcattgctgaaccatagaatcgacagaatatgcttaacacaataattcgatacagtcatgatcacctacgaaaaagggacgccgagagcaacggaggtgaaattctggtatcgaacgagtgtggggttttaatactggatttgaagaatggtagaatatctccatgacttgcaagaaaagagtgatcataacctacgaaacgatggaaaaatgag

SEQ ID NO: 19525 - DNA, 1001 bp, Diabrotica virgifera
cgcgaattccctgcgtcgaccctttcgtccgcggcggaggaggcggtattggaggcggaagcggcattggaggcggtggtgacggtggattcttgaggtgagattcaggaggcagtgtttctgtgaggcgcgtccactaccatccagaagcagatctacgacctcgtacccccaccaataacctgaagaattcatacctcacagaccaatctccgttggacaagccctgaaacactactacatcatcttcgttatggacccacgagcacccgccccctctgctccaggagtcccactacaaccaccattctcatacaagaccttgtcctacgttttgttctataaatccaaacaaggacccgaaatcaccattcctactgtctgtcccaactcaacccacgatatcataacgatacttcatcagatacaatagccataaaaccggcggaggtggaactggatcctcgatgcgtgacggttattgtaggtagacctatgtaccgccacacttgcaggagtgattgtaggtgacgagaaaaaaacataattcaccgttcctatataacttgtggctaaaataatttccttgaaatggccttctcatcaggtaaccgctaaatcaagcttgatattatgaaggtataattttgtacaataaaaacagatatttttcaaatgacatttatataaaatgccagtccctgatgcaataatgcggtttagatgaatttatattatccatctatatcatgatgaatattccaccgtgattgtaaaccattaataaatataaccatggcctacaagtccaaatttctatcagagattgattaactcttctactttttcattaattaatttttgtaacgcataacataaaataaattctaagaataaaaatcctcacccataattataatatcgcgcatttaatataacagattataactagtgggattattatatatccaataaattaatcactccataaattttatacc

SEQ ID NO: 19526 - DNA, 891 bp, Diabrotica virgifera
  misc_feature (477)..(491): n is a, c, g, or t
  misc_feature (493)..(505): n is a, c, g, or t
cgcactaacagatacaatcgatgttagaacggacctacgatagaccctatcctgtattctattcaacatcacattagagaaaataattagagagtcaaaagttaacactagacgaacaatagtaacaaaaagtgtataaatattggcatttgcaaatcatgttgataccatagctagaagcgaaagagggatgatagaagcatttaaagccatagacagagcgacacaaaactgtggcctaaacattaatgaaatattaaccaaatacataaacgccagcaaatcgacaggccaaaaaaaagctacagaatctgacaataggagacaataatatcgaaagcattaaaaattgtacataatctaggttcgctagttaccgcaaacaacaatgtcattgaagaagttaagagaagaatacatattgctaataaaacattaaatggactaactaaacatctaaggtctaacaatatcacnnnnnnnnnnnnnnncnnnnnnnnnnnnnccctgataaaaccggtccttatattatatggatcagagacatggacactgtcgaaaagcgatgagaacccattaggtacgttttaggcttctaggctatcacaaaaataaagtaaaaacttacctttttcaacaggggtaacagtacgaaataatacaaacaggtgagtaatattgcctttactagattatcgtaaattgtattacagctgacaattattattctttctgcaagtagcagcaaagtcacaaaaacaaatgagtggtttagcgccagatattcagatttgcttatgaaacaatttttgtcaacgggataattttaggtcaaactcgtaaccaaattatgaccagcaaaaaaaactgaattccacttgattatgtttt

SEQ ID NO: 19527 - DNA, 593 bp, Diabrotica virgifera
cggggtgttttgttatgttaatcaaaagtgaagttttattattatattcaaataattaaatgattgtgttctaaagtataaagatggctgataatggggctggtgcctcaaatcagcgaaacacccgtataaagcagtcaaaccttgaatgcaaaaacctgtatgattacttaaaatctcgaccaccaaatgtattagaaagactttataatcatcctacaatatgtttagcggtttatagagaactaccggacctagcaagacaatatgtcattagattattatttgttgaacagccggtgccacaagcagttgtggcctcttggggctctcaaaccttctcaaaagaacacacctatgctaccaaagttttagctgaactaacgttatggcaggaggcagctatacctggtggtcttttggggtggatactatctcctatgtttaaaaggaatctcaaaattgccttgcttggaggtggcaagcatggagtatgtcttcagcattagaagtggatagtaaggctagagatgttgctttcctaaatacctattctccagaaagatgggagtgggtcttacattatatggtag

SEQ ID NO: 19528 - DNA, 938 bp, Diabrotica virgifera
  misc_feature (213)..(234): n is a, c, g, or t
  misc_feature (271)..(293): n is a, c, g, or t
  misc_feature (631)..(646): n is a, c, g, or t
  misc_feature (796)..(796): n is a, c, g, or t
  misc_feature (840)..(840): n is a, c, g, or t
  misc_feature (850)..(850): n is a, c, g, or t
  misc_feature (870)..(870): n is a, c, g, or t
  misc_feature (890)..(917): n is a, c, g, or t
  misc_feature (932)..(933): n is a, c, g, or t
agcatttgcagatggtaagcttcaacctggcttaaatactgtggaagaaggaccaaaacagttcacaaataatgtgagtggtttaaaacaaaaattagaagaaatcaaactcaagttaccatggatagaacgactggactgtgtaaatgcacaagcccctttagcacctgaattagcagctcaaatgttgacccacgaggaaaaaagaagtannnnnnnnnnnnnnnnnnnnnngctcacacagtttactccaagtgaagacccggttttnnnnnnnnnnnnnnnnnnnnnnntgttccacagacaagcccaggctgccattctagattctataccaaagctaaaagatatgggaatactaactaaaaggcctgacgattactttgctgaaatggcgaaaacggatgcccatatgcagaagattagggaacatcttatgaagaaacaggagcaacagaagagaagcgaacgagtcaaacaacttagacagcaacgaaaagaaggtaaaatgttacaagttcagacaaaacttcaaagacaacaagaaaagaaagatatgcttgctcaggttaaaaaagtaagaaagggaatgtccaaagatcttgacttccttgacggaaaaaataaatcnnnnnnnnnnnnnnnngcagaaaaacggaaaatgaaagacaaaaagttcggtttcggtggaaagaaaaagggaatgaaaagaaacacaagagatagtgctgcagatataagtgaatttaaaaatccgggtaaacctggaaaaaaatttaacaatagtggaaaaggngtaaaaggtggtaaaatgggccaaggggcgaaacaaagaatggngtaaagtaanaggattaaaatgagatctanaggaaggaagtgatttatcnnnnnnnnnnnnnnnnnnnnnnnnnnnnaataaataaatgttnnatatt

SEQ ID NO: 19529 - DNA, 917 bp, Diabrotica virgifera
  misc_feature (272)..(292): n is a, c, g, or t
  misc_feature (482)..(499): n is a, c, g, or t
atttcctttactggcagtttactcgcttccaacaaggtccctttctttgtcgatagagtaaagccacatctctcgggtttttgcctttagtgacaatagaacattttatctattatgtaactgaaatattataaataaaatgaacattttatattttttgctgttggaactatggcacttctggttttaaagattcatcatcaacttatcatacacttttgggttattaagattgatcctgtatcgtattaacactttttcaaaaagtattnnnnnnnnnnnnnnnnnnnnnctttcaccacgcaagaactgcaataaggtatcactaaatactctttttttattataggcaagtaacaaattgtttctgagttttttgatcactttaatatatgaaatctaggtctacaatatccctattaaaaactaaatgttactttgtaaatttatcgttctatatattaagagtaggtataagtcannnnnnnnnnnnnnnnnnctctctgctgaaataattattacaacttacaactaaatatcaaaatggtgatgaaatatgatccataattgtagtaattaactattttactttctgttttgataattacataatttttaagttcaaaatatagaagaatgcagaaaggtctttattacgacttatactcttagtaaatagcacgttagagatattatactatatatttggcaacacctattattttatacaccccgtagatgctaaacgctagtagatagaactaatattcaagttggaaagacgattttagatgctttacccaaaaatggcagtggccagatccagatgctatgcaaacttgatttcagcttttaagagtggtttgactaaaaaaataaaagtaatggatcctttaaattaaggggggaaaagcact

SEQ ID NO: 19530 - DNA, 476 bp, Diabrotica virgifera
gccgggatttcccgggccgaccccttctcccgactgttttctttctaatctgatctaacgtatacaatattatcaataaatatttcactgaaaatgtgtagatgcggccatatttaggggatattgaaagagatctaattttcattaaaggaaatcatgtaaaatagtagtgtacaactattgggttttactacacacgttgtatatatttgtgttggtatatataagtctaaattaatcattcgctttcttgacgccgaacacagtattgaagcgcgaataagcattaccggtatatcgaccaggtaaataaggcgcctagaaatatagggaggtcaatcacaggctaaataatcagaccaataagacatgataacatctgaagaatatctagtcgtacataaccatgagtttaacagatacgcgcgaacaagtatggtgattgaaactggttaagcctattaatacatatttgt

SEQ ID NO: 19531 - DNA, 92 bp, Diabrotica virgifera
tctcggggccccccttaattcccttttttttggcggacttttgccctttccttggttttggtcccccccaaaaacccctgtgggggtaagat

SEQ ID NO: 19532 - DNA, 733 bp, Diabrotica virgifera
  misc_feature (64)..(78): n is a, c, g, or t
cttcgtccgggaatccggttcctattccggaacccggtagcgcatccgccaaacagacgggccnnnnnnnnnnnnnnnatcggcgtaacccgccaggacctggagacgtcgtcgagagatccgggacaagttttcttttgtgtatgagagtgcgagtgccatggtatcttctagcaggcatattatggtcaggaccgcgacatggaccgcattagaacatttgtccgcaccctctccgcccagtgtaaaaatccagggatagggtcccaggggaggtcactgctgatcttagaaatatgggtggcaacgtggccaggtgtcgcggccttcagttcttcatggtaggattcggtccacgtcgctatataggaagccgataatacagagggttgacagttcccgggctcactcagcgaatgggtgatgccaagaacgggatggaggctagtgatcccggacgcgcaaggtatctttcagaacatgcatcattcacaggtgagatgtctaggaaagaaggacgcgaacacacgctgtgtcatccagaacaaagaacagtagctacttctccgaatgcctcccgcaacctgtcaaaataacccgttcgcgatatcaaactcaggaggtctcaagatgccgggcactcttctcggtcaatcgaccggcatccaagaattgtccttccgtatctcccgaacaaattactgcttatgttttggacggaaatctttctttg

SEQ ID NO: 19533 - DNA, 78 bp, Diabrotica virgifera
  misc_feature (33)..(53): n is a, c, g, or t
cttctattaaaccctaccccgaggggaaatggnnnnnnnnnnnnnnnnnnnnnacgaagaatggatttcattggccaa

SEQ ID NO: 19534 - DNA, 402 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(374): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtatattaaaagaacaaaaatctaat

SEQ ID NO: 19535 - DNA, 751 bp, Diabrotica virgifera
gaaactttggatagtttaaaggacgttactataccagtcaaatacagagcacagtatatcgagaaatgttggaagtactttgaaggattgaaaccaaaaggggttaaaataactgaatatttgaatgctttcctgaatcacatgtctgcagatatattattgatattgactgcgccattcataagcgacattatcaaccgttacttccctgttatagaggaacgtctaagttctatcgatgagtttgttatacgtgtgttacaaacccgtgtagcggaaagaaacataaacttccaaactgtgtttgatattttgtcgaaattatctgataatatgagaatttcattttttaaatccttcattaacaataatcccgaccaacaattgttagctttgttcgccgaaaattggtataaaaacttcactttgatcgacagttttgatgaacacatatctctaaaattgaattcgtttagattggaaaatttatctgttgatgatctagctaagaaaactgtaaattacttagagcaactaatgacagaatttggatatcattgctttgcacgttttgaggaacaatttacaaacgcctttaataactacgatacagtggaagaatatacgttctatttggctattttgaaatataaagtaactccaactacttgtactttggtactaaataatataattcatatgtgtgacaatgagaatgtaaatcttaaaatacattcatgaattattacat

SEQ ID NO: 19536 - DNA, 448 bp, Diabrotica virgifera
  misc_feature (10)..(29): n is a, c, g, or t
gactgtgatnnnnnnnnnnnnnnnnnnnnttacaatgttgttgtttgcaatgctgttttgtatatttggcccaatattggctggagaagataatattttatgcacagaggagacttgtaaggatattaaatgtgatgagcttcccccaaaatgccagattcaaaatgccactcacaatggactaatcttaccatcaatggtgacatgtaattgttgcgaatattgtttagaaaatttaaatgaaggcgaagagtgtagtatgggtgacattagcaatcctgatgtgacagaaatatgtggagctgggttatattgtaaaaatactactccaggcgaaagtgatggaatatgtagacgaatgaagacaagctgtactaaaaagcaagatgattaccatggaaaaatagaaaataggtactctaggatatatggaagtgcgacggtattg

SEQ ID NO: 19537 - DNA, 443 bp, Diabrotica virgifera
ctcgcctgatggggaaagaccaattctcttccttgtggatggaaatccatcacaaaagttgcatactcgaatctcttaaaattgtttctacatacgaggtcaaaaaggacacttccctgccaaggctgctgacccgtaaagcacatggaaaagctcgaacgaacgttggtgtcgtccctgatgtactacttccaagaacaactatatccatatgtcgtaaatgaggttggaagtagaaaaccgccaacctagagaggtacttggatgagatgaccataagcattagaacacagatcatagtattgctattgtatgcctcatcgaatagaatcgactgtgttcacttcgatatcgacgctacgcatacacagtaccgtatctactgtatgcatgaagaccatcctgtgctcgcacctgtcgcatcgttcattgcatgaatgcta

SEQ ID NO: 19538 - DNA, 718 bp, Diabrotica virgifera
  misc_feature (461)..(478): n is a, c, g, or t
ttttcgtccggaagaagttatctaatatgtgatgataaagcaatgttccaagttttttgctgactgatgttgagcgctcctcctgcgcatgcgccaacccagaaaaaagacgaagatgtgaatgatcaattttatgaagacctctaaaaagcagatgataatcatttaaatgatattaaaataatcaccgggaacatgaacatccttataggaaaagaggtataggtactaccaaaattgtattggtaaatacagccctcacgatgttactaatgaaaataaagacttattagtatggcagttgccaaacacatggttatgtaaagagcatgttttaatcacaggaatacctatccataaagggagtaagaagggctgcgacagggagatgcgctggcgtgtctcctcttcaacatagctctggaaaaggcggtcagagatgcacgaatagacaacagagnnnnnnnnnnnnnnnnnncatcccaaattttggcatatgcagatgacgtggacctagttgcccgcacaacacgcaaactagaagaaatgtataccaccttctcaaatgcctaaaaaaatatgggcctgaaagtaaacgaggagaaaactaagatggttggtatcaacatccaaaaatagtgcccaaaacttcggtcaccagttcacggtggattaaatgaggtgtacaattttctcttagttatgctccctgattccc

SEQ ID NO: 19539 - DNA, 922 bp, Diabrotica virgifera
  misc_feature (3)..(91): n is a, c, g, or t
  misc_feature (293)..(329): n is a, c, g, or t
  misc_feature (581)..(675): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgactgccgttgaacaattacgtatcacgcccgcgattcagcaccttctgcaacgggctggcaactgccggttacataaccattatggcccgtcggaaagccacgttgccacggcttatattctggataaacaacgtgagcaatggcccctgtttccccctatcggtcgtccgattgccaacgccagaatttatattcnnnnnnnnnnnnnnnnnnnnnnnnnnnnnnnnnnnnnaggggaaatctatatcgctggcacaggggtagcacggggttacctgaaccgcccggcgcttaccgcagaacgtttccgtcccgatccgttctcggcaaatccacttgcccgcatgtacaaaaccggcgatctcggccgctggctgccggatggcaatatcgaatatctcggccgcaatgactttcaggtcaaaatccgtggcttccggattgagttgggtgaaattgaagctaaattgatggattgccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcggaactgcgtgagcaactcagccgacatctggcggacgcgatgttgcccggtgcttttgtcacacttgagactttcccgctcacaccgaatggcaaacttgacaggcaatcactccccgtgcctgacgcctcttctgtagcaatgcgttgttatgctgctcccgtcggcgaaacagaaatcgtgctggcgcagatctggcagacattactgggactggagcgcgtcgggcgtcatgatcatt

SEQ ID NO: 19540 - DNA, 374 bp, Diabrotica virgifera
  misc_feature (2)..(102): n is a, c, g, or t
  misc_feature (108)..(143): n is a, c, g, or t
  misc_feature (149)..(185): n is a, c, g, or t
  misc_feature (188)..(207): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggnnnnnnnnnnnnnnnnnnnnnnnnnnnnnnnnnnnnatatannnnnnnnnnnnnnnnnnnnnnnnnnnnnnnnnnnnncgnnnnnnnnnnnnnnnnnnnntttggattaaacaaaaagctcgcctggcccacggttaattttgaaggccggggtatttttgacgggctaaaggacacaaatattaattttttcttttacagccggaatgaaaggtctgatggaaaaaaaaccgcctttaattattttcctcacaatttattttttac

SEQ ID NO: 19541 - DNA, 749 bp, Diabrotica virgifera
  misc_feature (70)..(742): n is a, c, g, or t
caaaaggtgacgataacatcgctcgtcatacactacacctaaccttcaaaatatacagattgaggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaatg

SEQ ID NO: 19542 - DNA, 926 bp, Diabrotica virgifera
  misc_feature (394)..(434): n is a, c, g, or t
cgaccggatctcccgtggacgaccccgtcggacgactcatcatcttcttttaatcagaccaacggcgttatcagaaacggcattggcttcaaccataatgacatcagccgcatggcggatttgggttaaacaagctcccataacctgcaggctgacaacgcaatgaataaggatcttgaactttcggacagtttttatgggattcagagatgccactctgctcttccagtaccagacgataaagggttgctacatccatttgacctttctggccgcgtgcttcatgaatacgagcatcaaatggtttgcgggaacccagcgcggcttcaacagatagggcgccacaaataatggctgatgcaagcaggtcttctgcggcaaacagccctttcannnnnnnnnnnnnnnnnnnnnnnnnnnnnnnnnnnnnnnnnagaccttcttttgcgaccagagtgatcggcttgagtcccgctttctccagcgcctcttttgccggcagccattcaccacgatagcgggctttaccttcacccagcaataacagactcatgtgcgccaatggagccagatcaccagaagccccgaccgagcctttacctggaatacagggataaactccggcattaaccaacgctaccagtccttgaataacgtccagacgaataccggaataaccacgagcaagactgttaatcttcaacaccataatcaatctgacgatatcatccggcaacggttttcccactcccgcagcgtgtgacatcacaattgaacgctgtaactcttccagatcttgttctgcaatacgtgtatttgccagaagcccaaaaccggtattaatgccataagcggttctgttttcactgatgatacaattcacgcaggcaacactgctttcgatggctgggaagcattgctcatct

SEQ ID NO: 19543 - DNA, 939 bp, Diabrotica virgifera
  misc_feature (783)..(867): n is a, c, g, or t
ctttgtccgctttaatatgttgtatgacggctttaagacaatattaacaaatagatgagtttgataatcgtatattacaaatattaaattctcaaggttttaggatggttacagataaaattcaaagtggttctatgttattaaataattacgatacgcataaacccagcaataatttaagaacattggaagttgcatcttggcacactatggatcatgtagtgccgttaattcaaagtaacagttgtattccctttctacacgctgtttcaatgtatgtcaattgcacagataatcagaaggtcaaaatatcatttttgactcatcctaacattcaaaaatatttagtgtcgttatcgaagttggacaaatattacctgacaaatcattggtttgctagacccgaaagcatatttttgatgaacattctaaaatcggcagtagcaataaaagatgatattgacacttcaattttctacaaggtagctgtgaaatgcctatgcgtctttaattctgaacaaaaacctgagataagatttatattggcaaatataatcttctgctccaagttttatcctagtgaagtacttatggagaatttggatataagccagagaagtttaagcctggaagtttctttgaaaaacttgaatgagattttgaaagtgtatacacaaattttaggattacaaaataacgtaccggattttttaaccatcgtgttccttaaatataaacattggcaatgttattcctatagactggatatacccaacctatttnnnnnnnnnnnnnnnnnnnnnnnnnnnnnnnnnnnnnnnnnnnnnnnnnnnnnnnnnnnnnnnnnnnnnnnnnnnnnnnnnnnnnttaatctttgaaacgatttttccctttttgggctttaaaaataatcccctggtaatttttgtcttttaaatt

SEQ ID NO: 19544 - DNA, 341 bp, Diabrotica virgifera
  misc_feature (6)..(24): n is a, c, g, or t
  misc_feature (170)..(190): n is a, c, g, or t
ccctcnnnnnnnnnnnnnnnnnnnggaaaaagggttcaaaaaataattgaaaaaaggaaaaagaatgaaatatttcaacaatttccctggtgcccccctattctccctttttttgcaggcatatttgcctttcctctgtttttggctccccccccccaaaaccccttgcnnnnnnnnnnnnnnnnnnnnntctcccaaaaaccccctggtgcgccctcacggcgggctttaccttccacacctgtggttattttccaaagtgcgttaataaaattctttgaaagccttttctcccccccctccaacaaacccctttcctcccattctcttaaaacactttt

SEQ ID NO: 19545 - DNA, 721 bp, Diabrotica virgifera
accacgcatctacggatgcatcaacactgccatatttctcgccatatttgttatctcactctatatctttgtccctaatgttgtacctaatgaaatacactttacctaacgcttttcctgtataatttaaagatgaaattgtgatatatattgtgagatattatttgtggttgtaattgttgattaaatagtttttcattaaaattgactgtgcttttcttcgctgttatctgctttgatatcaggtttataatttattctataagtttatctattagtttataggcttatatttatgtgaatatgtatggaaacatgatcggtgataaaatctgtgatataaacttatggttctgcatatgcttctgcaatgtcttgaatgatgacaagagtgccaagaacacctacccctgctcctacgcctgctccacctatggacgaacccatgcaccattccgctccacattacacaccatgacaaacccaacgagtccaccacccttgccatcacggacgacatcatggacagcatcatgcacagcctcaaccagagactacccatccacccccccatacttactggcaacatcactgacacaatcctctctcctaccctctctcataccatcataatcgacatcataatcaacatcagcatcacactcaatatgtcccaaattactctggatatgactctcaacattatagacatgattattat

SEQ ID NO: 19546 - DNA, 870 bp, Diabrotica virgifera
  misc_feature (22)..(774): n is a, c, g, or t
  misc_feature (776)..(869): n is a, c, g, or t
ccgccctttcattcatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 19547 - DNA, 436 bp, Diabrotica virgifera
  misc_feature (14)..(91): n is a, c, g, or t
  misc_feature (94)..(106): n is a, c, g, or t
  misc_feature (259)..(276): n is a, c, g, or t
  misc_feature (323)..(368): n is a, c, g, or t
  misc_feature (389)..(435): n is a, c, g, or t
ctgatttaaattgnnnnnnnnnnnnnnnnnnnnnnnnnnnnnnnnnnnnnnnnnnnnnnnnnnnnnnnnnnnnnnnnnnnnnnnnnnnnnntannnnnnnnnnnnnaacctaagggataacagcgtaaattttatttgggaaaggttccaatccaataataaaagaattgccgaccctccgatggttgggatataaaaggttttataaatttgggggaaacaaagcttttttttattaaaagcttttggttccaactcnnnnnnnnnnnnnnnnnngtgatttttggaggttttaaaaccccgggggggggagcccaggtgtnnnnnnnnnnnnnnnnnnnnnnnnnnnnnnnnnnnnnnnnnnnnnnctaagcaaaaaggagaacccnnnnnnnnnnnnnnnnnnnnnnnnnnnnnnnnnnnnnnnnnnnnnnng

SEQ ID NO: 19548 - DNA, 491 bp, Diabrotica virgifera
  misc_feature (30)..(32): n is a, c, g, or t
  misc_feature (73)..(73): n is a, c, g, or t
  misc_feature (79)..(79): n is a, c, g, or t
  misc_feature (111)..(111): n is a, c, g, or t
  misc_feature (141)..(141): n is a, c, g, or t
  misc_feature (146)..(146): n is a, c, g, or t
  misc_feature (148)..(148): n is a, c, g, or t
  misc_feature (151)..(151): n is a, c, g, or t
  misc_feature (155)..(188): n is a, c, g, or t
  misc_feature (323)..(323): n is a, c, g, or t
  misc_feature (388)..(405): n is a, c, g, or t
acatgaggggggtttttcctagactgagcnnnacagggggataacctggagggggggccctttttgagagggnccgcgngcggccggggagcgggagggaggggccccgcngggggctttttcataaaaaaggaagggganagagnanttntaannnnnnnnnnnnnnnnnnnnnnnnnnnnnnnnnntgagagatgtgggggaggtatccgaagggtaattaaaagagtaagggaattaattggtatttgggagtgtgatagggggtgagttggtggttgtttatgggattggtgtggtgatggtgggggtttggtggggantttttgtgtggggagtggtgggttggagatggtttttttttggtgatgtaaggtatgagggggtnnnnnnnnnnnnnnnnnnggtgatagtggtatgagttgtggggaggttggattaggggtggtaggtgggattatttatggggggggtgagttgtgtgttaggta

SEQ ID NO: 19549 - DNA, 654 bp, Diabrotica virgifera
  misc_feature (464)..(485): n is a, c, g, or t
cccccgcgccgcgcgccaccgcacatcatgtcacgtctttctagtccctttataaaagctttagttgatagtgtccattaccgaagctctatgaaaaaacgaaaatgtctgtagacgagagattcctaaaggttgctggcgatatcgagagcttgataggcaagcccactagacatgatctactaaaaatttacggattgtccacacaagctaccgaatgagactgcacgcattccggaagtggactgttggaccttagaggaaaagaccgatggtagtcgtggaacgggaggaaagggatccaggctgatacccagctaagatgataacacgtcgctcaaagtacagccacttgatcgatagcttagagatcccagacggcttaattatcatcactttattttaagggaaaagtatcttgttaatcattatactctatggttctaataaatagattttcttgnnnnnnnnnnnnnnnnnnnnnngccggtctcctagatctaattttacctacgcgtcgcatgactacacccatactcttctattgggtcacccaattccatcccctgctcggcgttttacacgccgtggcctggaaaaaccctgggtttccaaatttatcgcgttgttacatttccttctttccccaggttg

SEQ ID NO: 19550 - DNA, 346 bp, Diabrotica virgifera
  misc_feature (176)..(214): n is a, c, g, or t
tttaaaccgctaatattgagtgtgattgatgatgtgtttgcccttacaggaggaacacttgttgcgaaactcgactacccggtcgaaaaaactcgcacaggaaacgacacgggcctctgccctacagcaatcccgcaactgaggaacgcaactcttatgagcactaccaccgaagnnnnnnnnnnnnnnnnnnnnnnnnnnnnnnnnnnnnnnncgactacctatccgccaaggatgggaccaaacatagacttggtgaggaaccatacccacagcaattaccgaatataccactcgccccacgagaactaaccctccacccaacagtgcaacaatagatcagcaa

SEQ ID NO: 19551 - DNA, 196 bp, Diabrotica virgifera
aatattttcttcctaacctagacatttgctaacgatctactgcccgatcacttaagtttctgaatcgtatcgtgtcgcacgaaggaccccatgatgcccagggatgtgctagtatcaggatctgtgctccggttgcccctctcctgatgtacggatccccgacggcgacacttctgacagaggtagtggctctgct

SEQ ID NO: 19552 - DNA, 703 bp, Diabrotica virgifera
tggttattgtatgtgtcagaaaatagtgaaaattttaagttataatgattttttttcgattaattaaagttatttattgtaaattactttagaaattaagcatattggataactaaatagagaatcataggttataagaacaatgcctgctccacccccacctccaccgctggctccggccgcgccccctcccccgatgttcaattcttcaaaaaatagtaaaagtagtagttctgtagatcgaggtgctttgttaaagtctatccagaagggagcaaaattgaaaaagacagttacaaatgaccgaagtgccccagcattaggaggttcttccaataaaccatcaaatggcagaatacctggaggtatgggtggcatgctattacccaaactgcccattggtggcatgtctcgtggcatgataggtgacaatcctataaatggtcattctagtagtgccggaagtgtatctcctggtagtcctttactgaagcatgattatttgaggcagtatacagagtgcactgaaatgagcccctcacctgatgatagcagaaattaggtcttaccgcctccgcgtatactctggatattattttctccaagatatctggccggatggtaaatactgtttcagagtaaacatcccctatcggccgcttaacttgagttcagatatgctttacttcaaaattcttctttc

SEQ ID NO: 19553 - DNA, 70 bp, Diabrotica virgifera
ggcccatgaacgcctcgccctgattaggggtaatttctgtcccaaattggaacaacattccccccccaat

SEQ ID NO: 19554 - DNA, 1142 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(461): n is a, c, g, or t
  misc_feature (476)..(496): n is a, c, g, or t
  misc_feature (525)..(568): n is a, c, g, or t
  misc_feature (636)..(685): n is a, c, g, or t
  misc_feature (689)..(779): n is a, c, g, or t
  misc_feature (794)..(836): n is a, c, g, or t
  misc_feature (844)..(952): n is a, c, g, or t
  misc_feature (954)..(1057): n is a, c, g, or t
  misc_feature (1073)..(1131): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaatacnnnnnnnnnnnnnnnnnnnnnnnnnnnnnnnnnnnnnnnnnnnntaatacaaaaagacatgttttttaataaacaggtgaaaaaaaatgttgcccgaattctttatttaacnnnnnnnnnnnnnnnnnnnnnnnnnnnnnnnnnnnnnnnnnnnnnnnnnntacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaatttttaaccnnnnnnnnnnnnnnnnnnnnnnnnnnnnnnnnnnnnnnnnnnncccttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccgccaaccannnnnnnnnnnnnnnnnnnnnnnnnnnnnnnnnnnnnnnnnnnnnnnnnnnnnnnnnnnttcctcccccc

SEQ ID NO: 19555 - DNA, 726 bp, Diabrotica virgifera
  misc_feature (17)..(79): n is a, c, g, or t
  misc_feature (95)..(114): n is a, c, g, or t
  misc_feature (331)..(362): n is a, c, g, or t
  misc_feature (391)..(450): n is a, c, g, or t
ccccgcccggctaggannnnnnnnnnnnnnnnnnnnnnnnnnnnnnnnnnnnnnnnnnnnnnnnnnnnnnnnnnnnnnngtggtgctgttcgcannnnnnnnnnnnnnnnnnnnaaagatagaaaccaacctggctcacaccggcttaaactcagatcatgtaaaattttaaaagtccaacagacttaataatatagctgctacaccaattataatctttagtccaacatcgaggtcaaaatctttattatcgatttgaactctccaataaaattacgctgggatccctgagggaatttattcttataatcaaaaaaattggatccaaggnnnnnnnnnnnnnnnnnnnnnnnnnnnnnnnnctaaacttattgtttaatcacgccaatcnnnnnnnnnnnnnnnnnnnnnnnnnnnnnnnnnnnnnnnnnnnnnnnnnnnnnnnnnnnncactctatagggccttctcgtcttttagaagaatctaaggtgtttatcttaaaaatagaattctttaatagataaattaatcgacgggtttttttttcctcccaaccctattgttcgagccattccataaaaaaaacttaattgattatgggatacctttgtcccagggcaacaccaaccgcgggcccatttaaaataaaatcactgggctgggcagaagagttttatttttaaaccacagaagcactctggctttctaataaaacagggcgcaaa

SEQ ID NO: 19556 - DNA, 588 bp, Diabrotica virgifera
  misc_feature (537)..(559): n is a, c, g, or t
tttcgtccgcctttgacagctggtccggtataaaaaaatacgataaacttaaacaagtaattaagcaaaattgcgaagttaattagagttatcacacctctaagaagaatggcttcagcagtaattccacaagtcaaagatgtagatatcgatgcttcaggtgtattcaagtacatccttataaaactgagcagcgctgcctccgatggaaaactcgttgataagctgattgttcgtggttatgctgagtgccctttccatgccgatattaacgatcaagtgacgtctgatctgcagaaactgaaatcgagtaaggtaatacaagattggagaaccaaggtgttgggcggaggacgtattcagcacgaccctgaggataagaagatattggtttacgggtattctcaaggttatggaaaagctgatcatcagttaactgtggatattttgaaaactgcttatcctgattatagtattacttactccgatgaaggatattaggatttatgtttaatttagcagtcatttgaattatgnnnnnnnnnnnnnnnnnnnnnnnatgtggcattgaactgaattatataagtt

SEQ ID NO: 19557 - DNA, 162 bp, Diabrotica virgifera
  misc_feature (57)..(70): n is a, c, g, or t
  misc_feature (72)..(87): n is a, c, g, or t
gtaaggatgataatattagcatcaaacaattgtatatctaggaaaaatatgtaggtnnnnnnnnnnnnnncnnnnnnnnnnnnnnnncaccaggttattataaacattggtccgtttgcggaatcaaataacaagtcctcgccctgcccccctttcctaaat

SEQ ID NO: 19558 - DNA, 75 bp, Diabrotica virgifera
acccggtacgtattaatgaaatcttggtccaaggtggaaagagattcagcctattttcgggcttattctttgaat

SEQ ID NO: 19559 - DNA, 673 bp, Diabrotica virgifera
tcttcgtccgactgcctaaaaatactatgggaagggtaaattttggtacaagatgttgtccaaatcgtttttctttttggagagccaattggaagcccaatgccgatttgcagctgcagcccctaccaaaacctaaagaggctagtgaaatctacaacaacgtcctatcagacgaaccagcccaaccagacatcttaatcataagaaatatcgatccatgtataaaacataatggcgcattccatcacacctcccgatatgaagttatggaacgggagtattatcccgaactggtggtccgaagaggacagagttttcaattagatatcacccttaatcggccatatgatgaaaagagggatggagtttcgttcatattatttctagatggtgaggaaagactgtcccatggaaatggttcgttagtaggggtacctttattaaagaaaccaaataaaaacctttcttggaatgttctactggagaaaagtgaaggttgtgtaataaccatacaaattactacaccagctgatgccattgttggaaaatggaacttagaagtggatacaaaactaatggataatggatcatatagctacagctgggaaaacaaaatctacattttatttaacccttggtgtgtccacgaccaggtatacttaaaatcaagcga

SEQ ID NO: 19560 - DNA, 889 bp, Diabrotica virgifera
gatgacctcctcattcgacttaaatttctgcccagcgagtgtcttttttaagtttggaaacaaatagtagtcgcacgaggccaaatctggagaatacggtggatggggcaacatttcgtagcccaattcgaccaatttggtcatggcgacggcagaggtgtgagccggtgcgttgtcatggtgggagagcacttttcctttgccaaatggggtcgttttttcttcaattcggcgtcgaatcggcccagtaattcggcataatagggccctgtgatcgttttgcccttccccaagtagtcgatgtagatcacaccttgtgaatcacagaaaatgctggccatcacctttccggccgattggacagtcttcgccttcttcggagcacggtcgccgggtgctgtccactctctcgactgtttcttggtttttggtgtataccagtgaatccatgtttcgtcgacggttatgaaacgacgttaaagctcctttgtatcacacttaaatagtgtcaaacactgctctgaagtggtctatcggttacgcttattgtctaaagtgggcaaacgcggcacccatcgcgccgacagctttctcatgcccaaaagttcatgcaggatatgacctacgcggccttttgagatgcctactgtgtcagctatctcgcgcaccttcagtcggcggactgccaatacaagatcgtggatttttgtcacgtgattctctgtggtatgcattttcggggcacctacgcgtggctcatcacaaaccgacgttcgtccacgttgaaactcattaaaccaatttctgacagttgccctccaaggagatgagtcaccgtacacatcatccaagcgctttttgatttctctgcgtgatttccctttcaaaa

SEQ ID NO: 19561 - DNA, 828 bp, Diabrotica virgifera
  misc_feature (681)..(708): n is a, c, g, or t
  misc_feature (726)..(744): n is a, c, g, or t
cggctaaaatacacataacctgatttttagttttctgtaagagataatttctgtaagaatttgcataaaaatggttattttaggagaacaatttcctaacttttcggcaaagacgacaataggagatataacattccatgactggttaggagaatcttggggtatactgttttctcatccagcagattttacaccagtatgtactacagaactagccagattggtaaagttaattccagaatttacaaaaagaaacactaaaatcattgctttatcttgtgactcagtagacagtcatttgaaatggagttctgatattcttaactatagtggatgtttagatggcacatttccttatccaattattgaagatcaagatagagatcttgccagtgagttgggaattattgattcagatgagaaggactctgatggcataccactttctgcaagggctgtgtttattgttgatccgaaaaagaagatgagactgtccattttatatcctgctaccacaggaagaaattttaatgaaattctgagagtgttggattccttacaactttgtgacaaacataaaatagctacacctgctgattgggtgcctggtgaagatgtaatggtacaacccactgtttctgacactgaacttaaaagtttgttcccatatgttaaagttannnnnnnnnnnnnnnnnnnnnnnnnnnnaagaatgataccagatcnnnnnnnnnnnnnnnnnnngtttttttctattgtctgttctcatatttgcataattatgtttattttgtaatattctttaataataaaaatacttaattagtt

SEQ ID NO: 19562 - DNA, 406 bp, Diabrotica virgifera
ctgctttctgctatgtcagccagcagaaacatcaaattcatgataaactgtagtgatgtttctgcgatgtttggttacaagcattattatctgtatcaagatccatttatgaagttttatatcatgaattttatcgaacaagtaaacagtaagaggattatcgaaggtaacaatacgacgatggtaccgtctatgggtacaaccgtatgaacaaaaagacgtaaagaaaatgacaaatagctcctatcaaagaagtaaaaaggctgtgatcatataaacaccacacataatctttaacaatagttattgtgatgtgtagataagtttattttcttttactgtgcaaataatattttaggaagaaagtgttctttgaatatccgtacaaaaatatattttagagacc

SEQ ID NO: 19563 - DNA, 930 bp, Diabrotica virgifera
  misc_feature (838)..(868): n is a, c, g, or t
atttatctaagattaacaaaattgcgatttacatttttcttgtgctgcacaccctttttagttggagtaaagtgttgctaaaagttgcgttggagcaacatattattttgtatttgttcagtccgtgtacaactttttttcagcctctacccaccgttaggaagctacgataaaatgcttaaatgaaactccaataagcaattccattcgccacgatctaaaccttgtccttaaaagaacaagcagcactatatgaactgcaagggctgatgcaacaagagctttgtctaaagataaacaaaagcgaacaagatagacattttgatgacgctaattccaatttttttggttatgatgctaatttccaagtttttctacaggttaaagaaaatttaacggttgaaacgaatctaccaattttggataagctaattattgagttatcggcagttctgttgacagcgtacgagtcagtgaactacatgaaaactatacctactgatgatattgaacctgaaatttaaaatgaacagcagttcaaatattttatagtccatcttcagtcagtcttaaggacttgcagcgaacacaatttattactgcttcatagtcttttttagttatctatgagataaaattcgaatcgaaagtttccaaatttgtcggtagcttttaagatgtatcttacgctaatgattacaaatccaacagacgaacggtcattttttcaaaagtgaaaattattaaaaaactgtcgacgtttcaacaatggcacaaaaacgactaaaaattttccccttaattattggctagggctattgaaaatgggggtggttcnnnnnnnnnnnnnnnnnnnnnnnnnnnnnnngctagcttttgtttgtatggaaacccataaaaaaaggtctttaatataaagggcttttttaa

SEQ ID NO: 19564 - DNA, 59 bp, Diabrotica virgifera
ccgcgggcccacccccttcccgccgcgcacgcgcgactaacctgcaaccgtaataactt

SEQ ID NO: 19565 - DNA, 830 bp, Diabrotica virgifera
gacgtccgaagcattaagtcggttgttgtctttaaaagctacagaagctgtgataattactttaggtcaaaagggagaaattttgacagaagagcaagtaaatgtggatctggtacagagaggagacattttgaaagtggtaccaggctcaaaagttcctgtagatggaaaagtgttacagggtcaatcaatgtgtgacgagagtcttattacaggcgaaagcatgcccgttcccaaaaaaaataggcagtactgttataggcggctcaataaatcaacacggtcttctcatagtcgaagccacgcacactggcgaagccacaactttatcccaaatagttaaattagtagaagaagcacaaacgtccaaggctcccatccaacaattggccgataagatagcaggttatttcgttcctaccgtagtacttttagcagttttgacgctgataatttggtcgatagtgggtgctatcgatatcaattatctacctctgggtgacagtgataaaaagggatttaataacacggaaattatccttcagtttgtttttagatgtgctttaagcgtgttagctattgcatgtccttgtgcacttggattggccactcccactgcagttatggttggcacaggggtaggcgctatcaacggaatcttaattaaaggtgcagaacctttggaaaatgctcagtaagtcaaagccgtgatgttcgacaaaacttggtacaataaacgaaaggtacacctggaaagtagcataaaactctggatgcatgggcaaacaagttctcatttccctctccgtcttcctagctgccgtggaatc

SEQ ID NO: 19566 - DNA, 236 bp, Diabrotica virgifera
gtccgccaaagctgatacgttttatgaattaatagcgcatttttcgttgagtcgttactacatatgtaggatatttttagaggaggcaacttggctcattcagaacgaagaaaacgaataagaaaatcggatgaaactaaacgattgaaaaaagacatttttgaataactgactactacgtccctaaagagcagttaaagcgcgtattggacgaccacgctattttacatgtggag

SEQ ID NO: 19567 - DNA, 190 bp, Diabrotica virgifera
  misc_feature (8)..(8): n is a, c, g, or t
  misc_feature (26)..(26): n is a, c, g, or t
aaaggagnaaaaaaagagcaagaagnggaagcggccgacgaagaagacgaagacgaggaagaagaggaaaccgagcaacagagcaaaccagcccccgaaggaggaagggacaccaacaaagagaggcgaagccggaacagagaaccagaccaaagcagagaaggaaccgaaaagggagaagaggaaagac

SEQ ID NO: 19568 - DNA, 523 bp, Diabrotica virgifera
ctttgccatgtcttgttatactttctaattacatctaaaaattccaatacactgctcccactgattcattacccgtatcttaacaatatcatattattcccttctcagtatacacatactattctactgagattactgcgtataatgttatattgagaatctaccttataaaccaaacactagactctgatagtaaaatcgagcacctaatagacagtctgaatatcaaaagattactagtttgtaaaacttatcaacctccaaagaacttccatctatatactctcagtcgtatgttagatatttccagtgataaagctgacttctaatagagccatcgaactcaccatatatgggaaatttcacttcttactactaggagtatgccggcttcttaatcacctccgacgatatggacgtcatctctatgtctttcatcctcccttcggcccagtgcgacttaaaccctcaatgcctcgcaccatagggaggctccatatcctcctatctttactggtatgat

SEQ ID NO: 19569 - DNA, 913 bp, Diabrotica virgifera
  misc_feature (46)..(46): n is a, c, g, or t
  misc_feature (194)..(208): n is a, c, g, or t
  misc_feature (458)..(477): n is a, c, g, or t
gaaacgttctcattctgaaatatcgtccccagttaatacaccaccnggtagaaaacacagcaatagattttacaaaacctaaagcaagatcaacaaaaaagccaagagtcactaaatctgatacaaaaactggagaaacagtttccactgaatcacttatccaacctgcaaaggaatttattggtaaagctttnnnnnnnnnnnnnnnaaactacacagagatagtcagctttctggatgatgtacacggttcccccaatccattaagtatcgcacaagaatacactaaaaacatatcagcactattaacaatgctaacagaaatctaccccaaactcgaaaacagacgaattaaatctagaattacacgaataaagaagaaaatacgtcgtcaactaaatctagatcgaactgaaactgataactccgaagatacagatgtttcccaagaaaacctnnnnnnnnnnnnnnnnnnnnaaatgtgctacgcctgtgacaccaatataactgtaggtcacattgttatagactgtaagtgtgcgttaaacagtgcggattgtgacaaaatcattaggtttttaaaggaaactaaattatataaccaaatatgagtgctacgtttcagaacaatcataaattaaaatcaactttgtaaaaattctgtaaaaaaactgtgtaaaacagtttatattttgtatcagagtggagccaaacctcagttggcgtgcctaggcatgccggtcgaggggcaaattcatcatcagcccccctcgtcatcgatctagcactctttcactggtcggtcgcaccggcgctccaaatcgcggatccgatcaaccagtgacgttcggctctttttgctgggatgtttcagcagaaaatatcggcatgttagtaaaatcgctcgcacccg

SEQ ID NO: 19570 - DNA, 949 bp, Diabrotica virgifera
  misc_feature (658)..(680): n is a, c, g, or t
  misc_feature (738)..(758): n is a, c, g, or t
cgccatctttacggacttaatatttcttttcattattctgctcttttccgaacatttcattatatatttgtttataaacttcttcaccatactggcactaggttaaacaactgtaatctattagatttacaaaagaaatagaacattaattttcaatacgtcgctttttcattataatgtttgccgcagttgtgaaagaaacaggacgagggaaataattctggacgagtctttatagatccagaaaacaatgttttattacaaaacactggccttaaaagtattattgattaaggacactagtcgtgtcttcttcttcttgtagttccttctcttatcggaggttggctatcatcacagctatccgtaccttattggcggctgcgctgaaaagatctactgagctgcgcctatacatactactctcttaggtttctcagccaggaaattcttaggcttcctatggatcttttacccctaattttaccttgcattatgagccttacaatctcatatttcgcacctctggtaatgtggcctaaatcttccagctttcttattttgatgttctttgaaaccctttctaaaattgtaaaaattaattgaagttttcttctaggaattgaattttctacctaattttctgcatactcgtacnnnnnnnnnnnnnnnnnnnnnnngatagccaggtgcagtacatcaaaaaataattaatatacattaaaaaactgattgcgnnnnnnnnnnnnnnnnnnnnnctaaacttgttgacttattttttcgaccattcggttttgttccttgacacttttgtcaacctgcaatatttttatttaaactttgttcaccggttcatattgataaaagcattttttaatacctgtggtcccaaacccttacttaggtttttactgggaatactttggttctttttacggtacaattgttc

SEQ ID NO: 19571 - DNA, 551 bp, Diabrotica virgifera
  misc_feature (303)..(320): n is a, c, g, or t
  misc_feature (425)..(460): n is a, c, g, or t
ggcagccaacacaaacaacacattgccacccgagcagcggtatcaagctcagttagaacagttggctgcgatgggtttccttaatcgagaaataaatctacaagcattgatttcctgctttggagatataaacgcagctatcgaaaagttactttcacaagggcagttatcttcaatgggataagttcagtatttaggattgaatatatattattatgaaatatggtagtttagtaaaactgttttggtgcatccacagatatattttgttttattactgcagacattaacaattttacgtgnnnnnnnnnnnnnnnnnngtatttcagtgggttttgaaactcattagaacaacgtggttaaattgaatttgaactttttttaatgcttaagtttcccccttttctgtcttggcacccgagagnnnnnnnnnnnnnnnnnnnnnnnnnnnnnnnnnnnnaagatctctgtgtctgatcatttttttaggaatattgcctctccgcctaatactgccttcctgttcaagatcaacctcgtgacctttctac

SEQ ID NO: 19572 - DNA, 755 bp, Diabrotica virgifera
ccgatcacacattggacttgcactggtgcttgctcataattactagttcatcagcaaacaacaaacaatggcaccgaggctagcgtgcctcctagctctggccatggcagccatcgtcgtggcgccgtgcacggcccagaactcgccgcaggactacgtggacccgcacaacgcggcgcgcgccgacgtgggcgtcgggccggtgtcctgggacgacaccgtggccgcgtacgcagcagagctacgcggtgcagcgccagggcgactgaaagatgatccactccggcggggcctacgtgagataacctcttctgggactccgacagagtcaagagaacagcattgatcgacgggaaacctagagttggctaagacagttacgaccagtagggatccttttctgtgtgtaggtggactccgtactgactatttggaaaatatgattgaataactactagactcagacaaaacagaatctgaaatactggttctggaaaacgttttctttaaaaccaagaactgttgtcactgatgtgagccaaaatgtttgaacgaaaagatgaacatcctggaaagtacactgtaactaacctaggtaaaggtgctttcgagattgagatagaaggcacctcaccaagtcagattctataaattgacagcaaaagccagttgagcctaatacatctgagtcttttgaactcacagtctcaattccaatctacgcgtttttggaagtctatcacaaaacccacact

SEQ ID NO: 19573 - DNA, 747 bp, Diabrotica virgifera
cgcccgtttctccaagtgaacaaaacagagtgcttcgtttttccagaagaaaaatccacaaaccgcatcctatcaaaatgagtgataccgtcgccgaagtcaaagaaaccgtcgcctctcccgagaagaaggtcgagaaagaggtggctgctgaaaaagtagaagtagaagagaaaaaagaaacgaacggcgaggcaaagaaaaacggcgtgtccaaggatgaagagtcgtcggacgacaaacccgcggaaaacggcgattcgaaagaagtcgaggacgatgaagaagccaccaaggcccagaagaggacgtccgacgtcgtcgacggagaggaaagcgccgacaaggacgtaagtcccgccaaaaagtccaaagtcgaagagaagtcggaaaacggctccgcggaaactgagaccgccgcctaaacttacctttttcctcgcatctctcctctatgataataacgaccgatcgttatccgggtcagactgttggtttttgttttttgaactttatttttcaattcggctctgttttgtgtgtttactttattctgttttttaatccacatttacccaaccacagttttgtgtattatatcgcgtctttgatttttaacatcattcctttcgtctttagttgatcattctactattttatttacatgtttttggggttgcgaaatgctacttactttatcgtcaggcttgggacctacttgatatacgtacctaaattcatctcttg

SEQ ID NO: 19574 - DNA, 887 bp, Diabrotica virgifera
tgattactcgcgaggtaccactattactttacatttccctactttcaaaccattcgtttacttctagtggtatctcaactctcttccactaatgactctcttgtgaagttgtttttgttgatagtgttgttttaagtggtgatcttaattcaggattttttcatctcatcactgatgtctgaaatggtttagcgattaatggattttagatgattcaagtttgcttcaagtgtatttattctactgcgaatttaaaatcagccgaagagtaaaaaaatgttcaaaatatggatcgcaatactagtggcacatttgagcttattaaaaacctctgccgggggaaatattctgatgattactttgggaggcacaaaatcacataaaattccattttgggagctagcgaaaggactaataccacgtggacacaacattacttttatcagtgcttttgctccagattttcattttcaaggattagaagagataacacccattaatttagtatattacgtgagaaattttaccaattgggacttggtaggtgctagaatgaaaggggaggaaccagttcctccattagatatggttaggtatgcatcagaggtatgtgatgtgttgctctcagattccgaaatccagatgtttcttgaagagaaacataaattcgatttattaatgttggatggtgaatattcccgaaagtgcaataggtttcgtttattaatttttaccgcacccttttatgtaacataaatacggtagggatttttaccctggaacctttgtcgtttgctggaaatcctggttcgtaatgaccgtaaaacccattcttattctttagataataccgaaaaatatgattttggaacagaaggcttgccaaa

SEQ ID NO: 19575 - DNA, 507 bp, Diabrotica virgifera
ggagattccccgggccgacccttttttccgaccggagaaccaggacctttttgattggaaggatgtccgggtgaaataggagaccgtggattctctgtggtatattggactacgaagagagaaatggcatgtatgtttccctgccgttataggaaatcttggtagcacaggtggtccaggagctaaaggagaacgagctttttctggggagaggtagattaccagggctgactatcaaggtgggataatgagatgcctggaatacctggccaattcgggaaagaaaggatacctggaaacccaaggcaaattggtgaaccaaggttgacatgtttggagggtagactacggctacctgggccacaaggatcactggatcttcagagcgcagaaggaagatcgaggttatgatggaaatccaggaccacaagggtctgccgggctcccaggacagtcattattacatatgcgcgccggaacaacgaggcgataaggtagaaagaggta

SEQ ID NO: 19576 - DNA, 351 bp, Diabrotica virgifera
  misc_feature (5)..(186): n is a, c, g, or t
  misc_feature (188)..(229): n is a, c, g, or t
  misc_feature (231)..(263): n is a, c, g, or t
ccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnncnnnnnnnnnnnnnnnnnnnnnnnnnnnnnnnnngattcatttatatagtaaatttatttagttggcgtgataaaccaatctcctttcactttttttacattattatatctaatctaataaa

SEQ ID NO: 19577 - DNA, 955 bp, Diabrotica virgifera
  misc_feature (27)..(47): n is a, c, g, or t
  misc_feature (824)..(825): n is a, c, g, or t
  misc_feature (840)..(840): n is a, c, g, or t
  misc_feature (883)..(883): n is a, c, g, or t
gaggttaggtaaaatgtgtaataaggnnnnnnnnnnnnnnnnnnnnnaatataaaaaagaaaatatggagattgatcccgactatgcagccaatagcaaagctttgcgaactaaagaagagaaaaataaagcagaaactcaattaacagaggaaatacttaccaaaactctcaatgacatatttgatgaggaattatcatctagggaaaagcagttagaagaacttgaagacaaaattttcagagcgcaaaaattattacatgtagtgcgttatgctttagtaaactcttactacaagaaaaataatttagaagtatctcctgatgatgaaactgtaactgcaggttttgacaaacaaaacagaattcatcctgcaattaaaaaactgttgggaagcaaccccagtttggatatactctgttccgtaaaaggcaaacgtagagttgcctcaaaaagctgtgataaaataggttctaagtctcagacgtcggaagctaaaagacctaaattagacattaaaacttcaaccccaaatccacacaataacagtgattgtgatcagacgttctcaaagaatagaaagaagacaaggcataggttggtgatcggtaatgtatccaaatggattcagtctttagaagataacacgacacataagtggatgatgtatgtaagaggggagaaagacaatccggatatatcacacattgtagataaagtagtgtttcacttgcattcttcttataggccgcatgatgttgttgaagttagggaatccccgtttcatctatctagacgagtttggggggagagtttcctcttannagtcagattttcttncaatgtccactaacaaacctggtcagtattgtacataatcttnaaattagaaaaacattttactggtcgtcagaccttaggaaatgaaactttgggtagatatatatctacatga

SEQ ID NO: 19578 - DNA, 378 bp, Diabrotica virgifera
aattcccggggccgaccctttcgtccgcgaagatgaaggtattagttctcttatctttactttgactcggggttgctctaccaacactccttgcgtagaaccggaagagtcacagaacatggaactgtatctcacttcgactctataggatgcaacatcataatcctcaatgagcgtcaacgatactttgcccaacaagcgggctgtggtcactgtggaaagaaaaaccgctttgaatggagtatatacaaaggagaaattatgtgcaacgtcatcgtacgcaagagctccttggtatgggcggctaataacactcctcccaaaccagccccgaatcggaatcagtactcgcgcttgtacataaactcttttcttccc

SEQ ID NO: 19579 - DNA, 273 bp, Diabrotica virgifera
  misc_feature (204)..(221): n is a, c, g, or t
attacacgctaagatgccatcgacatgaaatacaaatcttcaacgtttaacaaagatgttgacattcctcttaaagatgtaatggaagttatggatgaaactatcgacgctatctcggtctattatgtagatatataatgaatattgatgattatcgcccctatagggtatggaagacatgattaaagtaaattgaacccgaannnnnnnnnnnnnnnnnncgctttcgatctatgagtaatgttactttcctaaagtggcactaaaccccct

SEQ ID NO: 19580 - DNA, 202 bp, Diabrotica virgifera; identical to SEQ ID NO: 8432
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19581 - DNA, 60 bp, Diabrotica virgifera
ttacggcggaggagagagacactggctctgcgtacactatactctgaaaaagaagtttat

SEQ ID NO: 19582 - DNA, 503 bp, Diabrotica virgifera
  misc_feature (352)..(373): n is a, c, g, or t
agagtttcgatctgtacatagcttattttgcggattttcttaagtttctttcgtaattcttctaggatctaaagaattaagtgtaaatcttgcaatttattttcgttcacagcaaaatatatgtgcaacttaaatgattaaaaatactatagagatatcatttcctgttaaacaaatatatagaaatattcttctacgagacatgaatgcctaatcagcttgaattgattatttctacgtacattaccccgatggcagtgtttcatataatataagactgttagcaatagtattttttaagaaaataaccaattttgaattgtttctcatacagactgttaattttgtatcnnnnnnnnnnnnnnnnnnnnnnctaattttagataaacgaaggtgattgtacaataggtttattgaattctgccatcgcgtgggtatttctagctttagcattcaaatattgttttaagctttatttaacttataaattatacatttttgac

SEQ ID NO: 19583 - DNA, 742 bp, Diabrotica virgifera
aaaaatgcagaggatctggtggatgacctgagccatctccaacagctgctcttaaaacccatacgagtaaagtgtcattaaaaactatgagctaaactgagccaaccataaacgagagaaaagccaaacccaaagccatccacaacatacctacattatgtcatatgaggggaacagcgactgtatggcctcagatagagaaaatgaaacaaagtctgcacgatgaagcgggtaacaccgatgaaaattctacagaaaaaagagatgattcttctgaaaggtgaacctctctaatcgtgcttgagactgaatctgcagatgaagccaactggacaattatacaaagattatttccgaacattccgccctacattaggattgatttgctctatagccgaatcgtaagtacaaattcccaacgccaataaatatttctagtgaaagctcaggaccatcactccgctaatagatataaagaccttaaccaacagccgcggtattgttcttagttatagaagaactaatcatatggattgggatacgctgtttgtaagcatatgaaatccccaatgtttatcacttgaaacgaaacacaaaaacttaatcattttcctgggacgcttcgattgggaaggaaagatcggttttgcaggaatttccaaagaatgatgacaaagtctggcgctaaagagattggatttttatctcatacatatattctaactcacgaacttatgttatt

SEQ ID NO: 19584 - DNA, 298 bp, Diabrotica virgifera
tactatacttttgcaacttgaacgcttatgctaggaacttctttagagaggtttatgacgagcacagttaggaaggcgcagatctttatgttgtaaatgaccgaatttataatgtgacttaggacagctcatgcattgagtataacttgttttgactagctataacctattatcagtagtgaaattgtacaaacgtcctagaccctgaatcatatgatgcccgtaaataccgtcccctcgaagtagaacgaatacaattcatctcttgttttcccgcgcttcttttaccatgactatc

SEQ ID NO: 19585 - DNA, 236 bp, Diabrotica virgifera
  misc_feature (186)..(212): n is a, c, g, or t
cggggcgccccttaatttcccccttttttggggggattttttgcccttcccggttttttgcccccccccaaaaagcttgggtggaaaataaaaaaaaggctgacaaaacaagttggggggcgcccaggggggctaaaccccaaacttgaatctcaaaccaagcgaaaaaaaatcttttggaaaggnnnnnnnnnnnnnnnnnnnnnnnnnnncccctaggagagaaccttttttaa

SEQ ID NO: 19586 - DNA, 268 bp, Diabrotica virgifera
  misc_feature (118)..(136): n is a, c, g, or t
aaagaaatgaagaattccaacattttcccggggtcgccccttatttccccttttttttgggggaattttttggcccttccctggtttttgtgctcacccccgaaaaaacgctttgggnnnnnnnnnnnnnnnnnnntttgacaaaacaatttgggggggcccccaaggggggttttaatctcccaaactctggaatcttcaacacagccgcgtaaaaaaacccctttgaaaatgttttttcccccccccacaaaaaaaccacttttct

SEQ ID NO: 19587 - DNA, 1231 bp, Diabrotica virgifera
  misc_feature (46)..(64): n is a, c, g, or t
  misc_feature (1014)..(1033): n is a, c, g, or t
  misc_feature (1048)..(1072): n is a, c, g, or t
  misc_feature (1128)..(1152): n is a, c, g, or t
ctctagttctccaccaaaattttgctctccggcaatttttgttatnnnnnnnnnnnnnnnnnnnctaagttgaccggactataagtgctttcaataatgcactcacagcaggcataatatatcacatacatgtcagttatgctcttttaatattttctttcctctattgtttattaaaacatgataggtaaccaacattactttgtgaaagtcctagagaggtcaaagaattacgtttgttgtttatattatattttgttttgatactttatgagtacctaactaacctaactacagaaaaggaaaaataattcctgatatgatagaatccttggagttaatgctatgcttagtagcgaaatatagatatagtttgaacctttcttaataactttgttcattcaacttccaacaccaacgacgttttgtgatattttattttgcgtcgttatagtggagttttgcagaaatatatgtatttcatgatctcaaacaagcttgagtaccactgatagatcctttattgcaaactaattatgtgcatctatttttggtggtatacttaaacattcaaatgtcatttgctgatgcacttgaataaacgctcaagttatcgtcgttttaattcagatctaggatttacattaagaatactcagcgagttagtactaggagtagtttgttttgtactaatattgttcattttgccaactgggatatatcgatagtttgtattttctatattctatggaacagtatagacatattttcaaaatagaatgcttttatccaagagaaactttgtgaaaagatttttaacatcacgaaaagttgacaggtgttttaatccagtttttttaattcaataatcaatctgggctgtcaataaatctttgtatgtaatcaaggcatatgtgaataattatcaagtatgagtaatttagaaatatatacaaaactttttggaagtcttctaagtatataaaagtaataaaaaagggcgaatctcatacnnnnnnnnnnnnnnnnnnnngtcccaaaccattcnnnnnnnnnnnnnnnnnnnnnnnnngggaaaactaaaggggaaactccctctttgttttataaaaggaaatttttttggannnnnnnnnnnnnnnnnnnnnnnnncctggaaggcccaaaaaaaatttctcccagggggaaatacagcctccccctaaaataaaaaaacctctcacaatactat

SEQ ID NO: 19588 - DNA, 53 bp, Diabrotica virgifera
tgacgcgacctgaatcgccgcattaggcgatggcgactgtggtagtgcacgcg

SEQ ID NO: 19589 - DNA, 606 bp, Diabrotica virgifera
  misc_feature (144)..(156): n is a, c, g, or t
  misc_feature (159)..(173): n is a, c, g, or t
  misc_feature (532)..(579): n is a, c, g, or t
ggataggatagtacgaatagcacgagataagtcaccaaatggacgaataagtattgacacaacaagaaaaagatggtgcgataacctaaacaatttaggaggctaatattgaagaagaaacagacgttaaaaagcctacatacnnnnnnnnnnnnnccnnnnnnnnnnnnnnngagctaggtaaaatatacacacagttgaattagaggacgttattgaaactttagaaagcttcacatatttggaagttgcattaaacacggttggaacagaagcaccagaaatacacactcaaggaaaacaaagcttatttttcactcattcatgtgttccattaaagaaatacacacggtcaaaaatcaaggcctacaaaactattatcaaaccaatggcgtcgatatttgtacctatgaacaaaaacggagtatggccatccaggtacaaccatgaaatctgcaggtacaaccatgaaatagacaccgatctcataattcgttaaatttcatagtctttgatgggttggtcgcgaacnnnnnnnnnnnnnnnnnnnnnnnnnnnnnnnnnnnnnnnnnnnnnnnnaaagacagaaacaagaagagaagagac

SEQ ID NO: 19590 - DNA, 223 bp, Diabrotica virgifera
ttagagaagataatcaaatccaaaagatattagagcgagtaataacatagtatgaatacatcttaaaaaagatgaattacacgatcatctacaaaaataggatctggaaaaagactattaactaagaacgcagatcaatgtcacaggaggaggaatatcatcgagccctgtctttctctctaagcatattgcacgtactcacacacgtacttaataaatcccc

SEQ ID NO: 19591 - DNA, 907 bp, Diabrotica virgifera
  misc_feature (702)..(743): n is a, c, g, or t
cggacgcgtgggaaaacattgaaacagactgggaaaatatacgaagaagtatagaaaacacagcaaatacagtgcttctaatactacacagcaattctaattaactacttatgtgcaaaaaagcaacagtctgctttttaaaatgaggatggcacagtattaactacaaatattgctttttctcaaaagtctaaaggtacggatccaatcggtggtggtttataatttatatgtagaggagcgcattgccgcatccacacggagcaccaacgtagtggttacgtaccttaatactgccagtattaaagacacaattataaagtaaccagcaatgtttctttgtgaatatgtttcgtttttattagttcgttaatctctcttctttgtcttctgagcattctccatatttctttttgcgttcggtagattacgtgttccatctgttttgagaagctctgccagtgttccctttttatttgtctcactaattaaagtattcgtttatagtggttgtatgcctgttgtgtttgttttgttctgtattgtaaaaaggatctcttttttcttcacattttatcttcacttcctctctaaaccatgaggtttccttttttgatatgttagtattcgttactttcctcgatgatatcattttctaatatttcatttacaacaatctttttcctgatatttttgtgtatnnnnnnnnnnnnnnnnnnnnnnnnnnnnnnnnnnnnnnnnnncttcccccagccatctagaaatatagcagctgaaaagttttaaaacttaattaccaccccacaataaccatcttctttttgatctgcggttttgaaaaaagggcaatactataagtattcttaacttatccccggtcacctgaaaacctaaacaacatatccct

SEQ ID NO: 19592 - DNA, 395 bp, Diabrotica virgifera
  misc_feature (22)..(84): n is a, c, g, or t
  misc_feature (87)..(149): n is a, c, g, or t
  misc_feature (167)..(234): n is a, c, g, or t
  misc_feature (239)..(291): n is a, c, g, or t
  misc_feature (295)..(321): n is a, c, g, or t
  misc_feature (337)..(357): n is a, c, g, or t
aattttgaccggggttaagtannnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnncaaaagacccaaaaaagnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnncccnnnnnnnnnnnnnnnnnnnnnnnnnnnttcggggggaaacgcnnnnnnnnnnnnnnnnnnnnnacaccccaaataaaaaaaagtgcgcccccccccggggg

SEQ ID NO: 19593 - DNA, 177 bp, Diabrotica virgifera
  misc_feature (22)..(59): n is a, c, g, or t
  misc_feature (116)..(134): n is a, c, g, or t
  misc_feature (149)..(176): n is a, c, g, or t
ttgtcccccccaaaaaacaccnnnnnnnnnnnnnnnnnnnnnnnnnnnnnnnnnnnnnnggcccgggggggtttcatttaacattgattttcatcagggggaaaaacctttgaaannnnnnnnnnnnnnnnnnncgtttttcaataggnnnnnnnnnnnnnnnnnnnnnnnnnnnna

SEQ ID NO: 19594 - DNA, 851 bp, Diabrotica virgifera
  misc_feature (314)..(334): n is a, c, g, or t
  misc_feature (599)..(619): n is a, c, g, or t
  misc_feature (698)..(698): n is a, c, g, or t
tttcaaccggatacatgaaacgatcgtgcgcgaatagcgtacatatattgccactttcttaaataattcatatcataaaaaaaagtgttgggtgatttgtgataatgcgatcttacccttctaaaaatatgtcacgtatttcaccacctgcaaaattggaaggatactacaaatctgcgcccccacataagtggtctgtaacttcgacatgataggtgagaaattttaaacgttcttgctgctgattggataggaagggtagcgatatctagcctccacgctaggtacaccatagcctccatacggtacttccnnnnnnnnnnnnnnnnnnnnncaagtggacaataaaggtaaaacacaaacaacttttgtttcttaattatttatttatacaataatgtgacattttacatagaaatatgagtatttaatttcgattaaatatatgtttacttgttgaatttatcggctgcatacaacagctgatcggtcattagacccaacaacaaaacgcgaaataaaatgtgtattttaaaactgttggataaacagtacctacaatcagaaaaacttacctttaaaaaggtactcgattatgnnnnnnnnnnnnnnnnnnnnnacacgactgaatatcagctttttatggtgacacaaactaaacacaaacaccaaacacatcacataaccgaccatataanataagtgaacgacaacgaacgaacgaacacgaacacagattacagattcacagatagcgcaggatttgtcaaaagtcatgttccaccaatcacaatgccgacatcagcgcctctgactaaacggaaagaaaataaatacgattacatgttttt

SEQ ID NO: 19595 - DNA, 823 bp, Diabrotica virgifera
  misc_feature (761)..(761): n is a, c, g, or t
tttcgtccgctttcaggactcaggattcactgccatagcatgttattggtcgaattaaagatttatagattctcaaatgttcgacatttgtcagtacaaaaattgtcgttttctaccttaccgaatctattctgaaatatctgtcgaagctttgtacgaaactgagaaaagaattcaactaaactattattactggtatatgcaaatctgcatcagatattcagatgacacaatagtatttgcggacaacctataaagatctacaagtccttatgaccaaaatcacgtaatacagtcaagaatatagatcaatataaacgtaaagaagacaaagctcatgataattagaaaaagataacgtaaggtcaaccaaacccagtagaaagagtggtttactactattacctcggcatcaaaataaatgaagaaatggttaacaatcaggaggtaagagcttgcattgaaaaagttagatccaccttcaactggatgggaactttcttcaagagccacaatctctctcttggtataaaaataagaattctgcaatgcaatgtctactgtatccttgtttaccgtatcggaaaatacttacgatcctgtagacttgccgattcacaaatgaggaagtccttaaaaaaatgaagaagaaccgagaggtactgaccaccattaaatctcgaaatacataatacttcggacactttcatcatccagcctcataagtccactgctgaacataggcctcctcccctcgtttncatcccatctatgctgcgccgccctcatccagtttttatttacctttcttaagtcgtcagtc

SEQ ID NO: 19596 - DNA, 1141 bp, Diabrotica virgifera
  misc_feature (611)..(632): n is a, c, g, or t
  misc_feature (995)..(1015): n is a, c, g, or t
  misc_feature (1065)..(1114): n is a, c, g, or t
tgatatgatagcagcagccctaaaggttcaggattggaatgctaacaacaagaattatgctttcttattcaagaaggaaggagaagatcatgatatattgagaaaagaagattttgcggtagggttcatgaatgcggtgatggaagagaaactactagaattcccgaacataatttgtgtcgatgggacacatgggacaaataaaaaaggactggatttgacgattttgctggtgaaagacgatagaaatgctggattccctgttgcgttccttctgtcaaatagattggaccaacgaattcaagaagtttttttagacaccctgtatattgggtgggtaagttcaactgctcaaataataatattattagatagttccatattaatattattagataatgaattcttccccagagttcggatcacccatgttttaaatattctgcccaaattctgtccgtctctagcgctttattggtttttagtttcgtaattatttgtactacttcttcataactcggattttcaatgtgctgctccgccttataatatattgtctcgttttcattgtctgtttttgcatattgtcaattttgtctaaatgactctcnnnnnnnnnnnnnnnnnnnnnnctgctttcttgtctggttatgtgctctggaatttcttgtacttattttatccaagcgtctctttttcttctgcatgtcctagtcgctttgattctctcctcgttaaaaatttccctggtttttctggggattctttgaaagttattaagcctttttcccttcatcctgagaatccctaagcccttttttgatcttggttttttgggaaagttccctcttaacgtttttaatgttctaatgaaaaaatttcccccttggaatttatcccgggaaaaatgaaaaccccgcactcttggggccaaaaaacccataaaagaaatgttgggggtaaatggaaattttcccccttttcccccccctccnnnnnnnnnnnnnnnnnnnnnggccaaacaccttgttcaccaacaaaaaagttttttaaaaccccccccgnnnnnnnnnnnnnnnnnnnnnnnnnnnnnnnnnnnnnnnnnnnnnnnnnnaaggggggcgcgcggtgttacttatcc

SEQ ID NO: 19597 - DNA, 1301 bp, Diabrotica virgifera
  misc_feature (1155)..(1175): n is a, c, g, or t
  misc_feature (1227)..(1262): n is a, c, g, or t
  misc_feature (1276)..(1294): n is a, c, g, or t
caatccacgagcggagcagcgtgctcgattagcgtgataaaacacgcccacgagtgatggttggatgagttggaacaggaacaaaatcccattcgactttcacactgctgagtttttcattcaatgcacgggcggcatcatcaatgccggttaaccctatcagaccagaatttgcacccaaggatgcaatattcatggcaacgttagctgcacctcccgggcgctcttcaatagtctctactttaacgacgggaacgggggcttccggtgaaatacggctggtcgggccataccagtaacggtctaacataacatcgccaaccaccaaaacatccgcgcagtgaaaatcagggagtgctactttcatcccatgctccaaatatcaaaataaattgttgcggatattaccataaccagactgaataccagcaatatccgtcaggaaaagcgaccgttccagcgatgcccgactgcccataatcagctcagatcatccccaagccacttttgccagctatcgcacactaattcccgctgctggctgaaatgatcggcggaaacgcggctggacaatgcctgtaaggcaagatgatgcagttcatcgcgcatggtaatataagcctgcgtcaaagcctgcgcttcctgttcctccatgatattgtggttcgccattaattcgaatattcgtacattatcagaccaacgtgtcagcctggcattttcagcggcataacgcaggacctgatattgagcaataaattcaatatcggttatccctcccggatcagctttgatgtcaaattgatccaattgatggctacctaaatgtcggtgcatttttcctcgcatctcagagacttgctgccgcaaaagcgctggattacgaggaaggcataatgtttcacggcgaatgcgttcaaaatcatggcgcattttctcatcaccaaaaaccatacgtgccccgaatcaagggcctgatggttcccaagtccaccgcttcattttttctgattaatcatcaaagggattcaagggggactgaacaaaaattccccccttctccaaaaggaacggaaaaggggggtcaaagccaaaacaaaaccccccgaatgttgttccgggaactgaaaaaaagaaaaaatgggcttggggaannnnnnnnnnnnnnnnnnnnnggccccaatgggggggaaacccattcgggttatctctctccttttggaaaannnnnnnnnnnnnnnnnnnnnnnnnnnnnnnnnnnnccaaaaccccccgnnnnnnnnnnnnnnnnnnntttcccc

SEQ ID NO: 19598 - DNA, 132 bp, Diabrotica virgifera
  misc_feature (51)..(102): n is a, c, g, or t
agaaaaaaaatgcctgaaaaattcagttggggtggcaccaagggggtttannnnnnnnnnnnnnnnnnnnnnnnnnnnnnnnnnnnnnnnnnnnnnnnnnnnttccccccacaaaaaaccgtttttcccaaa

SEQ ID NO: 19599 - DNA, 737 bp, Diabrotica virgifera
acaatgctcgatccactaacccttgctgagagatcagcgatgcattatcgaatatggctgtgtggatcatgctatccctctgtctcctaaaattgagctggacaggcatgaacttaaaggttctgcccggcacatgcatcatcaaacgagcatacgtatcaagatagagccaagacgagtttgtgccgacaaactccaacgatacctaaagcctgactagctagatggtataaatatcaccctcgcaaacagtatctccagcgaatatgtgaaggagaactgcccttaagaagagctgatagacgcattcatcggacatttttcctccttgtcttccgacttgatgggaaacagcatacgggtgtccagtgacagaggttcagccaacaagtgaacgccgaaaatgaagctatacgaagatagtggttgaaaagaagttggcaaataagaatcgggaaaaactacatacataaatgcaggtatgctatgaggaactacaaaatcacttctcatcaacaagaaattatcagataccttgattttaaatagtacgacaacaccatatccttcaaaaaaactacagaggcatactggggctacacctatggatccagaactctctgcttggacacttggaaaaatgaccatccactcgacaagacagacatctttgctaacccagaatagaatgatgacgagaaaatatcaccatatgcctttacatccactagcagaat

SEQ ID NO: 19600 - DNA, 907 bp, Diabrotica virgifera
  misc_feature (542)..(563): n is a, c, g, or t
tccaggcggggcaaaaattgtctggctgccatccgctgcccttttgactgatgccgcttccaatgctttgttaaaaacattggacgaaccgccccaaaatacttattttttgttgcaatgccatcatcctgcaaatttattggccacattacgtagtgcgctgcttctactattttcttcctgcacctgaaaacacgataggggttgtatatggttgcaagaatcattcttccatgccatagacatcatgtgaatgcacaaactgcattagaactctctcagggagcaccattggcagcggagtgattacttcaagctgataaatggcagcatagaaactcgctttgtcaggcaattgcacaggtactgcataaatatgatactctttcacttttacccctgttgaactgtgatgatgtccaggaatctttgcattggttaatcagtttattatctgatgcagtgaaatggcggcaacaggcacagaattactgtgttaaccaagatcagcaggttttgattcatcgtcttgccgctacacnnnnnnnnnnnnnnnnnnnnnntacagttgatgattggatacgctgccgccatcaattattatccgtagtgggcatcaatcgagagttgttattgacagaacaattactcaattgggaaaaacaactttgttccacgcagtaacttatttagatatgagaatattatgtttttagttgattcgcattgtcacctcgattgccttgattatgaaacactacactaaagtgtagatgatgttgtagcataagcggcagaacggaatgtgaagtatatgctggctgtgacgacgacattacctggtttccaacaaatgaaaagcctgattgctaagcgagaaaatgtagactattcttgtggtattcat

SEQ ID NO: 19601 - DNA, 654 bp, Diabrotica virgifera
ttctctatgccacatgcatctgggataacgctttaaagtattgacacttacctttatcaacgtttgattccattccgactgactgtaaaagggataacccccataattttcttcaatttcttgacatgccactcctgcatgtctccgccatgcttgcaaagtttctcgtaaccgttcttttcttgcttcttcatcataagctgcacaatattctaggaaccttcatccattttttgagcaatactataggagatgttaatttcattaactacctcttctaatctactcttagccaactccatttcatgacgtggagctttttgatatataaaacatacacccgtaacacaatgatctgacgtcctgattgataaaaacaaatccctcacgaaatatctgttcccatatatcgtagctcgatcaagacgtatattttcactcaatacgtactcaacgtgtgcataaaagtgtggagctcaacgtcatggcaattactaacgatatgtttgatgaaagctaatacatttagaaaggttttcaagcgtccggaataactatactcctacatgcccgtcgcgggctggattggcgatcgaactcaagatcattccatagtgaaagaatatgcaactgaaattatggaactgaaaattc

SEQ ID NO: 19602 - DNA, 766 bp, Diabrotica virgifera
  misc_feature (577)..(617): n is a, c, g, or t
ttgcgtccgattttgatgatcgtacattgttaagattcaaatttttcttctccttccacgttcagtatacgagatgggacgaatccgacctcattcattgtagttctaattttccaaaattcttctttgtaaccctctttaccaataataatgacaacttcgtctactcttaaactaacttgaaatttatctttcgcatcataattgttaacaaccactgctttcaattgtcgaaacggccataatagtttcgtgtcttcggccaacccattaaaattttcgttgagactgtaattttgataattgagcactagttcttcaatactgttgaaaaacttcgattgagacaaataatactttttggagtcccttccctggggttcagttatacaacatatcttcatatgttttattgtatcagtctttaatgttagggcatatatgtcgtttgtgtcgcactgaggcctgaggcgaaccataaatgtcccgttctctctcctttccaacttcatactagcgctaaccctatccatttccccgacgaaccacaacttgtcccgtaacggatcattgaatnnnnnnnnnnnnnnnnnnnnnnnnnnnnnnnnnnnnnnnnnttttcccgctttgtggatgcatgatttatgcacgcttatgccacacgtagaacacttgtaaccttgaaaagttaggcctttaaggtacttcgagcagaacatactacgagtgtgtcgacgaaccgagtgaaactcaagattggggctgg

SEQ ID NO: 19603 - DNA, 144 bp, Diabrotica virgifera
ctttctttagtcgaatttatcgatgctctaccaacacttcttggtataaccgctctggtaaaagaagatgaaaatgttactctcaccgactctacaggacaccactctgtataatcctcaagagtgttaccaatcccagacaag

SEQ ID NO: 19604 - DNA, 564 bp, Diabrotica virgifera
cccttcgactgttagactgtagattttttaattgactgcattggcgccgtcataaatggcggtaatccatattagcccatcttttgagacataggttccgaaactcatggcaagactgggtgaagctcccagatcactctattataattggtatttgaacagactgcatcggagagtgcaatgaatctacagcatttgcggacgaacaagaagagcgaccagtcctgatgcacataacgacaacatacaggcacacagatatctagatataggcgctagtatgacatcgttcatgatactcataaaaagataacgtagggtaccctaagcacagtgaaaagaatgaatatctaccattacctcggcattaatcataaacgaggaaatggaaaaccactcaggaggatacatcttgaattgaagaagtaacatccgccttcaactggatgccaacgctcttgcagaaccacgatgacgctcttggtataagaaaataggtctgcaacgccatgccgactgttatcctttggttaccgtaaacgaaaaaataacttagcgatccct

SEQ ID NO: 19605 - DNA, 527 bp, Diabrotica virgifera
  misc_feature (225)..(255): n is a, c, g, or t
ggggaggaaaggcacaacgcgagcgcagaaagcgcaccagggaacagcaaggagggagccagaagtttataacgtcggggagacgagtgaaaacataagcgatttgtaggaggaccagaacttgaaagtggcgaaaaacaaagtatcacctgaacaggcggtagaaaactaagccgaatataccacgccgacatcggaaaactagcgaaagggaaggaacgatannnnnnnnnnnnnnnnnnnnnnnnnnnnnnnatcgacccaatacagacgagcacatgccagagaccacgggagagctcgcacaagatatacgcctagaggaatctggaataagacaaggccgcgcgtagcactcatgaaagctaacactgtggtgtccctggatgagacaggaagtgaggggaaggaacagatgtgactcgcataatcccccaacactcacaacccattcgggaggaaagcttagtgtaggacagacgcacttgccggagatacaaggcccgtaggggcaagccacgtgatga

SEQ ID NO: 19606 - DNA, 763 bp, Diabrotica virgifera
gctagatcctctagatgctacgccggctagtcctggcattgaattcccggcacatcccctattatcacaggatgctgctgctgaacctgacagaacattctcatgcgtagtggctgcttaacgagcatcaattgaaaactattcaaaatagataactctatctgtcaaaaattgattattaacgaccttcattgtatcaaaaaatgtattacctccactagatctgattacttctccatataatatgattacgaaaactgaattaaccctaatttcttagactctcatggccaaacatcaggatcactaccctcctgtcctattggatacccattactgtcacacatattcaactgataaacgatgtatttccgaatatctgataaaaaatcttttcagacgaaatcatctattcttccactacctatacgtactccatctacaaataatgcgtcatcatccattccttcccattgataatgacaactaacgaccatatcgttaaagagatattgcttaatcgtttggagtcctacctatgacaatttataaacttttgtacacttttcataaccacacctattattattgatataacttattgtagatgacatagatcctcactatgccgtgatagttatgtatattagcgaagcatcaagatgtaaatatctattaaatctatattgaatattataggaatatatatatcacttgacaatctcatctcattgatttttatgcactcagatattgtttaaaa

SEQ ID NO: 19607 - DNA, 218 bp, Diabrotica virgifera; identical to SEQ ID NO: 9653
  misc_feature (26)..(63): n is a, c, g, or t
  misc_feature (83)..(96): n is a, c, g, or t
  misc_feature (99)..(121): n is a, c, g, or t
  misc_feature (129)..(151): n is a, c, g, or t
  misc_feature (181)..(212): n is a, c, g, or t

SEQ ID NO: 19608 - DNA, 843 bp, Diabrotica virgifera
cggcgggaacgggtcgggatttccggggcggccccccctccggggaagtgtgtacagacaaacatatccctcaaactcatttcttatgtaggaccgatatgctagacgctatacgtcgatagtcccacttgtaaacatctagcaggcgatgcaagatggattgatcactctcgttggctcagcattcgatacacaatcaccaatttctatgatgccgcacaacttgaaagtcacgaaattaaaatgctttccagaactacatgtcagaaactgaacctactgaaccctgtagaggttccacaacttgtaaaagggatggaacgatattacacaataccatccgatggctacatagtatcgttgcatcaatcacgcgagcaatacttgctggaacagaagacttgcatcatgaatattggcctgatggatacttgaacaagatcatgctcgggtactcattaagaaatctgtccctgcggtatcctagcgggagacatgatattgctgagatctgatcaaatgcgcctcccatcatcccctaattatcacattcttactgttgctgaacgcttagtttatgcccgacgtacttgccggagataccgatgacggtaagcttaacccacgtgatgatttcgatgtttgtgctcgatataatactgataaagtggactatacatataactgtagtcccgtgaagatttgatgctttggtcttgaaggcactgcaaccaacagccatgttgaatatagtaagggtagtgcaaaatcctcaattgccatccattagtaagagtttcggtgatttcccaacgtgctcccacaacttgggagccttgcccg

SEQ ID NO: 19609 - DNA, 724 bp, Diabrotica virgifera
  misc_feature (341)..(362): n is a, c, g, or t
agctgaaacacactttatgatgttctaggtgtgcccagaaacgcaccaacccattacattatgaagcaatataagaagttatcgctagaatttcatccagacaaagacccaatgtgcactggatacactgtcccaggaaatgagcttatgtcctcacaaatgactctgtcaggactctcaaaaaatgagtgtctcctgagatgtaccgtgtggagcctcttcaggtatcgccagatgggtgactgcgcgatggtattgtggtgggatgactactctactattcactacttatatcggaagtctggtatgattttgagaggagtcatgtagtaggggagccnnnnnnnnnnnnnnnnnnnnnngacacagagtatctgctgaccgtatccctggaatagatgtgtaatgcaataacatccaaactacagttatttatgaaggtgcatctgtgatacttgcccggtttaaggtaggaactagtagttaacatactaaaagtgcatatacttgtataggatgggatttacctgctacgaatactcactttggtcgataaatgtcacaatcaactgtaacacgctgtccttactggcatgtggaaggtgtaataaacatcgtttgagataaatgctctaaatgtatggtaacgaacgtatgctccgagagtatgatactaaaagatcatgtcgatactcgcatgaccgaacaacaatagattttcttc

SEQ ID NO: 19610 - DNA, 520 bp, Diabrotica virgifera
  misc_feature (462)..(501): n is a, c, g, or t
atcctctagaggctattggcggcggcataagtggattgtttgatgcaggcaagcgccacggccggctgggcggctaagtgttgcgcgagttcctgagtattattggctaattcttcaggctcaaccacttgccagatcatgccccaagttagggcttgctccgcgctgattttctcccccaataatggcatccccattgcacgggcatggccaattttatggggcaagaaccaactgccgccggaatcggctgacaggccaatgcggcaataaggctcgaataaagatggcctcacgggaagcgatcacaatgtcaccggacagcgcaagggagacgccggcaccggcgtcaacaccgttgacggagtacatgatggacttggggaaagaaaccatgcaccgaatgatcggagtgtgacaccgtccaacatatccgccgagaccgcaaacgccgccctgatnnnnnnnnnnnnnnnnnnnnnnnnnnnnnnnnnnnnnnnngagaccggactgggaacca

SEQ ID NO: 19611 - DNA, 877 bp, Diabrotica virgifera
gttcgaccaacattgaaattactctaacagtagtttctatatattgatacacatatattgtttatgtaaaatagatactattattcagcctttcatcatatgaaaaatatcctgtgaatatagatgatataacttgtatctgcgatagatatggaatgccaaaccactgaacatcctttctccttacatatacattaatctccccaaacccatggttctaaccacaaaaacgactattaatctatttacccaagagtgatcttgatatccttctcttaatgatgataagacactcaagaaaataatttgcctacatatacaatattaagcataaaacgataaaaaataaaatctataacatctatcaaaaagtctctgaccattctatccaacaatttgaagaattttgtcttccactcattcatcagacatctatatcccaaaacgactaataactataggcattctcttcatctgaccaaatcgaaggcatatatgtcattactcaaaagtgaacactttcctatgagtctgttgcctcatacacaacgtctatcactgccacctgtggctatcgcacatctcggcatgatagcgacattaaatcaatttatgctgaccgctgaactcggcaattctatgacacggattgatgctcttattaccattatcatcaactctttaatcattgacagcatcacattcatccttgtatatgctggaatgagagaatattgatctgctattactatagctctagaagcagcattatctatcattcgatcttatgtatttgctcgtataggagctctatattctagagaaggaaattgtatccaaaacgctattttcgcccattctctaaacgtcgcctctg

SEQ ID NO: 19612 - DNA, 673 bp, Diabrotica virgifera
atacttcccctaccttctgcacaggctcattgcaggtgatcgtcgttgctgattattttgcgtgctcaatggtctactgattgggctttgccaaatgtatcttctattgtgttatactttacagatcctactcccttgcttaagaccattttcgtttcgcagatttccccgacatcttgattaacctctctattgctaatgccatatacaatagcgataattaaacctactatcttgacgatattcattgtgtcgatggaatcatcgatgttgttagagttcttcctgatttcatctactgatcgacagactctattaatcctttatcgagacatattatgaatgtccccttgctgaacttgcgggttctgatgtctgtataaacagatatggtttgagagacgaatgtcatggtatatgtggatctagttgccttttcattgctccactatgtctctgatggcaccttgatacttctctagaaatcaaaccgcgctctgatatcgaccgacaatttgatcagtgtgattcatctttctctggttgcaatggcgttataatgacagatgcctttgcatatgttatgagccactgacttgcatcacaaaagtaatatgctgacaccgtcacagatgttagctgctgaagaggatcaagaacactttctactatc

SEQ ID NO: 19613 - DNA, 629 bp, Diabrotica virgifera
  misc_feature (248)..(266): n is a, c, g, or t
attcctaaaaccgtttatgcaggatcgcaaaaatctaagacagaccgaagagcaaaaacctaatcttgttgaaattgccagtactattgtggattgtgtgtatgaagatgaagaaagcaataattatattgaggataacgataatgtgatagaagctgaatctgaagaagtaacgcctactttttcaacaggtgcaacaatgaggcaaagaacacctacacctacttccatgtcgaaaaaaagaaaannnnnnnnnnnnnnnnnnnaacctaccaattcagttgctagcgttctggaaaaatatttgcaaacgacagctgctgctgctgctactaattcaagtccaggaagcaatagtttgaggcaatttttcattgcaatggctgaaacagcacaatcattcccaccggcactgcaaattgaagttaaatcgaaggtttttaatgttctacatgaagcagaattaaaatgtttacaagctaaggaaagtttacagtgtcaaaagtgtaatgcagcagggttgcaaagtaattcctggacctaaataattaattacgtgtaacaaataaaatgtaaacaataaaataatagatgtaattattatgcacttaatataaaactatgtaatt

SEQ ID NO: 19614 - DNA, 933 bp, Diabrotica virgifera
  misc_feature (45)..(63): n is a, c, g, or t
  misc_feature (821)..(821): n is a, c, g, or t
ttcttccgctagttctcattttcttggctgtacgccacggatcannnnnnnnnnnnnnnnnnngactttcatatatcatttggaagcttaacaggaaaattcgtgaatatgatccgcaccggatatctgcgggaattctttttgaatgtctgattttgccgttgaatatatcaaaaccgaatatggcgtataggacctaaccacatacactttccacggagacctcatcgatactgagcccatgataatgaaaatatatgctccgtgttgggtacactgactcgacctaaaccccagaaaagtccacgtctgacgctaatcccagaactgatcggcaacatgcatcatatcaggatttgtttattatctcataaaagggtgatatcgcagataaaaaactatgaaaaggtatcccacaactgacttgcatcataagtgtattttacagggactacacacgaggatgacctgacgactatatctttatacgttcgtataacaccatagtacctccatctctttactgcatcttctttactgacgatacctaactgtcgagagtcatcaagggtatgtacaggctgacaacaaccaagcaaattataaattagatcttcaccactataaccgctatctgtcacccgattacaaggaaaagaagcttggtaggattcgaacaaatgagaagtatacatcataatagtcagaggcaatcctcttcttatcatgcaaagataaacctcgcctaaccctccatcttgtaattttagatgttccaaaattacgtccttttcccatatattgaacatacctgattgtanaatatgactctttagtatcatcacctgcatttatcgcagccatgagtaacttagcatcatcaccctttagcatgtcccagatctatccatcctaacttctctgtataaacca

SEQ ID NO: 19615 - DNA, 927 bp, Diabrotica virgifera
  misc_feature (302)..(329): n is a, c, g, or t
agaaaatatacagagaggaggtctgaccaaattccccagaaatcatcatgtggttattctgaggatcttcaaacatattgcctccaccttggaggggatttgaggtacatagctatgaaccaacattgaaccagacataaagaaattatgtgagtatcaccaggcccaagggagaaattaacaattattactaaccatgttcaccaacagtggacaaaatgcaagaggcacaagatcgaaatagagggaaaattatgagagagatatatgtccagcagtggacaagcgaagattgaatgatnnnnnnnnnnnnnnnnnnnnnnnnnnnntaaaaataaatcaatattgtactgaataattttttgtttcaatttaattggggagggggccgattatagtattcacaaccggtgaaacctgtctaagggggcgatttgagattttcaggggggcgatagagcgaagggggcaatatggggggcaatagagaaaatggggcgataaggtgggcgattagcatctgtgaaaaaagaaatgggaaatagagaagaaaaaactatactttcgatcggatatccataggataataaaaagtaattaaatgtacaccaatgcaggtaataataagacaatcatctcgtctagtaacagagggccccgcagcatgaagcttgcggggggccccaatcgcttaagggccccatcttgtcatctgatattatgtaaaaaatctgttcttgttatattattttacgttgtctgtttaaatttaaaaacgtaaaaaatttctaactaatagacgtattttgccagggaatcatcttcataatatctagaaacttaatcccctccggcctaccgaaaatttatgacagcgaccataaaaactatataaatgcttttgtacgtgactattgaaaaaaaata

SEQ ID NO: 19616 - DNA, 459 bp, Diabrotica virgifera
gtagagcgattactcgatcagaacgacgaagtaccaaacttcagtgatcccgattgactagaaaaacgatgtatcggaagaataacgctttagcgatgatttaaaagaaagtcctaaggaaactgatgaagtagaaagggttatagaaggacaaggagttccacaagtcggccctaatagtattgaaaagtttaagtcattgatggtcaaaatatttatgaggtgtgagctagaataacagatgaatattaccctggttatattgaaggtcacaccaaaggttacatctttatagaattatacctcgccatcataagctgctgaggatgagaaactcagtagcaatttgaaactgaatcattaccatatctttcaagttaacgtctgtactgactttgctaagtacgaccgaattcctaataaatgggaccatcgagagcttcaaccttacataggaca

SEQ ID NO: 19617 - DNA, 844 bp, Diabrotica virgifera
  misc_feature (409)..(431): n is a, c, g, or t
gatggtacgcctgtaggatgcggcctggtattatcggtccgacccattaatccgcgtattatatcacttctctttaaatgcgctttcccttactcaacgaaaactgcctttgaataaacttgctgattctgagtacagatgcttactgtatgtctcttcatatctagaggataccaaatcaaatacctctaaaaagataccgaatccttacaagattatgcctgccgactagcttctgactgaagaacctatatgtgccgagctgattaagctctgataattgaacatattatcatccgatttaccctctttgttgttccattatatggatagtacgatcaatcatgatattcttacatgtattcttcaattacatgagggaactcatgtttacctttattactatacnnnnnnnnnnnnnnnnnnnnnnnttaatgagattgatatcgttgaccaaatcttctacgatggtatatatagactgctatgcatactatggaatgatttgaagtacctgaaattgcccacgtgcctgagagcatctatgctccgctgagatgatgtgacacaatgaagagctatgcctcttgaacgacatctggaatatgcaaatcgtacaaccagttatcttgaacgaggtctgtcgtgaacttattctccactcatagatttccaaactcttctcgaacaaatcgaacgacaatgtcgacttcaacaaggtgtatagagacatcgacaatatttgccccaactatatctatctggagagtctcttcttgaagattagatgaacactatccatatcttgaaggcgatctacagacaataacttgaacaatctcca

SEQ ID NO: 19618 - DNA, 816 bp, Diabrotica virgifera
cgactcgctatatcctctagatgctaccgctgcacgcgccgaaccggaatcgccgcgtcgacccactcataccatccacggccccgaaaatcctggaacccgatcgcacaccaacattcctgtcgtacctctagttctgattttctctcctattgttgactgaatgcctgaatgccagatacccaaagaactacttacctatcccattgctatagacctagcaaaataccgccccagtggaattgctcgtatgttcctcattcctgtatgtacccgcgacgatcgcgagaaaaaagctagagaacacgaatcctacgtcggatccaaacccaccccctacgatttccccgccttgatgaattgccgccgagatgctagaccccacggtttaaattcaacagataaaatatttgttcctactgccaatcacatgaatgagattcctaaagcacctttaacaggaaatactagatttgaacaaagaggaacgacgctcgctcgatggcattgataattacaaccacatgactgcaaccacagaaatctactctgccggatgctagaaacgatacattgaccgacacctcacatacaccgggctgttaaaagcctgcatcttcccagcgaaatcgccatgactcacctctatcattcatcgtgtgtctattaagctaacatatactcaacgatcaccctctcacgatggaggttgatactgaaagagattagggagacaaattcttcagggaaattaggcgctgtaaagagtgattgcggcttattgtgggtccagtcttgttgtctctgaactatatc

SEQ ID NO: 19619 - DNA, 730 bp, Diabrotica virgifera
gctatatcctctagatgcaaggtgtgcgagcaccgggccggaatacccgattccaccgcataccattcgtccgaacatttcgattgtgaatataccttcatgctctgcccatacaaattgacctgagtcgctatctattctcacccactccacaaaccgtgaccaccgatatatctcgatcagatgatggatgataacatctgcaccatgttcaacgcactattcaagcaaagcctaacgacgaaattatctgcgatcccaggaagaccgcggcaatgattcatctctgccataacttgactatcaatgatgtttccactgatattgaaaatggattaccaactgacagctttgtattactcgacaattctcccttcggagtttgccacatcacaatgatcgacttatcgagattcgatccccatattccagacattgctggtcattagcacatgcgctccgccatataatattgctatgctgatgatgatatccccaggactggctatgacactgaatggcatagaaaattgcatgacattccacaaaacaactaccacaccaactgttccaccttcctgctgatttacaactatttgcagaacatcggtggtccgaatcatactgcgaaagtcaatgtagcccacaactctctttccaactagatccttgccattgctcagaaacatcacacgcgtattatgtcgctccgacacaccgacacaatcac

SEQ ID NO: 19620 - DNA, 87 bp, Diabrotica virgifera
caaaaggatgaagataacaaacgttcattctgaatgtacatcttagatccaatctacaagatttttgactccatcatgaactacaag

SEQ ID NO: 19621 - DNA, 840 bp, Diabrotica virgifera
  misc_feature (165)..(195): n is a, c, g, or t
  misc_feature (771)..(798): n is a, c, g, or t
atttgatcgattccgttcattaaactgtcaagtgcttcaaactcgtcgagataatgaaagtaccagttccagttactattactacatcttgtaatctacatgtgctctccgtgttgtggcattgataaacaatatgtgatttgtgtttttctaatgttttctcgnnnnnnnnnnnnnnnnnnnnnnnnnnnnnnnctatttgaaaaatgacgttcaaaagtcttcttcttaaggacatctaccatttcgatatcgttgattatgctgtcttctcggccatgctgttgctatcagcattgactggattatattttggttgcagaggaagatattgcaaaagcgaagctagtcaaacacttagcgaatacctcacaggaaacaagaatttgaaaccctttcctgtagctctctctttaatagcaagttacatatcaggagtaacaatattgggtacaccatcagagatttacaattttggaacacaatattggtttatagtgatagcaatatggctgagcggtttagttgtctcaactgtataccttccagtatttttgactctgcaagtaaattcttcatacgagtacctcgaacttagatttagtagagttgttagaacaatggcatcagtattgtttattttagatgaggtgatgtttttaccaatcattatttatgttccttcgttagcatttaatcaagttaccgcaatagatattcatttgattggtaccgtagtagcagtagtgtgtgtattttatacatttttgnnnnnnnnnnnnnnnnnnnnnnnnnnnnattcatggcaggttatagcgatgttcatttcagttgtagtgg

SEQ ID NO: 19622 - DNA, 1154 bp, Diabrotica virgifera
  misc_feature (584)..(601): n is a, c, g, or t
  misc_feature (672)..(692): n is a, c, g, or t
  misc_feature (861)..(874): n is a, c, g, or t
  misc_feature (877)..(894): n is a, c, g, or t
  misc_feature (1024)..(1042): n is a, c, g, or t
gttgtgaacctggcaagtccacaactacaagatttgtacaattggctggaagtggagttccatcctttactattgtgtcagagagtgtatgaggtaatcaaatctctcgaatctgaagaaaatgcagccctccaacaatatgtgccagctttacaagatgtaactctggtgcgtctagtgagacagatagcacaagtctatcagaccatagaatttgctaggttgatccagattgccaaatttactacaccttttcatctggagagacttttggttgattgtgtgagacacaatgatatgcaaattcgtattgatcatggcaaagactgtatccactttggaatggacctgagtgaaagccaaagagaggacaaaccagagggacccactttgcaagttatgcctagtgagcaagtcagaaatcaacttattaacatgtctactgtattgaatcaagccatacaagtcattaatcctaataagaagaagcttgaacgcgaaaaacttagagctgttatggttcagaattatcacgaaacaaaggttagagaaacattgtctacgaagacaatcttaaggaattnnnnnnnnnnnnnnnnnnggaaagaaagaagaggcttttggaaagaaagatccaaagaaaagaggagcgccgtgctacatatattaaannnnnnnnnnnnnnnnnnnnncgtagagccaacgaaaagagacgtcgcgaagaagaagaaagggagagattaaaggaaatagcgagaaaaaaacaggagcaaccagaacgcgcactaaaggaggaacaagaaaggaaaaagaaaggaacatcaagagagtttggatagagcttggaacatgagaaaggtnnnnnnnnnnnnnntcnnnnnnnnnnnnnnnnnnggagaaaggaaagcagcgaccaagggaaaaatttctgggaggaaagaccccaagaaaatctccttcttggaggaggaacaaaaaacctgctggacaaacccaaaatggaccccttggaaagcattctccnnnnnnnnnnnnnnnnnnnaaaaaaccccccaaaaggggacaaaaccccccttacttctctctttgggaaggaaagtaacaaaaaaagggaaaaaacaccaaaaaacccaaccccccaaggggaacccccc

SEQ ID NO: 19623 - DNA, 866 bp, Diabrotica virgifera
  misc_feature (255)..(286): n is a, c, g, or t
attcattaaaataggacggctgcgttggatgggacatgtagaaagaatggaagaaggcgaaataccaaacaaaatattcaaacagatgccagtaggaaaaagaacaagaggaagaccgaagctgagatatttagaacaaatagaaaatgatataaaaaccttaaaaataaaaaactggagaaaaaaagcacgaaacagatcagagtggagaagaatcctggaacaggccaagacccagaaagggctgtcgagccnnnnnnnnnnnnnnnnnnnnnnnnnnnnnnnngacttaattgaaactttaaataataaatctactaattttcacaacaaactagacactttttgagtgtgaacaatttcacatttatcaaattgttaatttctcctagcctactttaggcttgtttattaaattaaggtggaccttttttccctaattcttctataggtccacatttcaaatgtggacctatagaagaattatgagggattcctgggtagatagagttactaacaatgaagtgctgagaagaataggtaaagagaaggaagttgaacttacaattaaagaaaaaaagctacagtatctcggacatgtgatgcggggcgagaagtatggcatcctacgactcataatgcaaggaaatatagatggcaaaagaagcattggaagaagacgaattttatggctgaagaacctgagagaagtgtttggatgcagctcaaaacaactatttagagctactgcttcaaacattaaaatagctatgatgattgcctactttcgtagcggagatggcaccctgaagagaaaaagattaaattaagcagaaagtgaggatatattgatcaaaaacatggct

SEQ ID NO: 19624 - DNA, 884 bp, Diabrotica virgifera
  misc_feature (358)..(380): n is a, c, g, or t
  misc_feature (438)..(462): n is a, c, g, or t
ccccgcgtcccccccctcgcccgcccaatctgtacgctcctcattctttctttttgtattatttgctcagaatgtttcccacttcagtaccacttctaatacagacatcataacctaaatctatgagatcctagaatgtcccaattgacacaatcatgtatggctttaatccctgtatttgtattttattatagattattctacttgatatcactataaacatcccttgatttaacaaggattcctgaaactttctatggaagatactcggatataagatgcgtcttctattaatgatttcgcatctatggaggttcacagaaatacacttcatttgaataacctactgaactctatnnnnnnnnnnnnnnnnnnnnnnntgcaaatgcatatagctctcttacctcgagtagtatatctcgaagaaccttcataacnnnnnnnnnnnnnnnnnnnnnnnnnctaaactattttgttctatgttgttaacattgatattgtaaatgactctcaaatattagtgtacaatcacatccatctatccctgcatgaaatacatacgatattaaaaacgagccagcaggatgagaactactggttctactatgttcagccgatccatattgactctactgaagttactttagataatgaatctatatctaaattcttacatatgatgataaagtgataatgatggacaagacgtctcaatggctatttatgctttagtgctggtgtcgtaacgagacccttatgtttattgatgacaccgttaatccattataatgcacttctctttgttagtgatatgatttgaaaagtaacattgttatatgtctttttcaaatcagcctattcttcttggttcctttatgcttagc

SEQ ID NO: 19625 - DNA, 940 bp, Diabrotica virgifera
  misc_feature (774)..(774): n is a, c, g, or t
atttgatgctgatgctgagcttgagagattagaagaagacattcctgatgactcggatttaacagatgaatgcaatgataatatgatagatgaatctattgtagcgaaggaaaagggcaaccaatttgttaaaagtcaaaagtgggaagaagctataaaatgttacacaaaggctattaaatgttactcatatgatcctatattttatgcaaacagggctctttgttatttaaaactcaataagtttgaagaatgtgagaaagactgcgacctctcaataaaattggatgacacttacgtaaaggcgtaccaaagaagggcagcttctagaataaaacttagtaaattcgaacatgctgaagtggatttaaagaaagtactgatattagaaccgaaaaacaaggaggcaaaagctgaattagacaaactgtctatacttttgaaaagaaatgtagatgtagctgatcaaagacctatctcaaaatttactgcatccaggaacaaatcaaatagctcaaacttaaaaccctttatgccaatttataagcctccaaaggataaagaggttagcaacgagttaccacaacaaataattgatgatagtacacctattccacattgggtctcagatccagaaataattgaagtgaaaccagttaaaaaacctcctcatttgagatcaaaaaaacctcttaaacggataaagataactgaaattgataatactaacacaatccttgatgtgtctaaaccagtaaataaagaagctgttanagagcatgttttagagaagaaagaaaaataataacaaaacaagaatctgttaccacaaagatcaatatcagcttttaaaaaagatagaaaagtaaaattcgttcaagaggtcgataattcttttgacgaatctcaagaatctcaccacccaacattgcattctact

SEQ ID NO: 19626 - DNA, 832 bp, Diabrotica virgifera
  misc_feature (674)..(715): n is a, c, g, or t
  misc_feature (729)..(746): n is a, c, g, or t
  misc_feature (781)..(782): n is a, c, g, or t
gaaaggaccaaagatcactaaaaactcgtgagaaaaaaagtggtaacgggtcgagcaagaaaaggccatatatttatgaaaaacaaatgtggtttttaaacacaactaagacgtccagacttacaacgggaaccatggacaatgagagtaatgaaagcgattgggatgcaaacacagaggaagaaccgtttataattgaatatgatacatctaccaacgatactggcaatagtgtaattaaaaagccacctcataaaaaaagtaatagcgatgatgactacgattctcaatttgtagatattttaagaaatagtagtagcccatttttatcatcccatccatctgtcgaagcacaggacggagacaaactgtttctcctttcgttattgccttatttaaaggaaatgacagattttaacaaagtcgatttcaaaattaaagtaatggaactaatcaaaaatcaaatggattcgaaacaaaaacagtaaaaccactcagttgatcagatgtttacactttctcaggcatcttgagatagcagatttatctatgcccaacaacgccaattcactgatgctgcatcaattggtacatctatcgtttcgcccgtctcaagtactcaatactccgatgaagatatcttatacaccataatgtaattctacctattttgnnnnnnnnnnnnnnnnnnnnnnnnnnnnnnnnnnnnnnnnnnatgtgtgtatggannnnnnnnnnnnnnnnnnatctagttatatatttgttcatattcattatattnnatatataacattaattaatattcattaataattactacagtttttatcag

SEQ ID NO: 19627 - DNA, 810 bp, Diabrotica virgifera
tctagaggcaacttatgaaaagtgacgatttctgacatgcccacaatggactaatccagcatctcgcatgataagaatattggtatcgctgatgccattgctccaatgcctactcgatctattgattatcaccaactctggatacataaacgtattccgggcgctcaattttttgaccttgataaagttgccaatctacgaccaacctgccacgatgctgccagagactacaaatcatgttcgcaggatgcctgcaacatgagtagtcagcaaaaatcatcgtagagcgtcatttactatcatcggaaatatggtttctgccccaagggcctgtagaacatttaatatctttgggtccccacatcttcgaattcttgaagggacattaccggaccggcagacggcacgccatccaactgactcaggtgaagatacccatcgtccgcctgaaacgtatcaatatacagctctactcccgatagaaagtctagatctcagacctcagatactggaatcactacatggaaagactactcaacggattattgatgccagagcataaaaccgctttcacgcaaaaacggcgaagcctcgcccagggctgacaatgggtcatcttccggtatctaaaaatgatccgaggacatcattgattgataatggcagctatacatctacacaagagactgctgcaatcttccagactcacgacgccgacttagatcccccgattattaccagatgctcatatggaatgactatggccgatatagacttgatgcatgacatgagtggacatcaacaaaacgt

SEQ ID NO: 19628 - DNA, 684 bp, Diabrotica virgifera
atcctctagaggcccatatcactcagtcgtagagcggctactccactcccctcctatcacttctccaaaaaagaaatctctcttacgcattacactttgcctcctttaattgcttgctgtgacatcttgatccagttcaacgatctttcacagtcaacatggtggccagagccaccaactactgttttgtatgcctccgaccctgccgcacggggtaccgccagcataaacgaaaaaataggtccattttgaatagttcctatcatcattgcactgaaaggtatctttatagatggaagatttgaacccgaaaaattgatcacatcttttgccaccctttcacagtcacggcacaccttctcaaggatgttgagcttcgcatcgacattgactacatcaagcgtaactatggaaggaccgcccatagacaatcccaacaacggcagatgaattatcttggatacatacatgatctctctctatatcgatccaatgacctttctggaaaaaaacatcgaacacggacacacctctgaccactacagcaatttgatttactcctgactacacatgctgctcgaacagataggaggattcatacattcttgcctctcgtagaatgacacatgaaatgctgatgctaaaagacgatccggcagacctgccaatcccatctacatacaa

SEQ ID NO: 19629 - DNA, 356 bp, Diabrotica virgifera
  misc_feature (15)..(15): n is a, c, g, or t
  misc_feature (18)..(18): n is a, c, g, or t
  misc_feature (30)..(30): n is a, c, g, or t
  misc_feature (36)..(36): n is a, c, g, or t
ttagagggcaaaaangangcaaccagacangaagangaccccttaaaggatgaacgagaaaaagaagaagccccaacccctcaagaacaaaagaaagaagcaaccacacaccgattatttttaaagggactgctgagagtcatcaaaaatgcttgcgcggcgcgacaaataaaaaagactagcgtgagagatgcacgacaaaacgcaacagcaacgcatggagccacatcccaatcacagagcctggcgagaaaacgagacaggcaggcaccgaacgacattctgagaagttgggcagcgtgaaagacgaatgcgacccggcctgtagcgggggatcaagcacgggggatgtgttg

SEQ ID NO: 19630 - DNA, 992 bp, Diabrotica virgifera
  misc_feature (564)..(588): n is a, c, g, or t
tcgacatcatgagtccgttagattaccctaaagaaaacggaacgattcgaggaatgctaatgacagatattgaaattgcattctcggttagaaaccggcgattaagatcaatgcgactcataaaaagcagtgatctttgcgccggttttttcatcgagcctttaatgagcttagaagggagctcctgtctgttcagggaaatacccaatagacttcaaatcatagtgattaacgcgataacttgaaaaagctaaagcgataacgcagttattctatcgaagatagaacaccacaagtgtgaaactaaggataaggtgtgcgacgatgggtagacagaaagcagtgactaaatctcgccgtgaagttcgtaggatgttaaggaaagatatgaagcagttacgttatcggaataatgataatgtcacttcactggtacagattgacggcatagaggccattggaatgtcgcgtgataacagggatacctcagcaatattaccacgcactgagactcagtaccgctatatgcgggcaatcaatcataaacaattaattattgctaannnnnnnnnnnnnnnnnnnnnnnnntatatcagtatcgtgatggcagtggatgcgttaattaataaagaggtcaataaaattattgtgacccgcccggtattacaggcagaagaggatctcggttttctcccgggagatatggacgataaatttgcgccttattttagaccggtttatgacatattattaaaacgcatgggtgcttcatttctgcaatattgtttacgccctgagattgtcaaagcagaaattgccccctttgctgatatgaggggaagaacattcgagaatgcgtttgtaattatagatgaagcgcaggatgtgacgaccaatcagatggaaatagtcctgacccgttttggagaagatgtaacagtcattgtgaatgtcgatattagccagtgtgagctgccggagatatcacatct

SEQ ID NO: 19631 - DNA, 514 bp, Diabrotica virgifera
ttcgtcgcgagtttcgtactgtcttgcgctcatttaacatcgttctggtgtgtaagtactcctactagcttacaatgtgtcagatgaaggacaccccgactatggacccttcttcggacacttgttagccgcgtaatgacgtatcatacttcagttcaactgatgcgccgtctatgcaacgccctaatcaagaaccgagtattgccgctatcgtgggatatgaggacggaacttatgcatgaagatgtattatccccgtatgtcagtggcgggtatcattgccatctacgctctggtcatagttgtactgtgtctctggtaacattccagacagctctacatattcattgcacagtggtattgtccatttgaatgctggtctttccttatgagtttcactgactcgcggtaggtgtcgctattgttatccccgctgacgctgcgggaaaagtgtacggacaactgcaaaaactcttcgaacgaatgaccttgagacgcaatttccgcaaaggat

SEQ ID NO: 19632 - DNA, 1166 bp, Diabrotica virgifera
  misc_feature (54)..(81): n is a, c, g, or t
  misc_feature (968)..(986): n is a, c, g, or t
  misc_feature (1126)..(1158): n is a, c, g, or t
ggaagtcaatatttattcagtactggaatgattagtaaaagtaaaaataaaccnnnnnnnnnnnnnnnnnnnnnnnnnnnncaaagataaaaacataacattcactccaaattgaaaatttttataaaagttgtttgtgcatcttggtttttttctgtatttataaaattatttcatttttaatgcttcttgatagttccttgttgggaagtacgattgaatttaataaaatagtttctgacggaacactcactgagcaccctaaaatagtaattgaaggatttagctttccatcggagttaaataatggcgggttttccattttagcgaatggtttgtttggatctggatccgacggtgttccttcaactcgtgcccatttacccactcttgaacctcgtccgatgatactgtgtaggactaagctacgatcttctatcgttgcgtcattcaaaacgatactttctcgtattcgtactccggatcctacagtgacacctgctcctatacttacattgggtcccaacacagccgttggatgaatcgatgctgttttatctatgaggacatcggggtaaattacacaccgttcttcattacctcctggtgaacataatctttctggaaagtttgccttataaagctgcaagtaatgacgattggcgtagattgctgaaccggcagtttttaactgggaccaccaatttgtgactggtaacgcatatatttgtccagatccggcaaagtggagctagtatttcttgttctagttggatattcccggcttctctgttaaccatttcccgtttccgtttttgttgtactgttcttggagtttcatactaaactgcgccctattgtgggggaatattttcaggagaaaaaaaactaatctcccaccatttattcatggtggacacatattaaaatgtgggttttttaaaaaaattggggcctttcccaaagtnnnnnnnnnnnnnnnnnnnggatccaaaaaattaagagaaggaagtttaaattggctttgggtcccccttattggaaaattatagatttttttttccccaaattttttcccccgggtctctttattgggagaaaggggggaaaagactccagcctaacnnnnnnnnnnnnnnnnnnnnnnnnnnnnnnnnntttatttt

SEQ ID NO: 19633 - DNA, 808 bp, Diabrotica virgifera
  misc_feature (545)..(564): n is a, c, g, or t
gctatatcctctagaggccacgagtgcgggttcgggtgatgcagtgcgcggtcagatagatgaactgggcattgagctggaagatggcccaccgggaacaacatggagtcgtaaataatcaatgttgacttaattgagcgttgaagctcctttgaaccgccccttatgtggtcggttcaggttttatcacctttacgctttaatcgcgatatttttaactgtaatactgagttgtatacagagcgaaataaaaaccgacggagttattggcgaatatttatatactcaggatagaaagtatttccggtgagataggtcttttttccacaaactgtgtctcgtttcatagcaataaaagaggaatggctcagatgctcggacatttgatgggtgccatcacctgaacctagatgaagaagagatatttttactctacgtttataattactgaccgtataacacaaacccaacaaccttcttgcagctctattacttaacataattagctccgtttcagttgtacgtaagtcttctcagtatagcgnnnnnnnnnnnnnnnnnnnnagtaatacggtggaagcttagtcaggattgcgctggcatcacatatttcttattaaagagaaaaaacagcaccttacttgtatccgacgttccacaccactttcaggaatagaatgattcaataggctgccccaatattttcagtacttcacttatgatacatctggattcccgtcaccatacggagctcctgagactctagagctctactcactgtcgaactctcaaacgaccgacttaacga

SEQ ID NO: 19634 - DNA, 959 bp, Diabrotica virgifera
  misc_feature (648)..(666): n is a, c, g, or t
  misc_feature (789)..(789): n is a, c, g, or t
  misc_feature (808)..(808): n is a, c, g, or t
  misc_feature (816)..(816): n is a, c, g, or t
  misc_feature (834)..(835): n is a, c, g, or t
  misc_feature (885)..(885): n is a, c, g, or t
  misc_feature (927)..(928): n is a, c, g, or t
gttggaagagtgtggcgtagcaatgtattgtgatctccacgcccattccaggaaacataatatttttatatttggttgtgaaaatcgacgagggagcgatagaagattgcaggaacaagtatttccgcttatgctacataaaaacgccgctgataagtttagtttcgaaagctgtaaattcaagatcaagaagaacaaagaaggcaccggaagggtagtgatgtggatgatgggcatagcaaacagctacaccctggaaacctcactagctggatcgacattaggctgtagagcggacactcacttcagcatccaagatttagagcaaatgggcaaaactttctgtcaaacactgttggacttctacgatgaagatcccaaaaaggaaaaattgagggtgaaaatagtggaaaggttggtgaaagagggatctaatgctgaggagcccaccaatattaaactcagtgattactcaagtgatgatggggacacgtccaatagcagcgatgaagtcggacgggactacgacgaagatattcaactgccactagttcctccgtgttcccccatagtgctagtgaaaaaaaccagatcgaagttctccatctcggcaccaaaagcgaggcctcaaaacgcaaccctgaagannnnnnnnnnnnnnnnnnnacccctaccagtaaattaacaatagtaatataatatagagggtgattcattgtgagtgtccagtctccgagttgtggattctggacctcgaaatgttcggatttggcccaaatcacttattanaatgtgacttcttgccgangtgcattnatgttttgtttaaagatnntgagaaatgtttgtgcccagtagtacttgaggactatttgacgtgtcttngtcatctggggggggagggtgtttttactgtacattctactnnaattagatagtaaacgtttctggctgctatc

SEQ ID NO: 19635 - DNA, 992 bp, Diabrotica virgifera
  misc_feature (218)..(240): n is a, c, g, or t
  misc_feature (815)..(831): n is a, c, g, or t
  misc_feature (961)..(988): n is a, c, g, or t
tcctctagaggcgactcacagtgctatcttgatgtaatgcgattttgtcctccaacagaggcgacacccatctttacaacaatcacttggaacaccccatcttcagttgagccgtgagccgcgcgcattacccaaattggtgattaaacgcaagccggattctctgtttgactaccgttttgaagactttgagattgtggattacgatccatatccgnnnnnnnnnnnnnnnnnnnnnnnttaattttgaactgattcagtaaataaaaattcatttcacatttttttccatcctcgaatttggggatggaaaatttatttatccgcatcaattattcatttcattaatcgtatttcaaactgaaaattcatcccgcgagaacttgacattttttaatcaatcagtagattgactgtttataacatcaacagcaggcgaaattgacatgttaaatatctcagaaagtaaagcatcatttatgaccggccaattgagcctggatgctgtagtcatcgacatattcaaatataatgatggttatattgttattacggataatagccctttttatcccgaaaattataaatggggagatcaaaaaagtgatgttggagtaatagaatttaataaccacatattaaatattgtcaaaacctatactgcggcagtcattgacgggcagatttatattgaccagaatatacctgataaattgaatgcagaagataaacttattccagcacactatttagagtcgttaaatgggctggaagataaatttatcttaggtggaaatattaaattatctgttgannnnnnnnnnnnnnnnnaaatcagtgccgcgcatagcttggaactttttatgtcttttaccctttaaccagccggctaaaaaatattggaataaagggtatgaaacgcgattaactttacgaaaattttaacctagagtatagaagnnnnnnnnnnnnnnnnnnnnnnnnnnnnggat

SEQ ID NO: 19636 - DNA, 903 bp, Diabrotica virgifera
  misc_feature (15)..(707): n is a, c, g, or t
gatcctctagaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctttgttctaaattacacaggagtaaatcaatgacagggactcgtattttggcatcccgctcgtcttatttaattactctctgcgttccaagatctcaatgcaaaacccgtgagagctgttttcatttacatgaagctatacggtcgaaactgaattcccttcgtccggctcagaatcgggcacatgcgaatc

SEQ ID NO: 19637 - DNA, 1048 bp, Diabrotica virgifera
tccaacttttcgcatttccagtcaagatagtaatgatcatctcttttcatcaattgatggaaaaatttccttatgtctttttcatcatcatattcatgggaatgtggaagaatatccattacaggaaaagaatttattataatatcttcaagatcattgtcctttcttctttcactaatcgcccatttttttatcaggagtaattcatttttagtgaaaactttatacattgggccttcaaaagatgttaatttactgaaaaaaggcattttatttgcgttttcacctttaaaccaagatgaattcttcaaatggaaaataaattcttgcggatcttttttcatcaattcatccaagggacagcgattgatcatttttttattatgataaccataggccattgaacttttacctataacgattttctccatcgctaatgtatgattgcggatctttaaggttagctttcttaaattatccctcagatgatattttatatcacttaatttggctactgcatactttaaataaaaggggccattttcttttttaaagagatttatcactttgtaagcaattatattccttattttttcttctattgaatttccattttcagcaatatttgcagcagaggatacatcatttgatgacttaatagtttccctcaaatgttctatgccattaaaaaacaataaaatcaaatcagcaagaataatagcatctttctgaattgacgatttaaggttagaaattgccagtcttatcgttggcatggcaaaattctcatcaaaatggactatatcttctatagcctcattagtgagctcaggtgatacatttgcttttctattttgtttttctaagcatctaagtaactcgaaaagaatgaaataatcacaggatgaggaatgatgtgatacccttgcatcaaatgaacagctaacgggataactggccgaaattttgtctaaagatccaaatcctcaaagccttcataagagaattcttgggccgcgttttaaaactggaaaatgttttatttaaa

SEQ ID NO: 19638 - DNA, 809 bp, Diabrotica virgifera
tctagaggctcagatccgcagcgttcgcgcgttcttgcgtgcgcggcgacgaccctttttgtccggcctgaaacgatgattgcagccgatgacctcatctctaatggaagagtccgcctgccgtttttcagggactacaccctcaacgaatcctcgcccttcggatgcatcgatggtcagaaatatgtctgacgcatcagatacagtttaaagccagattctcgatgaaatatttccgcaagggagaaaggtgtttctgctgtgaccttgttctcctatcatgttccaagcgaaacaaccgtgatttccccgaatgactatgaaggccactatgcctttgatttactgatagaaccacagaagtgatattctttcgaaatcgcggaccacggttactgatgggatctataatggctatgttgctattttgtaccatgatctagctatcattatctcgacccgatatgaccgggttaaaccggattatgctgaacccttggaggacaatgtcggtgctgatgtgtctatcaaacggactgaccccatcaaaggggaagtaatagaggcaggtaagtggaggaataattcagctcgttatgctggtcactcagacgaaaagtgacccatgagagtagcgttgacccactactgatccataacaagatatataaccgaaccttgtgagcccttcatgaatacgaccggttgagtatgaggcattatctgatggagtatgctgataactatatcctgaggtcagattgtgcaacaatcattgtctcgttgagaagcctatcatcatctcagaa

SEQ ID NO: 19639 - DNA, 233 bp, Diabrotica virgifera
ttctttgagacaaggcaatatgaccccgcacgttggattaccatcgaatcaactgccatatctatgatcttcgagttatatgataaagatcttgtggtcatcaccaccgttgaccaacgtatgaaagatgtgacaggttccttcggtaaccaatatcgactgtcctgaactcggccaattcacttgagaagtgacggccggccttagtgctcttagtacctccaggatgcgta

SEQ ID NO: 19640 - DNA, 1236 bp, Diabrotica virgifera
  misc_feature (112)..(131): n is a, c, g, or t
  misc_feature (197)..(214): n is a, c, g, or t
  misc_feature (222)..(260): n is a, c, g, or t
  misc_feature (273)..(589): n is a, c, g, or t
  misc_feature (591)..(641): n is a, c, g, or t
  misc_feature (643)..(665): n is a, c, g, or t
  misc_feature (667)..(709): n is a, c, g, or t
  misc_feature (711)..(737): n is a, c, g, or t
  misc_feature (739)..(769): n is a, c, g, or t
  misc_feature (771)..(906): n is a, c, g, or t
  misc_feature (1020)..(1039): n is a, c, g, or t
  misc_feature (1046)..(1063): n is a, c, g, or t
  misc_feature (1119)..(1148): n is a, c, g, or t
  misc_feature (1165)..(1232): n is a, c, g, or t
cgaaaagactgtatgtttttgctccgcttgacatatcagcggagtattaattaccaattatatatatattatgttctaatttatcagagctaaaaaagtaaaatttttatgnnnnnnnnnnnnnnnnnnnngatttcttggtagggccatgttattcgtttataaatatatctacttttttaggaaagaaattaacnnnnnnnnnnnnnnnnnnctgtatannnnnnnnnnnnnnnnnnnnnnnnnnnnnnnnnnnnnnncggatgagctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnncnnnnnnnnnnnnnnnnnnnnnnngnnnnnnnnnnnnnnnnnnnnnnnnnnnnnnnnnnnnnnnnnnngnnnnnnnnnnnnnnnnnnnnnnnnnnngnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctttagggataacagcgtaatttttattggaagagtgcaaatcgaaaataaaagaattgcgaacccccaatggtgggattaaaaggtttaataaatgggggtaagccacccnnnnnnnnnnnnnnnnnnnnctccccnnnnnnnnnnnnnnnnnncctgagtttcggaagtttaaaaccgggggggggggccccgggtggggttcttaccnnnnnnnnnnnnnnnnnnnnnnnnnnnnnntacgcaaaaggggaccnnnnnnnnnnnnnnnnnnnnnnnnnnnnnnnnnnnnnnnnnnnnnnnnnnnnnnnnnnnnnnnnnnnngaat

SEQ ID NO: 19641 - DNA, 315 bp, Diabrotica virgifera
  misc_feature (235)..(256): n is a, c, g, or t
gggacctttcgacccttttaaagtgcaagtacttcagacctacagaagtggatcttccattggtagacgcttctaaagctgaagcaaagttaagatgggcacccaacgtgacatttttagagctagtgaaagatatgatgtactccgaataggatttaatgagaaagaatcctatggcttgaacatgtacatattttatttgtacattcatttacttggtcttctttgctatggnnnnnnnnnnnnnnnnnnnnnntacagacttacggtaaaggtctttaaagacaataaaaagagaacgtgagtaatgaatag

SEQ ID NO: 19642 - DNA, 756 bp, Diabrotica virgifera
ggcagttcgtttcagatcatctgtccatctcataggaggtctgcctctgggtcttttgtgttcgtatggtcttcatgttagaattgttctgtgccatttgttaagatcgctcctaactacatgtccagcgtattcccatttcaattttagtgatttttataccacatcggtgactttggttttctgtgttatccatgtgtttgttttcctgtccttaagtgatatgccaagcattgctctttccatcgcgtgttgagtgactctgagtatgttcatattcttttttgtgattgtccatgtttgtgccccatatgttaatatcagaatgatgcatgcatcaaaaacttaagatctaagatgtagttgaatttgctgatttctgagtatatagttcagtttgccgaatgctgcccatgctaactttcttcttctttttatttcttccgtttgaatttccctaattagtattatttttttcctaagtatatatatattcttcaattttttctataactttgttgtttattattgtcatcgtttcttcggagtgcatgacttttgttttgtttaaattcattatcagtcctattttagaaaattctctgtgtagttccgaaagcaaagtttgcagttctcgtaggtcagtagctatcaggattatgtcatccgcaaatcgtagattattgaggtagcggccattgatgtttattcccttatatttccaatttagatttttaaaaacgtcctccaaaacta

SEQ ID NO: 19643 - DNA, 1062 bp, Diabrotica virgifera
tcgctcccacggaaccggacgtgacagtctcccgtcatccggctcttgtcgttgaccgttcacgccgcgtacaaatttcccagtgtgcaaacaggccgggcttagcgctctgtatccttctcaaccattcatatgcctgagccaggctgccgtgtacccgcttatatttgcgggcgacccatttcgcaaggtgcagatctatatgactggctatacagcccatcgctgatcgataaaagcgcccatagtacttaatccagcctcgtaacatgggattgagccatcgcgccatgacttccagagacaacggggttttatgactcagatcccaaccccgtaccgtctgccggattgccttcgccgctctggcgcttatcgctggcaggaaattcaccgacagctctccctcttttgagaatgactttcttggcctgaatgtatagcccaaaaagtcaaagctgatttcaggatatgcctccgttctttccctgtccttgcaatagacgactttcgtcttgcccggactcatttccagcttacattcacccaggcgcgctctgagcctgctacgcaacatcattgcctgcgcatggctcttgcagtggatgacaagtcgagtcgcctcggggaacctccccccaaggcgctcacggaaccggacgtgaacgtctccgctcatccggctcttcccattgaagcctgcccccatagtcgcggccagtgggcaaacaacctcgtttcactccgcgcaacacgcgctggcccgtcgccggtggccccgaagtcgcttatgtttacgggtcagccataacacgagtttgcgatcgatttgcctcagcgttggatacagtgccgatttataaaaagcaccgtaataatttatccaacctctgatttttcccattgaacatatgcgccagatcgtacaaggacttgccactgcgattttgcagaccccactcctcccccccggaggattgcttttccctggtccggaactcttcccccggatggagttaacgaagggcttacccccacgaattcttccaaaaacggggccgg

SEQ ID NO: 19644 - DNA, 58 bp, Diabrotica virgifera
gactcctatagggaagctggacgcctgcggaccggccggatccgggtcgccctcgccg

SEQ ID NO: 19645 - DNA, 800 bp, Diabrotica virgifera
aagaaacaggttcctaacctttcagttgactttggtaaaaatattctagatcagcttaagaatggcgctgataagacagttgaagttgttaatggtgttttgagacttccaacatccacagatacagactcagttattccagttgatgagaatggtaacattgttctaggcggccgtccaagagacagttctgtagtgctcgattttggtaaaaatgtcttagatcaagtaaagaatggtgctgataaaaccgtcgaagttatcaacgatgttttaacacgcccaacatccagagatagagacgcaactgtagtccttggaggtaatgaccgacctgttcttgttgaccgtccaacatttgaccttccaacatccagagacagagatgcaactgttgttcttggaggtaatgacagacctattcttgatctcccaactttcagagacagagacgcaactgttgttattggaggtaatgacagaccacttcttgaccgtccaacatccagagatagagatgcaactgtagtccttggaggtaatgacagacctgttgttcttgaccgtccaacatttgacctcccaacatccagagacagagatgcaaccgtagttgtcggaggcaatgacagacctcttcttgatcttccaacatccagagatagagatgcaactgtagttattggaggtaatgaccagaccccttcttgaccgtccaacatccagagatagagatgcaactgtagtcctaggaggtaatgaacagactggtggttcttgacgtccaacattttgaccct

SEQ ID NO: 19646 - DNA, 564 bp, Diabrotica virgifera
  misc_feature (29)..(46): n is a, c, g, or t
gcagtatatatttctggaaatatagtacnnnnnnnnnnnnnnnnnnccaatactaaatatcgttaccttataaactttgccaaatcggcttattcacaaaagacacggaacgaacatcataaaagcctctataacgtatcagtctgaatcggacccactttcagacaggcacaaatcgtcattgagcaacctcgtgtcaattttcataggagcgttgttgctaccgttgctgtagccgttcgttttgccagctggagcgttattaaacattgttggattgactactgtggagggttcgtcactatccgaatcgctgccgctactcgatgacgaagagtcgctcatcactccaacgccgttgtcgatctttacagtgggcactggagtaggatttggccgtttttccgtaggtggtcgctggttgctcgaattttgagatgatctggaattgtgcataccagacgagctgtgagcatttctagaaggaggcctaagatccgaaaagtcgtctatgcctatcatcggaaggctggcaagagtactatgattatgtgattcgttagc

SEQ ID NO: 19647 - DNA, 119 bp, Diabrotica virgifera
gaaaatatattaggtttattaagggaatccggcaacactttttttccacctggttaatttaaaagcgatggtctttttgggattgaaacaataaagactcgcctgcccccttgagtaaa

SEQ ID NO: 19648 - DNA, 210 bp, Diabrotica virgifera
tttcgtccgggcgaagatgagaaaattaagtgatagttctggagaatggggtacgccaagccatcgggatgtgaaaacgagtcgttttgcgcaaggtatacggaaggtgttacattattgacacgtggttttttccgaggcgttgcgcatgcacatggcgtttgcactactatgagcgcggtagataggttgaataatcgtaaaatccgc

SEQ ID NO: 19649 - DNA, 871 bp, Diabrotica virgifera
  misc_feature (29)..(70): n is a, c, g, or t
  misc_feature (187)..(210): n is a, c, g, or t
cattacttaaatatttgtgaaacaacaannnnnnnnnnnnnnnnnnnnnnnnnnnnnnnnnnnnnnnnnnagtgttttggtgaaatttacagtgacaatcaaaatttttaaatttgacgttttattttgacagttttgtcaagaggtggtgttattgatcctgtagaggcccaaaaaagccaaaagnnnnnnnnnnnnnnnnnnnnnnnncaaaatgggtacacataaagtggagttgtatatttatgatctatcccaaggcatggcagcaattatttcccctacaataataggaaagaaaattgatggaatttggcacacgtccatagtgatttataaccgggaatatttcttcgggtccagaggcgttgaaagctgtaatcctggtactacagcattagggcgtccactgagggtagaagttttgggagagacacaggtcccctacactgtgtttattgattatttgaaaggactatcagaatcttcctttgccggtaatacatacagcttactccaccacaactgcaacaacttctcccatgatatagctcaatttttgtgtggagcgtcgatacccaagtacatcttagaccttcccaacgaagtactcaacaccagtttgggtcccagctttttggctctagtgtcgcggttggagaacagcgcgaggcccatcagagaggaacagaccagtagtattaaggagcccagtcccgatttcgaccagttaaactcacagatagaggaagcaagatataattcgtttctattggagcagcgcagaaagagcataaaggataaaatagccaagaaagagaaaaagcgggagaagaagcgcaaaaagatactggaatcaggcggagtttta

SEQ ID NO: 19650 - DNA, 741 bp, Diabrotica virgifera
  misc_feature (313)..(313): n is a, c, g, or t
cggacgcgtgggggaaaaattattaactttggatggggataaagtaataaataagcgaccgtcatcgcttcgacgaaataaacatttgaagtgaaatcttctttagggacgttgtgctctttttagatggaaaaaaagtattaaattatcgaccgtcatcgtgaccgtcatcgcttcgatgaaataaatttgtaaagtaaaaacttcttgagtgacgttgtgcactttttgaatggggaaaaagtattgaattaggaaccgtcatcgcttcggcgaaataaatttttgaagtgaaaacttctttaggtgacgntgtgtactttttggatgaggaaaaattattaaattaacgaccgtcatcgcttcgacgaaataaattttttaagtgaaaacttttttagggacgttgtgcacttttgtatggaggaaaatattgaattagggccgtaatcgcttcgacgaaataaatatttgaagtgaaacttatttagggacgttgtgcactttttcgatgtaaaaaagtaataaattagcgactatcatcgcttcgacgaaataaatatttgaagtgaaaacttcttgggggacgttgtgcactttttggatggggaaaattattaaattagcgaccgttacccgctttgacgaaataaactttttaaattgaaaatttcctttaaggacgttgtgcactttcttggaaaggggaaaaagttttaaatttcgcgacccgtcatcact

SEQ ID NO: 19651 - DNA, 839 bp, Diabrotica virgifera
  misc_feature (325)..(348): n is a, c, g, or t
  misc_feature (763)..(782): n is a, c, g, or t
atcccaacataattcttatcggctcggtttttatgtgtgtgtatttcgcgattcggtgacccatttggcataaaaaatatcaacaaactttcaataaaacaagaccgttcgttgcttgaatagtattttacagtcgaattatcccgacttggatttcttggtagagtaatagcgaaatagaggtcaaataactacaacaaagaccacgcagtgtatatctcgatctactgctatagtccggtcaacgaattttatacaattttcgttgtttttacattatattatattctgattggattttactgtaaaaaattgctccaagggnnnnnnnnnnnnnnnnnnnnnnnnaagggttgtgtacagctgctagtgctgtctccttccgtcagccaggacttccatttttcacgatcttcctagtctccgttttccaatcctttgacatggctttgtcaacttcattttttcatgatcttctcggtcgtcctctccttgttcctcttacactccattctgcaaccttgtttatcgatgtattttcttctctacatacttagccgtatcaatttaattttctttcatctatggactgcagggcatctttttcccacttttattcttctacttaatctctttttgttccactttttatactttctccttatttctttgacatttctgcccttttctggtctaggcactggaattctttctaacgctttttattttaacaaaattcaattttccgtttcaaaaaaatgcnnnnnnnnnnnnnnnnnnnnaggcaccccaaattcccggctttcatattgcacggaacactcccacacaattgggtt

SEQ ID NO: 19652 - DNA, 260 bp, Diabrotica virgifera
  misc_feature (7)..(50): n is a, c, g, or t
  misc_feature (63)..(101): n is a, c, g, or t
  misc_feature (109)..(136): n is a, c, g, or t
  misc_feature (140)..(199): n is a, c, g, or t
  misc_feature (206)..(223): n is a, c, g, or t
ccccccnnnnnnnnnnnnnnnnnnnnnnnnnnnnnnnnnnnnnnnnnnnncttagggcagagnnnnnnnnnnnnnnnnnnnnnnnnnnnnnnnnnnnnnnncaaataannnnnnnnnnnnnnnnnnnnnnnnnnnngtcnnnnnnnnnnnnnnnnnnnnnnnnnnnnnnnnnnnnnnnnnnnnnnnnnnnnnnnnnnnncaaaccnnnnnnnnnnnnnnnnnngcaaatgaaggaaacattaataattataaatttgata

SEQ ID NO: 19653 - DNA, 783 bp, Diabrotica virgifera
tgtataagttgtaaaataaaaggtgtgattttgtaaacagattcagcgtctaatccagaattctcccttcctctaaccgacggcagcagagcacatgttcgtcaagggagcccgtcagttgatcgggctgctctcccgttccccagggagtcgccctttcccagcaagaccctcgccagggcggcccttccactttcgcagacaactcgccagtttgggctccctgccgcaacttactaaggatcgatacccacacgtgaaaaggggagagtacgccaacttagaccaacagcatgtgggattcttcaaggatcttctcggcctcaatcgagtcatcacggacagtgaggaatgtgagtcctttaacgtcgattggataaaaggagtaagaggttatagtcagtgcgtcctcaaacccaaaactaccgaagaagtatcaaaaattctatcttattgtaataagcaccgaatagctgtttgtccacaaggaggtaacacagggcttgtcggtggatctgttccagtttttgatgaagtgattttgtggacagggcttatgaacgaaattgacagtttagacgaaacatcaggtgttctaacatgtcaagctggatgtatattagaaaatttggaaagctacgtatcagaacgaggtctgatgattcctcttgacctgggagcaaaaggatcctgtcatattggtggaaatgtttcgaccaacgctggtggcctgagaataatacgatatggaaatttgcatggaagtgttttatgtatacaagc

SEQ ID NO: 19654 - DNA, 165 bp, Diabrotica virgifera
gtaggactcgaactagcaaacataaatagtgttgttgataggagagacggcgaggatgtaatgctgaagttctgaggtaagaatccttatgttcgagggaggagaaggagtgggagatggagaaggtattagatgccgtactgtcgctggtgctgtagttgatga

SEQ ID NO: 19655 - DNA, 789 bp, Diabrotica virgifera
gaggtattgagttcaattcaatgtatcaacaatatgtagaattgaaaagaaataaataacaaattattcaattaatttttcgattgggggaatatcgtgaaacaggacagggcataatgttaaggatcatttattgtaccaatgtctttggtgcaaaaaattctgtggaaattaccaaacgcaaattaattgtttatgtattgcatcaatatctctaattcatcataaaaacaacgaaataaatatttcttcgtgtcttctttttatttttcattgaatggccttaagatctcgcgtttttgtaaattaaaaagtcttagaattgattatagtgttataaaaaaggacgttgaaaaataaaaagatcaagcacaagtgcacgcttcaactctttcgcatagcagcatacacaacatttcttcagttgtatatttacaaagtatatttgttattttaggaatcataatacttaagaaagcttagccgaaacaatcaaagttggactttagtcaaaaatattgaacaacctctgggaaaaatgtctcatgtccaacacttttaccatgtttagtcgagccgacattaaaccaaaaaatatttattgataggagacgaattttaagtgtcatagtatttacgtttaatttatttatatagttaattttttcttgtgaggttcatctgtgaacagtattttgttaatgcagatatgaataactggtactttcgacctttgttgtaaagacatgtgatatacagtattacttttattcacttgaggaacggagc

SEQ ID NO: 19656 - DNA, 89 bp, Diabrotica virgifera
  misc_feature (60)..(82): n is a, c, g, or t
aaaggtgggaaggctggagggaacgggccgggaatcccggggcggcctcttcgggcggtnnnnnnnnnnnnnnnnnnnnnnngagtcgc

SEQ ID NO: 19657 - DNA, 709 bp, Diabrotica virgifera
  misc_feature (2)..(19): n is a, c, g, or t
  misc_feature (175)..(192): n is a, c, g, or t
  misc_feature (345)..(366): n is a, c, g, or t
gnnnnnnnnnnnnnnnnnncctttatagtttattttctctttcatgacctgtatcatttgctctactatatttctcagaattttttaaatatcccaaagccccttatttttccttttgttggcatctactagttgccttgttaattcgtttatttcattgttgttatttatttcnnnnnnnnnnnnnnnnnncgtatctggtgtgcactgtattttttacttctggcaaatatatcttctggttcatcttcttcttccttttatcatgatctgatatattatggtcataagacccaccaatcttctgtatgtattacctttttagtctcaatttcactgacgcannnnnnnnnnnnnnnnnnnnnnacttttaaactttggattcatcatgatcggtaacgttttcttattatttaactaacgcgattatggtttttattggggaaaaataatatggtggcctccccttacattcgctttgcaaatataattttttgtgtatgccactatgctgtggtagtaagttttaatacagccttctaggaagacaccaatggatgactataacccccacatgaaattgctagttctccttttgttgctatttttaagagcacacagtggcgatcggcaggaggcaacaagcgcgggccaagattgcgaaaagtctgcgaactttcaaaagagaggctacagtgcgtcggtaact

SEQ ID NO: 19658 - DNA, 735 bp, Diabrotica virgifera
cgagaaggccatcatcgacgtcctggcccgtagaggcatcgtccaacgtctcgagatcgccgaaaccttcaagacctcctacggcaaagacctcgtctcagagttgaagagcgaattggggggtaagttcgaggatgtgatggtagccctcatgactccactgccacaattgtatgccaaagaactgcacgatgccgtagccggaatgggtaccgatgaggaagctatcatcgagatcttgtgcacattgtccaactacggaatccgtaccatcgcacaattttatgaacaaatgtacggcaaacctttagaaaaagatttgaaaggagatacttcaggacatttcaaaaggctctgtgtttctttagtgcaagctaacagagacgaaaaccaaggcgtcaatgaacaacaagccctcgccgacgccgaagctttgatcgaagccggcgaaggaaaatggggcaccgaagaatccatcttcaacaccgtcctcatcaccaggagttaccaacaattaagagccacattctctgaatacgagaggctaacgggcaaagacatcgaacaatccatcaagaaagaattcagcggagatatcgaaaagggattgttaggaatcgtcaagtgcgtgaagagcaaagttggatacttcgcggaacgtcttcactggtccatgtccgggttgggcaccaacgacaagactttaatccgtatcatcgtctcgagatctgaaat

SEQ ID NO: 19659 - DNA, 710 bp, Diabrotica virgifera
  misc_feature (634)..(634): n is a, c, g, or t
  misc_feature (640)..(640): n is a, c, g, or t
ggttgtcagcggtgccacagttttagtttacttttagtttctcgtacgtttcgttagtatctttaacgatgttagtgtactcaattcaaacttatacaattttgttttgacagtgttggatctttaatagcaacaaaattaataaccagtgcaactgtgatactagacttttaataattaaatggatccaatcagtgccagtgctcttgcattaaacatacacaaagaaaaaaagcgagatgcacaatttgaagagttaataggaagttgtaagtccctcagcaggtatgatgccaaaacctttagaacattgttaccacagattgctgctacatttatggcagtatcgttacacatattagtaggactttccatggcattttccggaattttgataccagcattagataaaactcgccaaaatggtacagattttgacggagaattgtatgccacaaaaccagaatcagcatgggtagctagtattgcggttattgctgtaccattcggttctataacttgtggaatttttgctgataggtttggaagactgtgggcgcttaaattgtccattttaccgtccattttaggttggtgtttaatagcaagtgcccaaagtatacctcagatattnagttgngagatttttaactggatttgggacaccttggtcaagtattcctgctatagtgtatatatccgaaattgct

SEQ ID NO: 19660 - DNA, 814 bp, Diabrotica virgifera
tatctttaactagcgtagaagtactcaattcaatcttatacaattttgttttgacagcgctggatctttactaccaacaaatttaataaccagcgccaatgagatacaacacttttaataattaactagaatccactcagtgccggagatcttgcattgaacctacacaaaaaactcagcaaatgaactattgaacaaatataggaagttgcaagtccctcagcagccatgatgccaatacctttagaacattgttagccacctgatagttgctacatttataggtatatacctttctactatctactaggactttccatggcattttccgaaattctcgatacctaattagataaagatctctaaaacgcttagatctttgacggacagttgtatgccatacatcctgcttcactctcgcatatctagcattgcgataatctgttgctctgttccgctctttaactagcggaatgtatgctgatagctttgaaaaactgctgccgacttacctcgtcccatttactctccattttatgtaccaatttcataacaattccctaattttacctcttttattatttcgaagatttttactgagattcctaacccctcgtgtaagcttcctagtagtagtggaattatccggaacttccccagacattctttctgcttccctaactacccaaccttccacctcttatctccaccccaattcatcttcacctattgaaacacattcttcttctttctcctctaacttctcttcgccctcgctatcttatagcattcttccagacttgttttttttctt

SEQ ID NO: 19661 - DNA, 574 bp, Diabrotica virgifera
gtgaaatggttttaatgtgttgtataatctttaggtacaaatactaatatacatgacagtatttttgtatgtgtcttggaagtggcctgtttttctgtgcctttctcgcacacttttatacacctactccggataggcttatcaaagtgaccgatcctgttcaatcaaaaagaattctcagataaacaaagagatgtaaccttatagtccaacacatgagaatatacttaaaactgttaaattatttcgaccgacatatcactccctggagattccttttactcttactactgccgagatgagatacacccccgatagtttttgtaagtatgaaggtattgttagaaagggaaaatagtataatgttgttaatagaatttaaatgttagttatatttggatttaatatagaaataattgaagatgtgttaagaaaatgggattgggaataaggtatgtcatgaattagtgaaattgtttatataatagtagtaggtaggatgtagaaatattgatgaagaagtaggatatgatatgttttttgataaaaatttgtaataatggaaataaaagaa

SEQ ID NO: 19662 - DNA, 607 bp, Diabrotica virgifera
ggtgtactgttaaaaatcactcaaatcggacagcagatttgggaaatgcgaggcatcagggatgtctcatttttgaggtggtgcgttaattttgattgaatttggtgcgaatatttaagaattgataaaaaaacatatttgcatttgcttgatttagtcacacctataattatcaaacaaaatacacagctatatgacatgccaactagcaactacacagttttagtttgaatgtacaattttaactgaacagttttatctaataaaatttcaattcatttgtcaattgaactgtacagtcttcagttttgcctacacacataagttttacccgcctagttcgattgtttagttgaaactgtgcagttcaaactaaaggtgtgtagcggcctttagcggaactgaattgaaaattatttcgcacattacaggatgtaacaaaagtgcgggtcgtggatttgatcgcatgttctgggacccaaaaaagtttgattgaacctaacttaccttatgtgtgcacataaggacaaatgtgcacataaaaaaggtttacagccctttgaaagtgcagaagaaatcgattttttcctatatatccgggactgtg

SEQ ID NO: 19663 - DNA, 60 bp, Diabrotica virgifera
gggatttaatataactcgagttttttcgggaaaagcgcgcgggaacccttttgctgatta

SEQ ID NO: 19664 - DNA, 458 bp, Diabrotica virgifera
  misc_feature (261)..(275): n is a, c, g, or t
  misc_feature (277)..(292): n is a, c, g, or t
aggtaatgaagaaggcgaatttgtggaccaaaagtttgttaaacgcctaatgaagcaccattctctgcaattgtttccagtaaccgtattttgcactccagaaaatagaaaatattacgaaaattatgttaggatatgttttgttaaatcaaaaacaactttagacgacgcaaaagagaagctgaacaaatttgaagaattggagaaaaattcttagaaccaaaactaattcgtgagacacaaaaaatgtttaattatagnnnnnnnnnnnnnnntnnnnnnnnnnnnnnnngaataaataaaatgttttatgttttaacaaaattgctaagataggtaaattgttattgtataccgggtgtaccaactaccaataaaactgtgttttttctcaaagttcgcatcgcactatggaatattctagcatttataaaatactgaaattaaaacctaactat

SEQ ID NO: 19665 - DNA, 612 bp, Diabrotica virgifera
agccttacaagtgcgaaatttgtttaaagcagtttagtcaattagttaatttgaaatgccacatgttcatcttcaataaaaggatctccaatagttttcgatatattggagggaatcgattttcattttgtagcttcggggggctgtaactttttttatgtgcacgtttgtgctaggtgtggggttggtgttcagatcgaactattttgtggtcccagaatgtgtgactgaatttgtgacctgtatttttgttacacgctgcatgtattgcaaaatttatataaattgcaaattgaacatacaccccccaagatacaacattaggaactaataagttaagctgctgcatataaaactcaattttctgagttattcattaagaaattcttctattgaataatatggtcttttagatagataggcttttgtcattttacggaacttagggaaagatgttgcagatttaagttgtaaagggagatggttgtatagtttttttgccgaatataatataaatttctttactaactcagtggacgcgatgggtaaaaaatgaatcaaaaattagatttgctgggggaaaagaaatgaagaaccccatgggggaaaaat

SEQ ID NO: 19666 - DNA, 685 bp, Diabrotica virgifera
gtgaatgataaactaatatttttaaaagtttaataaattgagtattatttatagataagtgcattatactaacataataacattcatagataagagcattataatatatgttaacttctgcgctattatagttttatgtcattttctattggaaagaaattgctcaaactcaaattccctttcagaatggaatttttaaagcaatatgctcctgatacagtgagtaaacaaaggaaaaaagtaaactttccttcagcagacagaaacaaagaacctatcctagaagtgctcaaacaatattttgataacaccattgaagggaaagttatagaaatttcatctggaactggccagcatgcagcacattttgctccacattttccaaaactaactttccaaccaacagaaaacgagccctccttattagaaagtatttcagcttatgccgcagatacacccacaaaaaatgtcaaagaaccacttctggtaaacgtggtggatgattggacgaaatggaacgtatcgaatgattttgattacgcaataaatgtaaacatgatacacgttacaccgttttcatgcacgataggccttttcaagaatatcagctcagttttaaagccaggaggattgcttgtcacttatggagcgtatgcaaataatggcgtttttgaaactgagtcta

SEQ ID NO: 19667 - DNA, 75 bp, Diabrotica virgifera
ctcttttaaaactttccaataatgagctccgctcaagagaaccataacccctgcaacacttgtttcccaaacaaa

SEQ ID NO: 19668 - DNA, 538 bp, Diabrotica virgifera
atttgatgatgatgctgagcttggtagactagaagaagacattcctgatgactccgatttaacggatgaatgcaatgataatatgatacatgaacctcttgaagcgaacgaaaagggcaaccaattcgtttaatgtcaaaagtgggaagaagctataaaatgttacactaaggctattacatgctactcatatgattctatattttatgcaaacaggggctctttgttgtttcgcactcaataagttgtaatgatagagatccaaactgcgacctctcgataaaattgatggacacttacgaagaggcgtaccaactaagggtagctgctaaaatcaaacttactagattcaaccatgttgtagcgtgatttaaagaacgtactgatataagaaccgaaaaactaggctgcaaaggctgatctatcacgagctgcctatactgatagaatgacactgcagatcgtgcataatcacgtaccttatccctagataaactgcagtagagacgcaaatcacatacctctagagtaaataccc

SEQ ID NO: 19669 - DNA, 239 bp, Diabrotica virgifera
cttctcagtgaattagagaccagcagtgttcttgcttttggtattgtagagaccactattagtggaagtaccacagttacatttagttttgctctaatgagtattatagttttgcgttatattctcttttagatcttttattaacgctaaattgtcagtgcttatgtaagtatttgtaataaaataatgtacaattttaaacatcaccaaatacatctaaatatacaatatatattatc

SEQ ID NO: 19670 - DNA, 956 bp, Diabrotica virgifera
  misc_feature (464)..(492): n is a, c, g, or t
  misc_feature (600)..(619): n is a, c, g, or t
  misc_feature (622)..(641): n is a, c, g, or t
  misc_feature (842)..(861): n is a, c, g, or t
caaatccgggtcgaaggaccatatatgtgtatgtaacttacgatccatttattgtgtaaacaatgattgtgttttgttttctagtctaccaataaaaaatacactgaatgatgcagtttattaccgattacatttttagaagtcgagagtagtattctccaattatggttttatcttctttaagatggtcaatctgcaaaattcttttcgcatcacaatacactgaagcgatgactgtttaattcaaggttcgaagtgcgaccaacaagttcctttgatatcgtaaggacattggcaagatgatttccagtgtagttgttgtctttagatatccttcgtgttgatcattttcaacagtgtcacggccacttttaaactgggtgctcgtttcttgcagaaggaaaatcatgaaaaattcatttgttttaaaaccagatttttttgggctctacgttttcttgtgnnnnnnnnnnnnnnnnnnnnnnnnnnnnntcatatattactaatatgaacatgtaaaatttgatttaaaagactgcctttttttttgaaatgtgccctatacttttacactacacattttttcgtataaattttggnnnnnnnnnnnnnnnnnnnngtnnnnnnnnnnnnnnnnnnnngagatgtattatatttggtatttgatatttagtttgttaatgattaaggatgagactgcacctatttgctcaccacccagatgactgtgttaagacataaacgagcttttattctgtaatacttttatatacaaaaatgtgttctattttttgtgtaactcgtgtccaagtaatgtattttctcaagtattttttcgttgnnnnnnnnnnnnnnnnnnnnacccttaggtaacttaatgtgtcactaagaaacaactatactgtgaacgttttgtgtttaataaactactccatggtattttttgctatcgatgt

SEQ ID NO: 19671 - DNA, 1110 bp, Diabrotica virgifera
  misc_feature (442)..(461): n is a, c, g, or t
  misc_feature (880)..(897): n is a, c, g, or t
  misc_feature (975)..(1015): n is a, c, g, or t
  misc_feature (1023)..(1062): n is a, c, g, or t
  misc_feature (1067)..(1107): n is a, c, g, or t
gagcatcccaaataagattgagcgttaccgcctcacaaattatggtaggggagcccaagcggggatttttgtagttactcgagcgcgtcagattattacatggggagaaaccttgtaccctgaaaaagtacctctaccatatattggcttttaatgcaggggagttcgttaaggggggccgaaaaaaataatctatccatagaaaaactcgaaatcgttagattaagataaggtaagttacgtacatgataaagagtgtatatttaaataatctgacgatttgagcgtaaggaaatggatgacccccaaagtttcacaggaaaaaagcgaatatttcgcgaaatgaatgacgatcgaaaaactaaaaaatacatactcgatatttttcaaaaatctatcgaatgataccaaacacgactaccctcggaaagggatggggagnnnnnnnnnnnnnnnnnnnncgaaccccgcgatatttcgcgaaatgaacatcagatcgaaaaactgaaaaatacacttattcaatatttttgaaaaatgtatcgaatggcaccaaacacgacctcccacggaggttactttaaaatcttaaatgggagccctccattacttttttttgcagatttggattccgtacgtaataataagtatcttttattcgagacattttttccgattatggatagaaaagcccactaaaatggaaaactttacttaacttattttgggttgagacggtatctttcccacccaataaggcccccaaagcgctcgagtgactgcacatttaacataatttgctcccccacattactttgattataattattattcttttttttgacccgggaagttcatcgggtcaaagaatttgttttgnnnnnnnnnnnnnnnnnnggtttggacgagcaccaaatcccaagtggatggcaaatttttgaaccgccctaagaataacccttttttttcttcccnnnnnnnnnnnnnnnnnnnnnnnnnnnnnnnnnnnnnnnnnaccacaannnnnnnnnnnnnnnnnnnnnnnnnnnnnnnnnnnnnnnnctttnnnnnnnnnnnnnnnnnnnnnnnnnnnnnnnnnnnnnnnnnttt

SEQ ID NO: 19672 - DNA, 713 bp, Diabrotica virgifera
tcaatccgccccgacaggttatcgacccgcgcagcccgctcggcgccgttatagccacctacctctatcgctccaaggctatagatatcgctataggtattggtcagcgtctctacctgaagcttcatatcgccgccacttagcagcaatgaaccttcattcgctcggatgcgatcattggtcagggtctgagcattgaccagcagggtctgtgcactggccaaggtacccaggttggtgacaccgccagcactgatgttcatcccgctgttggaagtcaaacgtccacggtttgccaactgcccgctgacggtcacgttggttgccccgccgccggccatgcttgccggctcattgagggtcagttgagatgtagtcacgtccagtgtgccgacgctactgactcgaccattgccctcgtagccgccggtcaactgcaaccccatgctgccgtcgctcgcgatcaagccatggttggtccagttatcgcctttaccttccaagcgcgtggaggccaggagctggccagtttcagtttgggtaaaagtgttgacgttgacgttcagacggcctgcctggatgacgctgctgttggtccaggtatcggcgttcaaggtcaggccgccacgggtgacgatactgcccccggcaccggtcacgttgggtagagagatatcgaagtccccctggccaatatgcaacagctgaccact

SEQ ID NO: 19673 - DNA, 549 bp, Diabrotica virgifera
  misc_feature (101)..(118): n is a, c, g, or t
ggtgtttgaacttgaactattttaatttggtattggcaaatttgcattttatattaacaaaatccttgggatttgaggggcagtttggtgatgatgaaggnnnnnnnnnnnnnnnnnnaatagctcttgagcctgtaccatgtgagaacgaaaaggtttatggaagaatttaataacacatttttgttgaggtttgtggtttccataaaaatgctgtgatgtggtttatgtgggggctggttcctggttggcgttatgttattgttcagtgggtgtacgtggccttcctttcatggaaatacatgcccccccgtttttttgcttgatatttgtatctagtggaattttttttaggtactatgagtagttccctctactctcaactttggatttaggtaagtggatggtcaaaaactggcttgaaaatagcagagaaaaagatgatgacttaatagatgagccaaatacgagttagaatccaacaaagaagaatgacaatacagtaaagaaacaaaatgcataaataatgtcaaggcaacacgatttaaa

SEQ ID NO: 19674 - DNA, 853 bp, Diabrotica virgifera
gtcaatttacgataaaatacgcccacatattccaattgtcaaagacactgagccacttctagaattagacagagacgaaagaaaatttgacatatttttaagttaccacaggtcaagtcttcttgtcagtgatctcaaaatattcttgccattcactatcaacttggatccatatttaaagaaggttatcaaagaagaaactcaaagtttagaagacgacgggctcgtcatgggttccatcaagaactccatgtcaggaaaccacagcatgagcagctggaataactcagaatgggtatctccacgaacgaatctctcgcgaagaatgagaacaacgccgaaacctcaaatgacgccaatgactcatcatggcactcctcaaacttcaatgatgggccagccgatgcaacagatgactccttctatgtccagctggtcacaaccttggaatgattctatggtttatagaccgcctatgccgttggcacctttaactgtcgctgagcccgaaattttggacataaaactttcaacgcttaacgtagatggcgttacgaagctgttatccaacatgagtgatctgaacaccagtgctgtaggagattataccaagactattaaggataacaacataaacggaagggtgctgttacattgtgatttagaggaacttaaaaagttactcaagatgaattttggcgattgggaaatgttcaaagtcatgcttgttatcttaagagaacaagaaattaccagtgtattacatcaagaggaaataaaaccatttagaataattccaaaagttgaaagaaaaaatagcaataaatctataaacacaagtgagaaagaaaag

SEQ ID NO: 19675 - DNA, 378 bp, Diabrotica virgifera
  misc_feature (6)..(146): n is a, c, g, or t
  misc_feature (155)..(268): n is a, c, g, or t
  misc_feature (323)..(356): n is a, c, g, or t
cccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttagcaaaaatatattaggttaataaaggatttcgggacattttttttcacnnnnnnnnnnnnnnnnnnnnnnnnnnnnnnnnnntaaagcctcccctgccccctga

SEQ ID NO: 19676 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19677 - DNA, 406 bp, Diabrotica virgifera
cgttattcatcatcatgtctggcttctttatttctccccacctgacgcaaccgcgtgagcaacatactagctctactataacgacacctaaagttcattctttgaacgggagttaacaacgtctggaatggagaacccctggcgatacacaacttaacctacgtgcagcacgtcccaatgtgcccaagtgcagaaatactgaagaggtccgcgccgagcacccttcccaacacttatgacacgctgaatggggcatgcggaccgggcctggaatggcgcctcaaagccccccggggtggaggcaacgaacaccgagcccgcgacacttgtctgccgaccgagctcccgctctattcgctattctttccttgacttcgcgccatgtttcttcgccccccccccggta

SEQ ID NO: 19678 - DNA, 289 bp, Diabrotica virgifera
  misc_feature (54)..(54): n is a, c, g, or t
  misc_feature (58)..(58): n is a, c, g, or t
  misc_feature (66)..(67): n is a, c, g, or t
  misc_feature (71)..(71): n is a, c, g, or t
  misc_feature (82)..(82): n is a, c, g, or t
  misc_feature (87)..(87): n is a, c, g, or t
  misc_feature (119)..(119): n is a, c, g, or t
  misc_feature (148)..(148): n is a, c, g, or t
  misc_feature (195)..(195): n is a, c, g, or t
  misc_feature (199)..(200): n is a, c, g, or t
  misc_feature (240)..(240): n is a, c, g, or t
  misc_feature (254)..(254): n is a, c, g, or t
  misc_feature (266)..(266): n is a, c, g, or t
  misc_feature (274)..(274): n is a, c, g, or t
tcttaaggggcgccaccaaagaggggcccaaaggacggaaagaagttttccaancacngaagacgnncacncgcagcaacancggancaaccaacagaccgaaaaacccagcgaacaancagcttaccagcaaaaccccacgacacgngaagccgaacaagacaggggcaaaggacaagcagacccccagcaacncggnnaccaacagagagcgggacaccaacaagcccaggaagcaancgaacgcccacacnaccaacagcccnacaggacncgccaagccgaaaac

SEQ ID NO: 19679 - DNA, 221 bp, Diabrotica virgifera
  misc_feature (25)..(25): n is a, c, g, or t
tgcagatttttttttgaagtcgagnccaaagccggacgcaggacaaagcttttttagaacgtgcaccactctctaccatcagagagtatcttgcaagaacccacgaagctcgtgggcaacgaatatattttaaggacaaacaggatgctgcaaaaagccggctgtcttgtcagtatacttcggcgcgagggcagatagagcccgctcttctatacgaatca

SEQ ID NO: 19680 - DNA, 765 bp, Diabrotica virgifera
  misc_feature (43)..(690): n is a, c, g, or t
cgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctcaacaacaaagacggtctcgaactcatcaaggttgctatcgcaaatgctggatacacaggcaagatcgaa

SEQ ID NO: 19681 - DNA, 842 bp, Diabrotica virgifera
  misc_feature (739)..(739): n is a, c, g, or t
  misc_feature (741)..(762): n is a, c, g, or t
gagttcctctaccatttgcgttaatatatctcttctctttgccattatcacaacgtcatcggcatatgctacaatttgacctcctctatttctgagtgtacctttgttcatttttctggtaatatattctattgccatgttgaatagtgttgtggataaaccatcaccctgcctcactcctttgtttgtttcaaactcttctgtttcccctatttgcgtttttacactcgctctggtatggctcatcgtcatttttataagttttcttaatttaagcggtacctgtagcatttttaatatttccaatagttggtttcgtttgatggaatcaaaagcttgtttaaaatctacgaaaagtatttctaagtttatgttagcttcgttcgccttctccattatttgttttagtatgtatatcgcatctattgtggattttcctttcctgaatccacactgatattgaccaatcttattctctgctgcttcttgtaatcttctttgtattatggttgacaataccttatatactgtactcagtaatgttattcccctgtaattttgacattcttgttggtttccctttttatgtatcgttattatttggcctgtttgccattcttttggcattttttcttctttccagatgtttactatcagtttgtgtatttccctatgcaacggtttccctcctagttttatgagttcgctgtttatgttatcttttccgggtgctcttccngnnnnnnnnnnnnnnnnnnnnnncaattacttcttcgagtgttggctccttcatttcattattttcccactcttcctccatttctgtaatctcttctgtttca

SEQ ID NO: 19682 - DNA, 851 bp, Diabrotica virgifera
  misc_feature (750)..(750): n is a, c, g, or t
gaacgcgattgtaattgtaataacacttgtttatatcgcctgctgtcagatagaagtaacggaatcattcaatcacacaatatttgcctatccagaaaacgctattaaaaaatcaacattacgaatcatcggaggagacaatgtgacaccgaactcatatccattccaagcagccctttttatatattataaatcaaaaactaacctttgtggtggaagtttaatagataaggaatggattttgacagctgctcactgtgtagataatgatcctgttaggatagttgtaaaattgggactccatgacgtatatgccactcaaggatctacagtacaaatttatgaagctaaaagttactataagcattcgaaatggaacgaaaagacactacaaaatgacatagctttaattaaattacctagaaatgcaacgttaaataactacgtcaatttgataaaaatcggggacaatattgattatgctgggcgtgttgctacagtgttgggatggggaagcacagaggatggtcaaatatctaagtatctaaagaaagtagatgtggacgttatgactaaccaagcgtgcaaagcagttcgcaaagaatttaatgagataatagtctctactcatctttgtacatccggacagggtattagaggaagttgcagcggtgattctggtggacctcttatagtagatggagttcaaataggtttagtttcatttggacccgagaattgcatgcgtgngtttccttctgtttttaccagagttccaaaattcgcctcatggataacatctacaaaacgcaatagtggaactagcctaaatgtgaatagttttggtatat

SEQ ID NO: 19683 - DNA, 53 bp, Diabrotica virgifera
ggggacgcgccccgaagcggcgcaaaaagcgcgaagcccgcggaggggacgcg

SEQ ID NO: 19684 - DNA, 1178 bp, Diabrotica virgifera
  misc_feature (456)..(478): n is a, c, g, or t
  misc_feature (717)..(717): n is a, c, g, or t
  misc_feature (834)..(834): n is a, c, g, or t
  misc_feature (850)..(850): n is a, c, g, or t
  misc_feature (852)..(873): n is a, c, g, or t
  misc_feature (971)..(992): n is a, c, g, or t
  misc_feature (1058)..(1075): n is a, c, g, or t
  misc_feature (1082)..(1112): n is a, c, g, or t
gtgaactatagaaatattgtactaaaatagcagttgcgctaatggcgtagattttgggaagggtaacccaagtagcaatttttcgacgcattggttgtcagtacaaacaaatgcactgtatacaacgttgcccaagagtattctcagttgtttcggccaacgtcccctaccccgactgacattacgatgttacaacgttaagtaatacctttagttttagttatacgggcaactaatttattaccattgtgacaactacatatcacagttcagttttttcaacaatcgcaacgacttaaaaatgttataatgctaaagtaatttacgccctggccgactctgaagttgagtagttgtctgtcacgtcacgaccctaggtgttgttctaaaggtgtgacacgtttgcggcaacttccagaggagaaaaagaatttcctttataactttatttttccnnnnnnnnnnnnnnnnnnnnnnnatggaaattttcgatttatttaacaacctgtttatttgttttcttaatagctggtttctattccattgttttatcagcagatttgagatttgataaccttttaatctttgtatcagctttggcagacagggttgccaggtcagtttttactctttcagtagttttgttttcacaaaatcaggagattctttttaggccatgtaaatatagtaatacagtgatatgcacatccgtcctanatgtctcaagaggaattccacaaaattggaaacctcattattccaaaccaccaactggtaattaccattttttagctaaaatctactaaatcaaaaactgaaatatacttaaggatntttgggatatatatgngnnnnnnnnnnnnnnnnnnnnnngctaacttaaggggataggcgcacaatgccgtcctgtaaaatgttcaatgtattttaaatggttttccttttttgcgaatccttaaaaaaactaaagnnnnnnnnnnnnnnnnnnnnnncgcaaaaagggaaagaataccgtttttttcccaaggaccgaaaagccccttaaaaaatttctatannnnnnnnnnnnnnnnnngtttccnnnnnnnnnnnnnnnnnnnnnnnnnnnnnnngggggacttttttatttccaaaaattccccgccctaaaaaaaaaactgttttggggttttttttcc

SEQ ID NO: 19685 - DNA, 687 bp, Diabrotica virgifera
  misc_feature (95)..(113): n is a, c, g, or t
acagtgttttttgaaaattgactggaattatcaaataataattctaaactattataaatgtaaatattaaaagtataatcatttattgtcagtgnnnnnnnnnnnnnnnnnnngttgatgaagaatttaagtagatagcagaaagctgtttataagaatttttcaacattacaattgtggacaaatcctcatatctggtgaacgaagtcggaacaaaagtgatgagctcaacatctaaatgtgtagatgggatcgccaatgatggactagaggaaatcttggatgaatcgatgaggttatgctgatatctaattgatggatgaacaattacacgtgcgtgcaactgagatgtgcgatatagacatgaggtactcaagagatcgaaggtggcgggaaagcaaacgatgtcctagcaaggggggtagcagtgctggaagggggacgcttggaaatggaaagaggcaaatatcaccatcaaggactgatgatgactttgatataacggggcctgtagttggaggtttggtggaagagttgtataaaggatggtcgtagcggttaacagcctggaactattcgtagaagttggaaggacgactctgagctctaagagcattagcgagtggcattaggccagatcggtagaaataggtgttagtgaaaacgtagctgttgcagatttagaac

SEQ ID NO: 19686 - DNA, 150 bp, Diabrotica virgifera
ggagatacagagaatgaagagggagagctacaaaagaagatgcatggcaatgaagatgatcttgaccgagctcaggaagatgtcaaaaagagacgtggagttgaagtgagacaaaagaagaggtcatccgaaagtcgtgtatgcgacagt

SEQ ID NO: 19687 - DNA, 300 bp, Diabrotica virgifera
  misc_feature (16)..(16): n is a, c, g, or t
  misc_feature (63)..(81): n is a, c, g, or t
  misc_feature (91)..(91): n is a, c, g, or t
  misc_feature (109)..(110): n is a, c, g, or t
  misc_feature (115)..(115): n is a, c, g, or t
  misc_feature (117)..(117): n is a, c, g, or t
  misc_feature (134)..(134): n is a, c, g, or t
ataaaaaccgcgagancaaaaggagaagagaggagaagaccccttttaaaaggaagggaaagnnnnnnnnnnnnnnnnnnnaagccaaganaagaaggaaggagaagannaagananaccccgaaaagaagaancggcgggagggaccatgaacgcggagagggaagagaaacaacaagaacccccgaacacaatttgtggcgatgggacacatgggacaaataaaaaaggactggatttgacgattttgctggagaaagacgatacaaattgttgtttttctgttgtgccccccctttt

SEQ ID NO: 19688 - DNA, 853 bp, Diabrotica virgifera
  misc_feature (5)..(24): n is a, c, g, or t
acacnnnnnnnnnnnnnnnnnnnncgccaacatgtcaatatatatttcatttctaacacataaatattacatcctgatatcagcgtataaaaattaggagctgttagctttaatgaagttgataagcccgtttgtggatccatcgtgagaagatactggtctagagtcttgcaattcgggctcgattgccttcgccaactgtttacccaattctactccccattgatcgtaggagttaatatcccagataattccttgggtgaagattttttgttcatataaagcaattaaagctccaagaataaatggagtaacctttttaacaacaatactgttagttggtctatttcccagaaaaactttgtgtggtaatattttctggagcgcttctccttgcaaaccttgcttctccaactcggctttagcaacttctggagtttttccggccattaaagcctcggtttgagccaagaaattggccaaaaggatcttgtgatgcgttccaccgctaattgggttgtgtgtggtggccggggcgataaagtccgctggaatggttttggtaccttgatggataagttgatagaaagcgtgttgtccattagtaccaggctctccccacactattggaccagtttggaagttaacctgttgaccactgcgcgttatatattttccattactttccatgtcaccttgttggaagtaggcagcaaacctatgtaggtattggtcgtagggaagaagagcatgtgtctcggatccaaagaagttaccataccaaactcccaagagagccaaaataacgggtgcgctttgctctaaaagagctgactggaaatgttgatccatg

SEQ ID NO: 19689 - DNA, 871 bp, Diabrotica virgifera
  misc_feature (18)..(41): n is a, c, g, or t
  misc_feature (54)..(71): n is a, c, g, or t
  misc_feature (105)..(127): n is a, c, g, or t
  misc_feature (353)..(373): n is a, c, g, or t
  misc_feature (452)..(471): n is a, c, g, or t
  misc_feature (542)..(584): n is a, c, g, or t
  misc_feature (707)..(707): n is a, c, g, or t
  misc_feature (711)..(712): n is a, c, g, or t
  misc_feature (714)..(714): n is a, c, g, or t
  misc_feature (730)..(730): n is a, c, g, or t
  misc_feature (736)..(736): n is a, c, g, or t
aggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtataactttannnnnnnnnnnnnnnnnnnnnnnnnnnnnnnnnnnnnnnnnnngtgtaaatttaaccttcttcccctcacattttttaggattaataggaatacctcgacgatattcagattatcctgatgtatttatattatgaaatattgtatcttctattggatcactaattncttnnantggggttatattcttnaatttnataatttgagaagcttttttctttttcacggaaaagaataaggaccctttaagaataacttcttcattggaatgactacaatttaacctccagctgaacccaaattttctgaattgccaatattttctccaattt

SEQ ID NO: 19690 - DNA, 852 bp, Diabrotica virgifera
cgatgatcaaggagtattacgggttggcagtcgtcttagatatttgtctgtttcgattgataagaaatttccttgcatcctacctcgcgaaagtcgattaacttatttgctgattgattattaccataaacgatactgtcatgctgggctgcgtacagttagttttttgcttgcccagtcattttggattttgtctcctaagcgtgctatacgctcggttttgtcaaaatgtatacagtgttggaggcccaatcctagaaattaccaacctccaatgggtaacttacccctagttagaatttcccaggttaaacccttcctgaattcaggtatggattttggtggaccgttttatgttgtgatgaatcgctatcgaggagctaaatcttgtaaggtgtatctttgcctctttgtttgcatggccaccaaagctcttcatttagagttagctagtgatttatcgagtgagacttttctctctgctttgcagcgtttcatagctcgtcgtggtagggttgataagttatattctgatcgtggcagtaattttgttggcgctgctaaataccttaacctcatgaaaaatgctgcttcaaatgaaaatatttccttccattttaatgctgcatctgctgcccactttggcggtttatgggaggcgggaataaagtcagtaaagacgcacctagctcgcgttataggcgatcagatcttgtcatatgaggaactaaacacggtcgtaattcagattgaatcgtatcttaattctaggcccttgacccctataagttctgatcctaatgatttgtcagttctaacgccgggtcattttttaaatctagaacctctttc

SEQ ID NO: 19691 - DNA, 939 bp, Diabrotica virgifera
  misc_feature (552)..(568): n is a, c, g, or t
  misc_feature (811)..(837): n is a, c, g, or t
  misc_feature (895)..(925): n is a, c, g, or t
tttcgtccggtcagcgcttccagttatggcaaaactccagcatacgcgggtaaccagactcctctgtacagagattctggcaacaaaactcccatgtgcgattctgggtctcgtacccccttgcattatggttcaatgactccgattcacgacggttctaggacaccaaatgctagttcagaatgggatcctgcggtctctggtaatacttatccatcaccaggatatactcctagtactccaggctatcaagccaatggtccatatacgcctcaaacacctggtacaatgtacgacggtagctacagtccatatcaggcgagtcctggatatcaaagcgccatttccactcccagtcctggaaccggatacggccaatctcctgcttctagtaacaatccgtacagcactcccagttctgggtatagcccgaacatgccgtacaatcctcaaactcccggtgcaggtctggatgtgctacctatgactgattggcataccgtcgatattgaggtaagaattcgcgatagtcatgacgatcctggcttagtnnnnnnnnnnnnnnnnnttagaagcatatctgcagctatgtgtacagttttccttcctgaagaagatagagttgttaacatcatatgcgatcatctagatccagtacggccacaaagaggagatcagtttaaggtaattattgtggaagaacgagagcaaactggcgaacttcttttatagatgcaaacaaagagtagtaaaattaaggcgatattactatgctgcccttaaaaatttatgcagatgagggcctcaggcnnnnnnnnnnnnnnnnnnnnnnnnnnngttaagttgaacgttgattggggaacgggaaaaataatttggatttcaattttgtggnnnnnnnnnnnnnnnnnnnnnnnnnnnnnnncgaaagggtttttt

SEQ ID NO: 19692 - DNA, 1096 bp, Diabrotica virgifera
  misc_feature (165)..(194): n is a, c, g, or t
  misc_feature (585)..(602): n is a, c, g, or t
  misc_feature (614)..(688): n is a, c, g, or t
  misc_feature (917)..(937): n is a, c, g, or t
  misc_feature (1027)..(1049): n is a, c, g, or t
ccctcaaatagatccggaaaaaatcgacgtacgccaagctgttacaacacatcggcaaaaagaagtcgaagaaatttacgatataaacacttacgatagtttcgtatccaccaacagcgattttgtggacctgagctcgttaacggaagaagaaaaagcccattnnnnnnnnnnnnnnnnnnnnnnnnnnnnnngaagtgagtttaacaaccagcatgaaaaaagaactaccgtggtactcaatcaggacaggaagagttgcagaggtcgccgaaaaattatagttcgagatcgtcccacctcacctacaataatgaagaaaagaagactggcggcgaacgctagagagagaagaagaatgaatggcttgaacgaagctttcgatagattaagagaagtcatacctagtctagatgccgagcacaaacttagcaaattcgaaacgttgcaaatggcacaaacttatatatctgctttaagagagttacttgaaagaagtaacatagatagataacagtgattttctatttatatttcagtcataatagtttatattatattatgtcatatttcacgtatgtacannnnnnnnnnnnnnnnnnagttatgagcannnnnnnnnnnnnnnnnnnnnnnnnnnnnnnnnnnnnnnnnnnnnnnnnnnnnnnnnnnnnnnnnnnnnnnnnnnaaggcgatctaaaaggaggccggtttactaatctatggatggggcgaaataactttacgggggggtcccctttaaaaaggattccggtttgcggtccttttgaggggagggattggttttttcttggggcccccaattttattccccgggcggcaatttcccaattccgggggggaaaaacccgggagaaaccaaatttaatccgcttggccaatatcccccttttccnnnnnnnnnnnnnnnnnnnnngcggcgcccaccgcgtttcctctccccaagggggggggggggcttgaagggggggaggggcgggcccccccctggccgggcccctttacnnnnnnnnnnnnnnnnnnnnnnnccccccgccttccccccccccatcttgccgggtttccccagggcccg

SEQ ID NO: 19693 - DNA, 828 bp, Diabrotica virgifera
  misc_feature (659)..(684): n is a, c, g, or t
cttcatatgtcaacacattctcaataaaaaccatttaaatgtgaaatatgttcgaagcagtttactcacagttcctctttaaaagtacatataaatgagcacactgggataagtcacaatttgaatgtaaaatatcgacgacggaaaggcagaacctcgtaactgaaaattttttataaaatgagttacttcggttttcgctttataataagtgtagcgacacctattattaaccagcggttaaagctgagaaaatttccaaaaggctttaaattacagaaaacggtactattaaacatgataagacacgccctaaatgaaaaatgattcgttttgttggtcttctgtaaaattatcaccttgccacttacgagtccctgccttttcgacgtcgatatggaaatgcacactggagaaagtcaatttgtatgtaacatattgtaatgtacagctggttccaaaaaaaactgatacgactcttagtaagatttgatcattttgagcagtgtatgcttggtctgacattatattatatttattatgacagacaaataataaaataaacaaacaaacagccatttttttgaggttgaagttatctgaccaattttaagatttgacagtgtcaggatgtaaaataataagaattttatccttcnnnnnnnnnnnnnnnnnnnnnnnnnnaactcatattcattatatcaccccttcaccaaaaagcttttttacaagaaacataatccagggatttttgatatggtttaaaaagccgaactacattaaagaaacccccaaaaaatcgggggtgggtaattccccttggccggg

SEQ ID NO: 19694 - DNA, 801 bp, Diabrotica virgifera
  misc_feature (56)..(102): n is a, c, g, or t
  misc_feature (688)..(709): n is a, c, g, or t
aaatcaaaaagagtttcttatgcaatatcaagaccccgaatagcttttgtgtcttnnnnnnnnnnnnnnnnnnnnnnnnnnnnnnnnnnnnnnnnnnnnnnntccgaatgggccagtggccaaaacttaaaccatctagcccctcttggacgacttaactgggtctagaactgagacacagccatacctcaaactgctctcagcttcagagctttgccatgattagtctgactaaagggctatcaggctgaagacattcatgttctagaagattggcaatcctctcttttgggatcacaaataatgaccggaatgattaagtaagtgcactacacctataaatacttgtcctagctgtagtaggatgtatatactacgaggattacggctcgataccgtctaactggacgagttacctaacaaatcccaggagagcatagtgtactatcggatggaatcgaatgagatatatgttctaacttacatgatgaaaatatgcaactctggtgacaatgaaggacggagtgctcactttgagctagatgagagctagtttcgcatatggaccgattgaccccacctcttcacagatgggcccgctggttaactcggtattggaatggatgcacatacgaacaagatcttgaagaatctttcccaatgttcttataaaactgggaacttatgnnnnnnnnnnnnnnnnnnnnnncgggcgttctccgcggccccaaaatacccaaaataatggcccccacccacacaaatctaacctaatgaacccccaaattaaatcccccccct

SEQ ID NO: 19695 - DNA, 965 bp, Diabrotica virgifera
  misc_feature (916)..(946): n is a, c, g, or t
  misc_feature (949)..(961): n is a, c, g, or t
tttcgtccgcccatacttactaactctaggaaaaggatgaggattgtcaacagtggtagtgaatcacacaggtcttctgatggttcagatatagcacagactcgacatggaaggaccagttaattaatgtcagattccgaaagtactcagggtgaaacagatttttctgaccaagaagacagtaaggcgcctaaaaatgatacacaggggaaaactaaactggactctgactcagagcttagcgatgggcaatctgaaaaatgtcctatctgcctggagtcgtttaaattacaggaaattggtactcctgaatcttgtgaccacacattttgtctggaatgtattcaagaatggtctaaaaatatgaatacttgtcctggtgataggcaggaatataggctgattttgggacgagaccatctaaatggcaaagttaccagacagatcccagtagagcatactgtactttcaaatggaatcgaattagtagatgatctaacttactgtgaaatatgcggttctggagataatgaagacagaatgctacctttgtgatggatgtgatcttggcttccatttgtactgtttgacacctcctctcaccgatgttcccgctggctactggtattgccatggatgcacatacgaacaacatttgttggagctttcagatgaacttatagaactggaacatctggattttttttagaagaagaccagagcttcctccgccccgagaacacctagaataatgccccaaccagacaacagaaacgatcaaccgtggagtgaaaccacccgatttcgccgtcggcacgcaacccctttaagaaaattcccccaccctaaccaataacaaccccagaaaattcccacccggcgcaacccgttaaccagaactccttcccccaaaaannnnnnnnnnnnnnnnnnnnnnnnnnnnnnntcnnnnnnnnnnnnnggaa

SEQ ID NO: 19696 - DNA, 644 bp, Diabrotica virgifera
tttaaatgttcggttacaaaccacggcgccgctaaaatcttaacaactctcaactctacacttgtaagcgacaacgcgcatatttctgtttgtcgctcgtggtttgtgttgtgtttgtgagtttgtgtttacgtttacaacagtaataaattaaaatggctgataaggtgtctaaaagtgacaaaataccgacattatacgaatattttactgatggcggaatacaatcgggtttgaatgacaaaaaacctcattttacactcaatggtaaagaaatatccatttttagtggagctctgcattattttcgcgttcctagagattattggaaagacaggttaagaaaatatcgggcagccggcttaaatactgttgaaacgtatgttccgtggaacctacatgagtatgaagatggcgtttatgatttcggtaacggtggcagtgattttcaagatttccttgatctcgatttgtttattaaattagctaaagaagaagacttgttcgtaatacttcgacctggtccgtatatttgtgccgagtgggattttggaggtttgccgtcttggttattaagatacgaggggattaagataagaaccagcgatgcaaagtatgtaaacttagtcaaaggtactttaaaa

SEQ ID NO: 19697 - DNA, 52 bp, Diabrotica virgifera
aaggaaactcgattacatatccatttctattttctttctctcctccattttg

SEQ ID NO: 19698 - DNA, 147 bp, Diabrotica virgifera
  misc_feature (2)..(19): n is a, c, g, or t
  misc_feature (24)..(68): n is a, c, g, or t
  misc_feature (70)..(131): n is a, c, g, or t
gnnnnnnnnnnnnnnnnnnggttnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnncccattttttttggat

SEQ ID NO: 19699 - DNA, 505 bp, Diabrotica virgifera
  misc_feature (390)..(409): n is a, c, g, or t
cccacgcgtccgccggaatacgattccgtcacgagaaattacaatttaatcaacaacatcatcacgagtcctgaaaacgacgatgagctcaatttaagttgtttaaaagatgaagatttggaaaataaaaagcaacgcaacttgagtaaacctttaattcgtcgcaagtcagaactgccccaagaccagtacacaatgaatgctctgtccgaccacaaaaggatggacgactatctagtaacacctccagacgtcaacaagtgctagtctcttctcctacaatacttgctgcatagatggcagtaagttttgtgccaattgaggaaaaatcaagaaacatcggtctttctaccctccatggaaattgagatcgaacgaagcatgcttttnnnnnnnnnnnnnnnnnnnnctttaggacatgttatttttttataaatgtagaggatatatgtatatagtttttttatgcgaaggcttgaaatgatagtaaatcacggaagtatat

SEQ ID NO: 19700 - DNA, 341 bp, Diabrotica virgifera
agcggatgtaccgaaaaatattcaaggtgaaccacccccttatattccatataatttaccaacaaccttctgttcctgtctcacagaatattgatgaagagacatattaaaataatgaacgcattgatgccatgcgctaagactactgtgccaaatcagtacggatacagctatctaccttccaccaacataccctccgagtgcgtaccaatttcccgatcagtgtaacggaaaagcaatcgcctaacagtaacatcaccgtactgccctaccaaggatgtcacggatactactaacagctaatagcacaatacacagctccatgactgcaacctcaccgt

SEQ ID NO: 19701 - DNA, 668 bp, Diabrotica virgifera
  misc_feature (400)..(419): n is a, c, g, or t
agaggagaagaggtgccactgcgtggggcgcgggcggcgagtctccgggggcccccccacgcccccgggatctgtcatcgtttctagccatgttattaggaaaattttgatagtgtagttttcaaaagaagtaaacttaactaaaaccagtttgtgagcgttcatattgtatagatttaccctcccaagatgagtgatgagcgtgggacaaccgctaggataatgtcggagggcaaaggaaatgtgggtcctagagaaaacgcacccataaacctcatgctaattcactgatggctgactatcttaacacatgttctctaaactatcgacaagacaaatactttaccctgtcaggatgggccctgacagcagagctaacgacctatgaggatagtatcgnnnnnnnnnnnnnnnnnnnnccggcaccaggacgaagacctgttgatcgagacctgccaggaagtcattgatggcttctgcagtgagaagtcacaacgtcaaaatcagtgccatatacacagtttcagagatgaatgaggacccgttctgagtgactccatcttccataagtgcaacatttgccccgcgtggggagactaggatatatgccgctcaaggtcgaacctcattgaactgcaacagagcccgcacgcatcaggaatgtggtg

SEQ ID NO: 19702 - DNA, 610 bp, Diabrotica virgifera
aattcgacggcccaccccacgtgtccgttatttgtagagagatgagctttatgcttatctacttcttgcatcaccgtttcatgtctctccatggcatctttaactggtttttccgacgcctctgcaaacttggaatatttggcacaacctgctttagcaattattattatcttcttataacgatccattttcagcatgtagatcagcgatctgctgatctaattctcttactctacttgtctcagcgctaccgtcaggaaccgtaaacatttcactcttaatatatctacccaacttcatcattatggactactttagttattaagatcatccctaacttccgcatacttctttgcgtaatttttccgctatctcccgttcttcttctgctctcttctcagatggatttaatttgagttgataaatgatcggtcaattgccgaaaatgatcttgttcttcttagcagtcttatgcgtagagaagctacaatctactatgtatctttcatactagatctattataccaaattataatgcaatgttatcacgcgtacagcgcgtactgagacgaagcataaatataaagctactatatcaagtctgtcatat

SEQ ID NO: 19703 - DNA, 923 bp, Diabrotica virgifera
  misc_feature (157)..(171): n is a, c, g, or t
  misc_feature (774)..(774): n is a, c, g, or t
tttatgcttatctacttcttgcatcaacgattcatttctctccatggcatctttaacttgtttttccgacgcctctgcaaccttgaaatattcatcagaagcttctttagcagtttttattttcttctttaacgattcattttcagcttgtagatcnnnnnnnnnnnnnnntaattctcttactcttcttgtctcagcgctaccgtcaggtaccataaacatttcactcttaagttttttacccaactcttcattttgggctactttagccatcagatcttccctaacttccgcaacttctttgcgcaatttttccgctatctcccgttcttcttctgctctcttctcgatggttttattttgagctgataaatgatcggacaattgtctaaaatgatcttgttcttcttgcagtcttctgcgtagagtagcacattctctatgagcttcatcaagtctattttccaatttaagtttgccttccgcgtccgcgcgttcgagagaagctttaataagctctatatttgtcttcataagattttgttgatggaagtttaccttcagcgaatctctttccttgagaagacgttgttcggcatcctttagcaaagcattttctttttgcaaattgcccagcataacttctgctcgtgaaagcttcgtttggctttgtattgtttcatttttcaaataagtagctgcttgttcatgcttaattatcgactcactataaatcttattctgcttttctaatgctgttatttgtttcttgtnaatgtcaacgttgttgttgaatactttgaacttttcttcgtcatggtccgcacgagcgctcagtttacaatttaatcttgtcagttccttaacctcaccgcgcatattgtctaattgatcaatcaaaatctttttcattggctgacttt

SEQ ID NO: 19704 - DNA, 618 bp, Diabrotica virgifera
acgcctcgcaggtaccaggcccgggaatctcccgcgcgtcgaccctcttctgtccggattcatctatgcccatttaaaaatcttttttggtatcatatttataaggtattttcattttcttcggatgtggctcttccaaagatatttcttcttgctcaatatcagattttctattaccaactacatacagtcggaaaaattaacgaattttctctttttctagtcttttagtaaagaagtctttttctataaataacaaacgtttattatagaaaaagacagcaaatactaaatacttgactgatgtgatatttcgtggatattctttcattattccgactgtatatttagttctatctatttgcgattcataatatttatctcccttaacgtctactaatccaataaccataatgtcatactttcattcgtcaatcataatctccatatcgcctatctttattctgatacctaaggccatcaatcagcaactacatacctcgttttcttatcataatacaacaataattaacaagaaaataaaactagaaaactagaaaatcaaacattagatgcctattaaccataacattcataccaccctcaatactttgtttt

SEQ ID NO: 19705 - DNA, 517 bp, Diabrotica virgifera
  misc_feature (103)..(132): n is a, c, g, or t
ggcttgcaaattgtagaagcctcggaggtgtaaccagagaaggttcccattgttttcattctggtgggatatgttatatgccattagagtgaaaacttagtcnnnnnnnnnnnnnnnnnnnnnnnnnnnnnnggtggaagccccatttttgtcaatataattttgcagtcttctgttcatagatagtaccaatcccctcatgttttagttaacaacctcttcccatgcctgctcaattgcttctcataattcaattctattccgtggtctaaggtttctttcatttagtttctttgttaactctgcccacatattttcgacggggttaaagtctgcactacggaaaggccacggaagaacattaacatcagtttcttctagccattctcgaacaattctactcgtatgcaccgggcaattgtcatgttggaagatgaagttgttgatctgacccgagcagagggacatgagtgatgtagcatatagtcattgaatccatgaacgaaaaatagacccg

SEQ ID NO: 19706 - DNA, 483 bp, Diabrotica virgifera
tctcggccgggactatctatagagatggattatactgttgtttcttttatctacatggaggctcggtctcatgaaaccctcttggtagagcaaatgtttgcagtagattatagaaacgatgttttcaccgcacctctgcatgacagcattcccgatcactaataaatgctgccgagccccttatgggcgaaattgtatttgaaagcacacaaccatgaaaactcaatactacatcacggagaaacttagaatcaagagtagagatataaggcgacccccctttgcgggtttattgcagtacaccaaatccatgggggattggatatagagttgatcttggatgcgtgagggagggttgaggataccgctatcattcagctctccgattctcaagcatcacaagattgtatgtgtgatgctgaacttagagattgattgccctacttcaaatgatagtgctgatgacaattccatggataagat

SEQ ID NO: 19707 - DNA, 577 bp, Diabrotica virgifera
aactgagagacctactcccaagaaacctcaagataatcttaaacctgaaggagattttgaaaggccaacaccgaccaaaattggacctggtgaaaggcgtactcctataaggcatgatgataatcttcgtccagagggtgactttgaaagacccgagaaagcccactggagcccaggagagagacctaccccaagaaaaccacaagataatctgaaacctgagggcgattttgatagaccaacaccttctaaagttggacctggtgaacggcgtactcctataagacatgatgataatcttcatccagaaggtgactttgaaagacctgagaaagcccactggagtccaggagagagacctagtccaagaaaaccacaagataatctgaaacccgagggcgattttgataggccaacaccctctaaaattggacctggagaaaggagaacaccgattagacatcaagataacttgcatccagaaggtgacttcgagaggccagataagcctggttgggcacctgctgaaaggtctactcctaaaaaaacagcagataatttgaaaccagaagggtca

SEQ ID NO: 19708 - DNA, 372 bp, Diabrotica virgifera
  misc_feature (2)..(206): n is a, c, g, or t
  misc_feature (208)..(281): n is a, c, g, or t
  misc_feature (297)..(362): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnngatttatttaatcgcnnnnnnnnnnnnnnnnnnnnnnnnnnnnnnnnnnnnnnnnnnnnnnnnnnnnnnnnnnnnnnnnnnatttttttga

SEQ ID NO: 19709 - DNA, 760 bp, Diabrotica virgifera
tatttagaggttaatattatacaaactttttatttaaaatgtctcttaagtatagtttaacacgactagtaaataagagattaatttctgttgccgataacttgagataccagattagactgggtagctaccaatcgtcaccatacctagaagacttgggcgaagtaaacacaaaatatgaaatatcgaaagaccccgaggaatggaagtatgtcgaacgagcgttaccaccaacaattattccggaacccatccagaaagataagtatccctcaggatggaagccacaagccgaaaacttgctacatagaccatattttatacaaagaacgaaaaaccacatgcttccagtttacctagatataacacaaaggggattaaggagacatacaattatcagaaaaatacaaggtgatatcaatttgttagagaaagagttattggaatttttgcagccacaatcatttcagcctatcaggagtcaagtacatgaattcgctgggtttattaggatgaatggtgactttgtaaatgctgtgaaatactttttagaaaaaagacagttttgaatagtttattttatagaatatcttgaaaattagagtttttattaaactatgtatctggatagtgataactagcttgctaaataagtgttaagctagaagtcattattaattatatctgtatatattatcatgtacaacatcttaagtcaaaaatgtatctctggtaccagaatatataggtattttgatgt

SEQ ID NO: 19710 - DNA, 534 bp, Diabrotica virgifera
gaaaagagtttgtgattagtataaataataaatatgggaaatgtattgccgaaatccgatttctctagtggattagtagaaaatagacgggaaaatctttggaaacataaagacgacgataaaaagaaggaagaggatagagttaggaaacacgaagaacacaagaaagacgaaagaaaggataaagcttaagaatgttccaagaaataaaatgcaagaaatgccgtaaaaccatctttagcccagatcaaatcaaaactaacctaattttaaatgctcatggtcatccaatggacaattctagagtttgtgatattgacgttgaagaaaccaatgtatttataaatgacgagcaccttcctagttggataaaagatcgaatcgaagctgaagaatggtctaaaggtagaattaattgccctaattgtgattcaagaattggtagttttgattatgtgtctggacaaaagtgtgcgtgttttactaatttgttgcctcctattcattttataaaaagtaaaaatagatttaatc

SEQ ID NO: 19711 - DNA, 808 bp, Diabrotica virgifera
  misc_feature (386)..(399): n is a, c, g, or t
  misc_feature (401)..(420): n is a, c, g, or t
  misc_feature (466)..(488): n is a, c, g, or t
  misc_feature (591)..(637): n is a, c, g, or t
  misc_feature (649)..(674): n is a, c, g, or t
  misc_feature (720)..(737): n is a, c, g, or t
atgggtgattgcgatgtttaagaaattagccatggatattcatatcctttaacatcggtgccaccccaagtaagttctgttgtatccgtagttaaaggatatgaatatccatgggtgattgcgatgtttaagaaattagcaggaaaatacgagaatgtctgtggaggaacgttggtcagccgtagagttgatgtaaccgctgagcattgtgttactgataattatggcaatgttctcggtagagaaaactttcaggttggcagctggaaaaactttactacgacttcggagaccctcgagattaacatgctcattatataaaagatatctcaggacgttgtgaatccaagatatatataggcatgcagttatatgttgatgactannnnnnnnnnnnnncnnnnnnnnnnnnnnnnnnnngaaacttttaatattctaaaatatgttattattgattttaccatannnnnnnnnnnnnnnnnnnnnnnttttttactagaatataaatttaacactatataaatttactaaatgacgataaaaatagtattaaaaaattgcatatttaagtaaaaatatatacgtttaaannnnnnnnnnnnnnnnnnnnnnnnnnnnnnnnnnnnnnnnnnnnnnngtttgtgaattnnnnnnnnnnnnnnnnnnnnnnnnnnatattatgaatgcccgcgcgattttgaccgggttaaggcagataannnnnnnnnnnnnnnnnnaaatctgaaatgcaagggtttggttgaaacaaaaacttggcttcattttaatttataaacatctttttttt

SEQ ID NO: 19712 - DNA, 1238 bp, Diabrotica virgifera
  misc_feature (280)..(336): n is a, c, g, or t
  misc_feature (518)..(543): n is a, c, g, or t
  misc_feature (1030)..(1048): n is a, c, g, or t
  misc_feature (1117)..(1158): n is a, c, g, or t
acaagtgacatggtcctggtacggcgggccggcggtgtcggggcctcgtgcctcgtgtgcctcctcctcatgacctgctcaactttactccttgtagacggagctgttatcctgccgaacacttcgggaattgatggacagctaacggcgaatcataaagttgatcacttcttttcgctttggttggtgtttagtaacgacgatgttaaaatatcagatgagccattcacaatctttgctccacaaaatgcagcaaccaagcgagcagaaaaacttcttnnnnnnnnnnnnnnnnnnnnnnnnnnnnnnnnnnnnnnnnnnnnnnnnnnnnnnnnnatcgaccttacaaacgtaacaagcaatgtttccttaaaaactctttctggtaaaatgattactgtgaagttttccaaggaacatggtctaactgctaataatgccaatgtagtggaaagaaaagtcaaggtaccaaatggtttattagtcgtcttagacggttacttgttctcgtttacggnnnnnnnnnnnnnnnnnnnnnnnnnnacttcctcaacgacgtccacgtcccaagaaaagctgatggacgtatcggccacgtttccctcagcgtccaacgaaagcaataaaaatcaatcgaacactacgttcgtggaaaacattatggaaagtactttcgttcctcaagagcggcgttagagtatttcaacacttcttatcaagatccaacgtttccaagttgctacaccgagatgaagaatataccgttttcgtaccgacctgaccacgctttccaaaggtggcaccccatttgattgggggtttatccatttaatgtccccgaatttacagagagggtaattggttaaccctttttgttaaagggaagataaaaacaaaaacttattaagggacggagaagttatctaaaacaatccggaggaaagggaatttgggtttaaggaaaaacacccaatcttacccgccatgggaagccttggttagaaaagggaaaaaaccccccatccccccnnnnnnnnnnnnnnnnnnncctaagggaaaaagaaaaatttcggtacgggaaattctttataggggctaaaaacctcccttccaaacnnnnnnnnnnnnnnnnnnnnnnnnnnnnnnnnnnnnnnnnnncttttttcttttggggtccggggaccccaatatttttcttttttcccccttcccccccttctcccacatcactctttggg

SEQ ID NO: 19713 - DNA, 333 bp, Diabrotica virgifera
  misc_feature (281)..(309): n is a, c, g, or t
tttcgtccggtttgcttgtgctcttctcgtacgtctgttattttaggcgaatcctaaggaggttagctactatgacgaaaagggcatctcccggccacggtacaaggcaatgtcaaagttgtctatttgacaccagtgatcacaagtgctgcacacactgaatatcatagggttgactagtattgaccaaaattctgagtaaatgatgcgagtgtatttagcaaattatgaaaacaaagacgaataccgacaaccgactgacctttagaggagttacatannnnnnnnnnnnnnnnnnnnnnnnnnnnnaaaaagtgatgatgatgtttatga

SEQ ID NO: 19714 - DNA, 752 bp, Diabrotica virgifera
  misc_feature (11)..(25): n is a, c, g, or t
  misc_feature (68)..(86): n is a, c, g, or t
gatcaaacaannnnnnnnnnnnnnncctgttttctcattctacttgaacagagatcctagcggcaaannnnnnnnnnnnnnnnnnntaggaggatccgatccagagcattacaaaggagaatttacatatatacctgtcacccgtcaagcttattggcaatttaaaatggatcaagtaactgtgggttccaaaactttctgtagtgcaggctgccaggctatcgccgatactggtaccagcttgattgctggacctgtagaagagatgacagccatcaaccaggctatcggaggtacaccaattccaggaggagaatacatcgttgattgtcagctgatcccgaaactcccagttatgaacttcgttttggctggtaaaagttttcctttggaaggaaaagattacatattgagggtatctcagatgggcaaaacaatctgcttgtctggattcatgggaatcgatattcccccaccaaacggtccactatggattttgggagacgtctttattggtaaatactacactgagtttgatatgggcaacaaccgagttggatttgctgagacggtttaaaatttattcataaatcaatatttatatactattacataaacaaacattgtgcatacttgttcatatgtataaaataagactttttttagtgcactttagaattattagttgctctcttagttgttttcgaataaaatagttaataattgttactgaattagattaatgattgaat

SEQ ID NO: 19715 - DNA, 992 bp, Diabrotica virgifera
  misc_feature (843)..(843): n is a, c, g, or t
tacagcgcggacctagaaaagttcatctgaaagatgaagttagtgttagggacacttttgtatattttgtgccttatcagtgacggacttgctcttcctgaagggctgttatatttatataatgtgccagaagcgatacctttaccaaaaggggatgatatttccagtagtgaaattaggttaagggagcctattgtattttttggcgtaacctatgagtctatttttgtaaattcaaatggactcttatcgttccaaacggagatcccaagatttataaacatagaatttccactagattatccgatcattgcacctttctattctaacgtggatactacatcggtgggaactgtatcctactacgaaacagaaaacccaggattaatacagagggccacggaaaatgtccatgattcattcctgaactttgctgactaccaagctactagtttactcatagttacatggcaaggtgttggttacttcaacaatggatccgataaggtaaatacgtaccaagttgtcatttccacagatggtgagcagtcgtacgtcgaattcttataccctgaaaatgggattcaatggattcagggcacaggggatgaatcaggtttaccagatgcccgagctcaagcggggatcatttctcccgaaggaaaagtgttttcactacctggatccggaaccgaacaagtgaaaaatttaaaagaatggacaaatatgggattggaaggtcagtttatctataggatcgatcaattggaaattgttgaacctgatgtcgatttcggtggtaaatctgatgaagacgacaacacttgtaccagcgctaaaacntttgtgcatatccaagcaaggtgtatagactacgacgaaggattttgtttgtgaatgtaatccaaagtactatggaaacggaagacattgtattaaaaaagatgtacctttacgagttaatggaaaaatctacggcaaaatcaatggcg

SEQ ID NO: 19716 - DNA, 825 bp, Diabrotica virgifera
aaaaaattattattcgaatgtaggatacaggccgatccccgtccaaccgtcagttggtcccacaatggcaacgctgttagcgaaggtccacgtcacaagttgaggatagataaagatggccattcatattttgcgacccttgaaataatcgatgtcacggtagaggatgctggcaaatacaaggtgaccgcaaaaaatgacttgggagaaagtaacgccacaatcagccttaactttgacagcgatgaggcacctgtgccggaaaaggagggcatcaggccgaccttcacggagagaccactcatcagacagacggaagacgggtccaccatcaccttcctgtgccgctgcgtcggtgaacctaaaccagaaatacaatggttccacggaaaggaagagatcaaacagaatagtcggtattcgatgtctatggaggtggatgagaagatctactacatggcacaactgcaaattgccaacgtcaaaaggaatgatcgtggagagtaccgcgccgttgcgaaaaatcgatttggtcaaggcgtcgctaccatcaacttgaatttcgagggtatagaaaaacccaaaatacccgacggaaaggctccgaggtttcccaaaaagccaaccatcagacaagaaggcgatgtcctcatcatggagtgtcttcttgaggcacaccccgaccctgacataacgtggtttcagagcgagaaaagcatcgccgacagcacgcgagtacgcatgctccgaaagaccacgtgtaaagacacgtatcttctcactttagaaatcgcaaatcccactcgcgaagatggcggacattat

SEQ ID NO: 19717 - DNA, 276 bp, Diabrotica virgifera
gagttaagagaggcaagaggtgaggggactcgcttttaacgagaggttttaaattggaagatatgttctgtttttcatagtgagaatggccttgactcattgttgctttctcgcaagtgacatatatgttttttgcgtcgccatccggaattaggacgtccccaccaattctcccaaagcacttggtccacagatcccagacgatacgcgcactggagattgagagtgcttttggatagatgaacgacgtggagacacgcccgatgcctgcccgct

SEQ ID NO: 19718 - DNA, 1057 bp, Diabrotica virgifera
  misc_feature (933)..(954): n is a, c, g, or t
gatagcaacttcgaaagcctagaatatccgctgtccgaatccagcgaactggccagcagcttgcccagttgcacctccatggagaagaaaccagagcccgtgctgagttcggccagcgtgttatccactcactattcgcttacatcgaggccggtttttcacaagcataaccctctgtcgcacatgtcgagcttcaagacaaccaggggaatcaccagatcgccggtggattttcgagagggtagacgagctagtgatggactcgtcgctcaacaagtagcagatactagtagagtggtggcttttaattcacaaaagtttactgaaaaacgtaaggccaaaggtgtgttggacatgcacctagttcaacgcgagaatcaaagactgcaaccccagtatccagtaccagtaagagagacccccgaagacgtgtcgcctagacagaatcaatatttgcaacccagacccaacaaaaggatcagtttgccagacaattttaactacaccaaccccggtgttgagtcagtgcaacttcaaacagctatgcaacacaggttgctccaacaaaaacgtcaaattctccaaaaacaatgcgctctatcccaccaatcaacaccagtgacgtccctagaaaccacccactcgctgtctagacggcaaatgctgcgcccaagctagttacaagataactcagcaacaaccagtcttgcctcctctccccttgtcagaaatcgaaagcaaagatttattggcttttccaggaattgttgaaggggctggagagtctttggaaacgtcctaataactggtcaactgtccgaaaccgtttcactgcccaacgccgccttgggaagctccaatgggctacttggaatcaggaatctccaccgtttggtatgagcccggttttggttactgtttggcttaaatggnnnnnnnnnnnnnnnnnnnnnnccttctggagttaatcaagaaataaaattccaaaataatgggtggtccgaaaacaattatcccctgtggggaattttttataaattggagattttttctcggg

SEQ ID NO: 19719 - DNA, 132 bp, Diabrotica virgifera; identical to SEQ ID NO: 17265
  misc_feature (13)..(35): n is a, c, g, or t
  misc_feature (43)..(65): n is a, c, g, or t
  misc_feature (95)..(126): n is a, c, g, or t

SEQ ID NO: 19720 - DNA, 694 bp, Diabrotica virgifera
ctgctgctaatttaaacaagacctactcttggcaaaagtctctcatggatcagacttacgccatcgaatacataaaacactataaagatgaactaattaagcagtatagtaagaatatgagtattcctcagctggcacagttaagtcaaatactgactcaagatcagttaaagttgctgacaactttaattcccaaacagtcaacttccagtgccccgagtacgtcatcgagtttgcataccatgacatcagcatcaggtatcgtgagtactggcaagcaaagtaagcaacattcttctagttcttcaagacaacacatgccgagtacatcaatgccgagtacatcaatggccggtacatcgaagtcgagtgttggcgaatcctccaaacataaacaaagtactagtaccacatcgtctaaaaatataaccgcgagccacactgtcacacaggtgtttaaggaaccgtcactgaataaatctcagtctctggaggaaaaagcagctaaggacttaatgaaagaccgaccgaatatatccatcactcctgtagcagtctcggcgctgcctccacctccaagtatatcaccaagctttataagaccaacttcaacaagcccttcaagtggtaaaactcttcaagagaaacttgcagaaaagaaaaaaagcaacagaagaaacaaatgaaatcgagc

SEQ ID NO: 19721 - DNA, 565 bp, Diabrotica virgifera
ccgggaggaaccgcgggcccccccccccggccgggaacatgaacttggaggagatttatttctattttttggtagtgtttttaattactgaaccgccaatggctatcggcgaagagatatgtatactggtattaatgcaaacctctatacctgtaccaagtggatgcggcagtgccaatttgggaatatgcaattattactatcgccgatagaacagatagaagattggcgccttctctgaaaaataaagaaggagaagaatggtttgcgtaaccccatcgataatcgactgtcgacgatattgatgtctcattcacaggtaactgaatgcaagcagaatctggtggcgagaggattagttatttatggtacaccactatacaaaaggtcgccgtcactgacggaagcggctgaatgcatcagatcgtaggaaagttttaggtttattgataaattactctgacaaagattctgattacaataaccggtagtatatgatcagttgtagatcaattatattaatgctcgatgagcatcatgatgaccagaaagatcgcaacaacta

SEQ ID NO: 19722 - DNA, 485 bp, Diabrotica virgifera
  misc_feature (7)..(34): n is a, c, g, or t
  misc_feature (141)..(163): n is a, c, g, or t
  misc_feature (196)..(228): n is a, c, g, or t
  misc_feature (251)..(314): n is a, c, g, or t
  misc_feature (333)..(362): n is a, c, g, or t
  misc_feature (364)..(401): n is a, c, g, or t
  misc_feature (433)..(471): n is a, c, g, or t
ggaatgnnnnnnnnnnnnnnnnnnnnnnnnnnnngatatttaggaaaaatatataaggttaataaaggaaattcgcaacatttttttccccctgttaattaaaacatggtctttttgattaaatattaagtctcgcctggnnnnnnnnnnnnnnnnnnnnnnngggattttggaccgggctagggagcataatccnnnnnnnnnnnnnnnnnnnnnnnnnnnnnnnnngtgggatgaaaaaaaaaccggcnnnnnnnnnnnnnnnnnnnnnnnnnnnnnnnnnnnnnnnnnnnnnnnnnnnnnnnnnnnnnnnncgagaaaaccctattgaannnnnnnnnnnnnnnnnnnnnnnnnnnnnncnnnnnnnnnnnnnnnnnnnnnnnnnnnnnnnnnnnnnnctgggggggattaaaaaacaaaattcacctcnnnnnnnnnnnnnnnnnnnnnnnnnnnnnnnnnnnnnnngacaccaaattttt

SEQ ID NO: 19723 - DNA, 818 bp, Diabrotica virgifera
atcaaagctatcgtttatttacttaaaaatacaaaaaatcacaataactatttactaatatttataacaaaggtacgaatctgcataggtttcaataatatttgcaggtcttccacattatccttctcatcagtttcgtcaactactctcttcttaatgtattctctccatttgtattgtgcccaattttggtaatctgagactttatgtgcaagccataagtcttctatcggtaaaccagagtcgaagttcagacgatggttctcggataaccattggttggctcccagtgttgtttctcttatattcgatatctcaaatggagcgaaaagaccttttaaatcgatcctcaatggtttggataatactggatcttcatcaatctcaaacacatgctccaacctcaataaaaatgtatcagctttccaaggctctaatgtcaaaatttgaatatttttgtccaaattacgttttaatccagcatactgcataacatattttgatttatattgatcaaaagataagttttcagtaccagaaacaaaagtccatgctgacaataatttttgttgaatttgatcgtgtacctggctcgctgttgtataaccatttggattagagtctttggaacttcccagaataacgtaatgcgatcctctagctaccaatcccttaccgaaagctgtttcatttaaagcttcacccacaccaaaggcgtcatcatgtaaacaatttctgtgtatcataagttcaatttctccatcctttaaactagatcctccttgcgctctgtcggtcagcacagctaattctaaatc

SEQ ID NO: 19724 - DNA, 977 bp, Diabrotica virgifera
  misc_feature (838)..(838): n is a, c, g, or t
  misc_feature (862)..(862): n is a, c, g, or t
  misc_feature (917)..(917): n is a, c, g, or t
gtgagattgatataatattgatacaaggatgcatttaggtttagcagtgaataaaattaagatagctatgatggtaaccaacgttctgaaaggacgtgctacgaagaagagaaaatagggcaacgttaagagctgtcttgcaccaacttaagcttcgctagctcctcagtaagcaaaagcaagctaaaaccgttgtagaaggtttggtaaccactgctgcattcctagctagaaacttcaggcagaaataattccatatcatgatcgaaaaacaatatatcgttacaaaaacactggccgtaaaagcctctacaataaaaatcaatttaatttgtcttccggcaactagtggtcaacacaataattccatttactaatatatctgtaatactgttgtgcattatttcactgatcaggtccagtacacggttgggacaactctcaacactctgacatctctatgcctatgccctttgtgacctacaccattaaaggagtttgaagaaattgtttagctggctatttgttcttcaacttcatttacagctttctttacatatattcacatcgtacatgcttctcctccaaatattttaatgagtataccaagattcgcacaccgttgcgtcttaatttccacaaataaatcgtttttatttgccattataccattactagtttaaggacccttttacagtccacttcttgtagatttgatcggttacaataccccaccactccgctctgacgtcataagccacgcccacaaagatggtggcgacatctgtcaattgctctttcaactgttttatgtctaattttgtttcatggcctttanataatctcttttaacgtttctgancaaatacttgtacaaatacatatttaaagccatacgtttatttagaaattatgtntgtctctttctattttttcactatagtcttttttctgactctatggctcgtatgacatat

SEQ ID NO: 19725 - DNA, 93 bp, Diabrotica virgifera
atctcgcattctcgccaaacctgatcctatgctcatataaattataaacatgcaaattttaggcgctattcaaccttacgtgtaacaatctat

SEQ ID NO: 19726 - DNA, 97 bp, Diabrotica virgifera
  misc_feature (26)..(47): n is a, c, g, or t
ttggggaaattttggcctttcctggnnnnnnnnnnnnnnnnnnnnnngaatgttataaaagcaaaaaaaatggtgaaaaacaaaatttgtgggggga

SEQ ID NO: 19727 - DNA, 902 bp, Diabrotica virgifera
  misc_feature (725)..(744): n is a, c, g, or t
gccggaaaagaactgaatgccgatcaaaagactgctgtggctaaattcaatgaagtgacgaatacattagactttgctagagatttatgtaaacagttcctagggattgcagtagcgtccgagaaggaagcgaaaaagattgcgaaaaaagaagctgctgcgaaatatcaggcggaattggcgaggttaagggaaattttattggtccaagatgcgcttaaccagatgggtaacgagactgttcgagaggactttttgcaagggagaaatggagctgctcaattaactgaatcagatctcaaactactagacgacctataccctgaagtgacaccaaaacatgaagctggtaatgctaccgccttcatgaatgaagtacaagcggctgctgagcatctgttagcagcagttgatggcaaacctaaagaagtatttggaggctcctatagccagattaaggaaatattaggaaagattcatgaaagtggatattttgatcaggcgcaggtatatgaggagttcgcagttgtcgaacccgaattagtggaagaacccgaggttctcccatctgagccattaaacaaccatgagactggagctgtgatggtgcctccgcctccacaacccctaccagaacccacacagccgacgacaacagcgccaccacctgacatgccgttgattgaaagtttgacaatagaaaatcgtgctaccttacatcaagnnnnnnnnnnnnnnnnnnnncaacctccgttggagccgcccaccttgacgaatgaaccgcctatgttttatcaacaactacctcaacaaccgcctccgccacaaccgcaaccgcctagaccaataaccgaaatgcttggaactggaagcttcttttcctacaggactctgaaattgat

SEQ ID NO: 19728 - DNA, 767 bp, Diabrotica virgifera
gtagcagctgtagctttcctagcaaccgtgaccatgtgggagatgggttataaagaaatcagttggaaagagtttgtacatagctatttgcaacgaggagtagtcgagagactggaagtagtgaataaaaaatgggtacgagttaaacttttacctggaaatactgttgagggagcgaatataatatggtttaacataggcagtgtagattcattcgaaagaaatctagaaaatgcacaagtagatttgaacatggaacctgcaaacttcataccagttatatataaaacagaaatagaagcagcaagcctttctggtatgcttcctactatacttgtaattgctttcctaatttacatgatgcgaagatccgctgaaatgatgggcggcaaacgaggcaagagaggaggaggcttgtttgggggtgtgatggaaagcactgccaagttgattaattccagtgatattggtgttaaatttaaggatgtagcaggatgtgaagaagcaaaaatagaaattatggaatttgttaatttcttaaaaaatccacaacaatatattgatcttggtgctaaaattccaaaaggggcaatgttaacaggtcctcctggaactggtaaaacacttctggcaaaagcaacagctggtgaaggcaatgtgccggttatcactgtctccggattctgatttttagaaatgtttgtcggtggtggtccctttacagtaagagatctctttctcagtggccagaaaacatggccccttgg

SEQ ID NO: 19729 - DNA, 751 bp, Diabrotica virgifera
agaacacattgctccgagcggtaacagcaatattttaaataagctcgaagattagattaaaattaacatattgtggaaaaagtgatggtcagtgatgataaaagtatgtagtgagtagttaaaaaaacagtggccactatattgacctgtggtattgattatttaggttatttaagtgataaatttagggaaatagagaattgttagtagctgataagcatggatcatacacctattcaacagttttatagggatgccaacgtatttatcactggagggacgggatttatgggaaaaattctcgtggaaaagctgctgaggtcaacggaggtgggaactttgtatttgcttgtacgagaaaagaaagggaagcacaaggatgacagaatcacagaaatattcgacgatgtggtttttaaaagacttaaatcagaaaaatccaaattcagacatcgagtacaagctatatccggagacttaatgctaccgcatttgggattatcagagtcagatagacagcttttaatttcaaaagttaacgtaattatccacatgggagcaacaatcaaattcaatgaaagcatcatcagtgcattacatgccaatgtatatagtaccaaattagttatagacttagccaaagaaatgaaacatataaaatcgattgtttatgtatccactgcctattcaaattgcacacgaagcgaagtagaggaaaggctgtatgatccaccgatatcctatgagaaat

SEQ ID NO: 19730 - DNA, 1239 bp, Diabrotica virgifera
  misc_feature (976)..(990): n is a, c, g, or t
  misc_feature (993)..(1006): n is a, c, g, or t
  misc_feature (1099)..(1120): n is a, c, g, or t
  misc_feature (1168)..(1237): n is a, c, g, or t
aaacaggtagatcttttaaaaaaggtcccaagtcggcgcaaagattaaaactgcacgatataaaatataccagctcggctcatgggatattaattgttactatcaaataattttacatctcaatggaaaaaaatacattattatagaataactttattaaatagatatataagtatacatagcctaatatcaaataattttacatctcaacgaaaaaaatacatttatagaataacttctacaatcggcaatctatttgtttttaaatggataaagagctgaacctttaccataatacatagaagctaaattagggataattttaagataaaaacgtaattgcttttgattacatgagcagtggcgtactagatacccaaacagtcaatatgtctccaatatctaaccaagctttatcatatgtatcagtagcaaaatagattccacggccaacatttccaaccaagagaaactgtttctaaattcgcaaataaccaaaaatttctgtataatattgaaggaaggggtattgagggtaggatgtatttctatgttaataagaaattttccctaatctataattccaagataaaattacgattatacctactaatggggtactaatacctacctgttaatcttcgagccgacctgggggtttttaaaatgtacctggggtatcataaaggactaaaggattatagtgagccgagatgggaataccccgtagcgtggtttcctcaactttgtagttgtttgtttaatgttttcttagaattatgttaaatcagttgtatctgattatgcaattatgtgtaatagctggtagctggctattcttaaggtacaaacagaacaagtggggttggcgtgaatggcactagtttaagtcgcggtcgataatcgacagcactaaacaaaggaggttacctgcaactgctcgggccaaaaagtagtttgccaaacatttgaatgnnnnnnnnnnnnnnncgnnnnnnnnnnnnnnggtttctctttttttttagtttcacaagctggttgggccaaaaaaagttttttagggtggagggtttcccagcttttgggggggggactgggnnnnnnnnnnnnnnnnnnnnnntgtggggttaacttttttttgtagtgtttcccgggaggcccccccatnnnnnnnnnnnnnnnnnnnnnnnnnnnnnnnnnnnnnnnnnnnnnnnnnnnnnnnnnnnnnnnnnnnnnnta

SEQ ID NO: 19731 - DNA, 189 bp, Diabrotica virgifera
atcagcatatttcggcgacaagctgataaatcagttgatggatttaggatataaatttagagctataaactagtcaccacgcaaagatctggatagaggaagtagtggagctcactgcgcactttggcggagtcctacgacttcgccttgcgaggttacaagctccggaagatatgaacaacttggttt

SEQ ID NO: 19732 - DNA, 99 bp, Diabrotica virgifera
caacgatgtatttttatacgacatgcctccatcgagatgttctccgatttcagtttcttcaggagttagcccgggtacgataaactcgggaccagaacg

SEQ ID NO: 19733 - DNA, 566 bp, Diabrotica virgifera
ccagaagctgttgtttcgggagaaaagcagaaaggatttaattcatttttgcgcaagcttcccccaattgctttcgcttgcattgatgaagctcattgcgtgtcacaatggtctcataatttccgtccaagttacctaatgatttgtagggtattgagagaaagtctcggagtcaaaacgatcctgggtctaacggcaactgctacgaaagctacacagtccagtatcatacaacatctgcaaattccagatggtgaagatggagttataagcgacattcctctgccggataatttacatctttcggtttcgaaggatgttaacagagataatgccttgatggagttgttgttgtctgatagattcaaagactgtaaaagtattattgtgtactgtacgagaacggcaggaagagtgagaggattgccggatttttaaaaacgtggcttagaggggaaaaaaaccagaaaaaaaaaggaataccaaggaaacccgaagcgagatgaaccctccacgactgaaaccgtaatccacccagggtttgccggggtcccccaaacaaagaa

SEQ ID NO: 19734 - DNA, 598 bp, Diabrotica virgifera
  misc_feature (284)..(308): n is a, c, g, or t
ctgcatttatgtattattataaattaatcatacatgtgaaatatattggagtgtattaaagttaagtagtagaatgattatgcatggtaaagatataaagaacactacatagccttgggttgttgaaaatctaagaagtaataagtgaattatctattaaaagcaataaacaaacaattatgaaggtactgtgaaatacaacctactcttaattctatttctatagagaaacgtcatatatactgtggaaaaattggaaattgtcttcaatactgcctccgtgnnnnnnnnnnnnnnnnnnnnnnnnngattcattcgagtccgatcgaacacatcaacgtactaatacacttgtaaagatcattacccatttactataaaaagtcttaggattacatgttattattgattatcataatttctgctttcaaaactcaccctatcgaactgcattctacttcggtatgaaaaataactgattagaaatttaatacttcttttaccattatcccatattccatgaatgtcctttagcggcttcacaattgcctgctagatcaactttccgcgaaaatctactatttgctttatagctgtc

SEQ ID NO: 19735 - DNA, 575 bp, Diabrotica virgifera
  misc_feature (185)..(204): n is a, c, g, or t
ctcagttaacatattcgtttattggactaaagaagtacagtgctaagaggaatgttgtcaagctctttgacagaccaaaagagctggtcatcatgcccaaaggagatgacaaaactgtatttgacgttcctaaagaatatatcacagatcaatacaaaaatgttggaaatcagattgtgtctcgnnnnnnnnnnnnnnnnnnnngaggtaagattcctgtgaacactatttccattcctccattgggtgagattttggagttaagaagagacgagaatttctctcttttcttgccgaaacacagaaaaattgctggacaacttattaacatttacataggcatgcgcaacgttgatgatcttctctcggttgctgtatataccagagaccgtgttaatccttacttgttcaactatgctctttcggttgcattgttgcatagaactgatacccaggacgtcgacttgccatccttcattaggtcgttccccgacaaatatgtcgacagtaaagtattcgccaaggctaggggagaagcccacattgtgcctaccatttcaagacacaattgaaat

SEQ ID NO: 19736 - DNA, 432 bp, Diabrotica virgifera
  misc_feature (156)..(175): n is a, c, g, or t
ccgcgaccccccccccctccgctcattaattatatacctatatattgatcattttaaaatctatgctagctagaatgttgccatttctcttgcacagaccaaattagcagtactttttgtgcaaagaagtaggtcttcactgtctaagatatctannnnnnnnnnnnnnnnnnnnaagttatctatgaccgaaaacttatagtgacacatttttgtataattactattaagaatcttcatgcctgtgaaccctatttccatttcagccattgtgagagattctgtagacaatgaagatacgaaaatttctctcttatcttgctgaaactcacaaaaattgctggacaacttattaacatttacatagggatgcgctaggtcatatgatcctcacacggatgccgtatatactgcagcaccgagttactacct

SEQ ID NO: 19737 - DNA, 93 bp, Diabrotica virgifera
  misc_feature (3)..(31): n is a, c, g, or t
  misc_feature (34)..(34): n is a, c, g, or t
  misc_feature (45)..(45): n is a, c, g, or t
  misc_feature (69)..(69): n is a, c, g, or t
ttnnnnnnnnnnnnnnnnnnnnnnnnnnnnntanattaccttagngataacagcgtaatttttattggnagaagttcaatcgataataaagat

SEQ ID NO: 19738 - DNA, 1075 bp, Diabrotica virgifera
  misc_feature (15)..(47): n is a, c, g, or t
  misc_feature (408)..(424): n is a, c, g, or t
  misc_feature (439)..(456): n is a, c, g, or t
  misc_feature (554)..(574): n is a, c, g, or t
  misc_feature (615)..(632): n is a, c, g, or t
  misc_feature (1004)..(1046): n is a, c, g, or t
  misc_feature (1048)..(1061): n is a, c, g, or t
ggggggtaactacannnnnnnnnnnnnnnnnnnnnnnnnnnnnnnnncattgccttgggataaaacatcgttaagtaccgtttctctaaattacccagaactcccagaactcttcacagcgaacgcgcaaaaatggggggatatacctttataaggtggaaatctaatagctaaaatcccctattacatcctactaattgcaaaaactataccgcattcaataaaaacaagatggaaaaggcgaacattggacataaaagcttaaagacaggaaaaaacgtataaaaaacttttttctagggtatgttagggtaaaaaacatgaattatcttttaaggctttaaaatactgatttttttggacaaatgggtaaatgaatcaatatttgggaaaggattgggacaatannnnnnnnnnnnnnnnncaatggggggtttcnnnnnnnnnnnnnnnnnngcggaggggctagttatatttccagttcgataatcatttttgaattggggtccgcttaactaatggaaatttattggcacattaactgacaaatcccnnnnnnnnnnnnnnnnnnnnncattatagcaatggagggatttctagatcgtccaaaacatnnnnnnnnnnnnnnnnnnctggtaatacactgacgtgggaatcattaaaaattttaaaactctattttttccttaaactaaccttaacaccaaaaatgtttatccaaaagaaattggagatcctaaaccgaaatcccctacctatcagccccctaaattggaatgatttgcccaatccaaaagtaaaaattacaattattcccaaaaacggccttcccaatttacgttggaccacaaaccattttcctaaccctgaccgcctttttagagacaaaatgggatttttttttggttttaatcgcaacccacaacctcctcggcaggcgattggggggattctttctcccaaaagggggggcggaaaaccccctttaatgcgccacaaacccnnnnnnnnnnnnnnnnnnnnnnnnnnnnnnnnnnnnnnnnnnntnnnnnnnnnnnnnntcatccccccccat

SEQ ID NO: 19739 - DNA, 746 bp, Diabrotica virgifera
attttagattgatgcatagtgcatatgcaattgatgagcatgacatttgaactgtgtacattaacatgagatttacataaatactatatctcttatacaccttttatatttacattttgatcagtccaactgtagaacttttgttaacagtaaaaaatgttcactaatatcgacgagagaatctttagacaatcaaaactagctgttgctagaaatctttttgatgtagaagtgcctcatagactaggaagttatgataggtttattccttatagagccaataataattgggagacttcctttgccactatacctgatcccaataagaacactcaaactggtaaaaagacaagagaaacaggtgaaaatgcgagagacagttcagtgtataacattctgttgaggaatgaattattaggtgaaaatatagaagatgttaagtcacagtgtgatgagaggcaagccctgacaccagtgaagagtaggaatctttttaaatatggtactccaaataagaatgaaaagacgccgattaaggcccaatctagtccgtattccctttcacccctcagtacaagtagccaaagacttcttcgatctccacacaaagcgacaagaaagatatctaggattcctttcaaggtgctggatgcacccgaactacaagatgacttttatctcaatctaatcgactggaccgtacaaaaacgatctcagcgatggcttaagcagttgtgtctaattta

SEQ ID NO: 19740 - DNA, 481 bp, Diabrotica virgifera
ccttcctccgagaaaaacgtttgttacagtataaaataaaaaacctttaagagcaaagatagtatggaaaatcattatagttaggacgatgatgggcttagcaatgaaatcaccctcatatacacgagcgttactcataaacgacgaaaggaatcacctatccaacgaatataagaacgcagacggagatacacgaacataatggacagtatattcttaaaatgaacaaatgactgagagcatcacagaggaaacatcagatgcctcgagaatatatagactaagctgaaaaagaggtacaagaaatctgtaatgacatcttaagaccttcttgacataataccatatccctaaaaaaagaaatgaatagttgtaagtattcaacatcaagatgaatggatattactattaggtacctctcaaaagaagccactgacgatactaaagaagaaagccgacgatgattcacaaaaagtttatc

SEQ ID NO: 19741 - DNA, 349 bp, Diabrotica virgifera
tgaaactacagaagtactaacacaccaagtaactggtgaagttaagtccgatgttattgtaacggcaacagctttaccagaatatagtccttcagaaggacttaccagaattgaacctatagtggttgaaagcatcgatgacttcactggtacactaaagctaaatactgtcagtgctcaagaaaaactcgacgtattttcagaagtatcagtaagtgagacacatacagaggctgtagcttcagaattcaaggttggaacagatatgcctaccggtaaggctgaacctcttttagatgccgttaaacatctacaagcatcagaagtgcaaacctctgaaaatataaca

SEQ ID NO: 19742 - DNA, 929 bp, Diabrotica virgifera
  misc_feature (305)..(324): n is a, c, g, or t
  misc_feature (352)..(374): n is a, c, g, or t
  misc_feature (424)..(450): n is a, c, g, or t
  misc_feature (693)..(719): n is a, c, g, or t
  misc_feature (826)..(844): n is a, c, g, or t
acactcaatatttattgttttttcgattatagccaaaatgtattaaaaattcgtgggaaatactgaaaagattcatttcgtactttgctatgagaaaccgtgacgtcgacctcgagtattttttcattaagtgggtaggtgcaaaatttgcttgcagtgctttttaaatgcattcatttttttggaatcatgaaaactcattagtatttttgaaaaatttaactccagagtaaacggttacattattaccgagggccgaaaatccctgaaaacctctataatgtttatttgaataagttacaggnnnnnnnnnnnnnnnnnnnnttgagtgtaatttttaatttcaaatatnnnnnnnnnnnnnnnnnnnnnnngttctgactttcggccctcggtaatatgtaatgtaatctttcaatctggnnnnnnnnnnnnnnnnnnnnnnnnnnngtttttccaagattcgaaaaaaattaatgcatttaataagcatcgcaagcaaattttgcgcctatcatttaaatcatttaaaattctgcgctaaatggcatttgagatatgggctatgcttcatctcatgcacttttaatgaatgatattaaagtatgagatgttgggtggatttttctacttaagccagacagtagaacttttgaaagtcggctaggaggttcatcgtatgtgctcatattnnnnnnnnnnnnnnnnnnnnnnnnnnnccagtaattttgaatccatcgctactttggtttcggttagtattacttcttctattaattttaaacaagattccttgtggtcatcgaagagtcatcacaattgacgnnnnnnnnnnnnnnnnnnngttaatattatcttcataattgtttattataacatcgcttttgtcagcagatgttcttaaaaaggattttaaaaatgtgattgga

SEQ ID NO: 19743 - DNA, 933 bp, Diabrotica virgifera
  misc_feature (650)..(650): n is a, c, g, or t
  misc_feature (763)..(763): n is a, c, g, or t
atattgacgaacaattagaaatattaagaatacaaaaacaattctcacttggcagcaatggagatttcatggaaaaacatttggagtatttagttaagaacggtaaagattataaaccgttgcttattcaatacctgaaagatatggctattgaacgtcgtatcagagattttcgtaatatagatttatccataagtaagcggctttacacagaaatggtagagcatattgaagaagttattaatagtgttaataactcttatagtatacattttaaacatgattatttcctaacaattctgaatttttgtcagaataatcccgaattttgtattaaaattgcagattttccactatttgttcagttaatagaaaacaatttcagtaaagatgctaaatacaataatcaaataatagcaaatgttattttatacaatgtaaagtttcctcaatatgctgtaaaatacaatatagatatatttgatatgctgcgacatactattgctgaaaataagtatttaggtccattggaatcagtttttactaaaataattcttaccaaagatcgagacgatttcgcaaataaaatgttagaattttattttaaagaattgttcgagagctacaccgtttcatgtattggtatgttnggtttctaaaaaatgaaccaaagattttatcgtcttatatgacaatagtagcagacaagtatgccacgtggtcttgatgacatcaaaatttatagactaataaaacattattncacatttaggatttgataaaatattgagcgattctctgatagcacaactagacaagaaggaatgttgatgggtccagaagatactgataccatatgttcctacttctactatgattttataactttgtttctgaagatattaccaaaaagacaacttgatctagtgatga

SEQ ID NO: 19744 - DNA, 201 bp, Diabrotica virgifera
aatttgcttcatctgcatatgtatctgaacaagaaatgattgagatactgaagtcacccacactatgcatctagagacaaatgagagtcgatgtatagaaagcctcacccaaaaccacaccaactggcgcgctcccctgatgggaatgcgcgggtattgtgaggaggaggaaaagggcgtacaatgaagtgtggaagtccc

SEQ ID NO: 19745 - DNA, 80 bp, Diabrotica virgifera
ttttcgtccgcattgtcattaacgagaattcatattcaaattatttttaggataagtcataatgggaactagcgtacttt

SEQ ID NO: 19746 - DNA, 816 bp, Diabrotica virgifera
cttggactcttcgcgcatgcgagcgtcaaaaaattgatgcctttgagatgtggtgctggagaagaatgctgcgcataccttggacagctcataggacaaacgtttccattctaaaccaactcaatattaaaaaaaggctgtccacaatatgtctgcaacgaattctgcaattctttggtcacgtggttcgcagaggtgacgacagtttggagagattaattgtttctggaaacgttccggggagaagatcaagaggacgatcaccaactagatggtctggccaaataaagctggaaactcattctgcgaagctcttagagcagctgaagatagagaccaatggagaaacattgttaggaatattggaagaaatcacgatcctcagtaatggggaaacgacaggagagggagtagcgattccagggtgtctgccattataccggtgtcatcagcgaatcttatgttatttactattcttccgtttatagagattccatcacttagctccgctccactcggtaagttggaatgacaaaagagatctttctgtaggtattaaagtctcttatcttatagataataaatggcaatttacttctagtaacgcaccgcagaatataagggtcagtctcacgttggtttaagctggtttcaatagcgagtagaccacttggatctttggctccttagatgcggctctggctcaaatatccacggaaagcgcaataatatgttcctttaaaaaacattggtaggaaaaacattacattttatgctgataaattagcttttatcaaacttacaaactggcgcatt

SEQ ID NO: 19747 - DNA, 446 bp, Diabrotica virgifera
  misc_feature (257)..(284): n is a, c, g, or t
tgactacttatcccttatgtctgataatggtgaattacgtgaagatttaaaagttccagatggtgaagttggtggtacagtacgtgcagaacatgctgccggcaaggatatattatgtaccgtactgaagtcttgtggtgaagaagtcgttattgcagtaaaaacaaatactgctcttgataaataataatagccggttgtaagacagcggggtcgagaacgcaggcgtcatcctttgtctactggggatccccgcnnnnnnnnnnnnnnnnnnnnnnnnnnnnattggaccatcagttatcaaacaaataaagcttatctaatgcccgacgccctgtcaaccggcatccgacgttgatgtggtgtaattttacatctatctgtaatttgttggcaaaattacttgcaaagctacattttcgttcaataaatcgtaatttaatttt

SEQ ID NO: 19748 - DNA, 53 bp, Diabrotica virgifera
ttcgccggatattctagatccggcggcgctctatattatcagcttagacgcgg

SEQ ID NO: 19749 - DNA, 894 bp, Diabrotica virgifera
gaatcctgggtctattgctgtgttaatatccttaagaaccacttatatatcttcactagagaaggtcgggaatgcttcatttctatggcctgagtttattgatttttacgttcactccacatgaattacacgtggttttattcacctatccttaccactgcctttcggcttggtgtaggaacaccgcccgcaaattctcttagtaattaataggcttgcctgcagaataaagcggttgcagttgcagtccattgttttcctctagtgacaactacgttatgaagcagttcatttgctgtttttttattccttagttttaaggaaggcttgatataatttcttgctattttgtaagctaccaggaatttattctttgcgataccctcttggttatttgctgttggttatattttgaacggttccgacgaatctagggtaattgttgcttttaggtgttatcagatatgtggagaaactaatccagttggcttttttaaaatggtatctttgaagggagataaatatgtttaggggatttttcccactccctatattattgctgagcaatatcggttatgtcgaaaattgacaatctagataatgacacgtgaagcgacgagctagacgcacgttttcatttctttaatagattaaagaaagataattatttgatagcaaataaaaagtagacagtgatgaagacagtaaggtgaaccatgtttgtgagtatcattaaaaacgatatttcaacgacaaagaggtataaagcatggacaaaaaagaatatgtaaaaatattcgtaatatttattgcgttttaaaaaatagttatcaaaaacagctaaagattaaaatgtagaatgtaataatgactacttactaaaagggtaccaaa

SEQ ID NO: 19750 - DNA, 859 bp, Diabrotica virgifera
  misc_feature (99)..(185): n is a, c, g, or t
  misc_feature (386)..(403): n is a, c, g, or t
  misc_feature (425)..(440): n is a, c, g, or t
  misc_feature (442)..(482): n is a, c, g, or t
  misc_feature (484)..(532): n is a, c, g, or t
  misc_feature (535)..(678): n is a, c, g, or t
  misc_feature (680)..(791): n is a, c, g, or t
agatttttgctcttcgacagatcccattatacaccaggaaaaagtgagggtttacgcaaaagatggatccctcaccaacctggccacttagacggcctnnnnnnnnnnnnnnnnnnnnnnnnnnnnnnnnnnnnnnnnnnnnnnnnnnnnnnnnnnnnnnnnnnnnnnnnnnnnnnnnnnnnnnncgctgtcacaattttgaaaactctaccaatgaaagttgttggagtcgactgctacactcctactccaaatggtattaagtgatggattgacagataggtatgaacaactatcatatgactgcctcaatgacttcattctacaataactgctaaataagttaaaggatgatcttaactaaaacatcttataaaagtttaagnnnnnnnnnnnnnnnnnncataacaaattggaatatttgnnnnnnnnnnnnnnnngnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttacgctaaaaagcttacattattttaaaaagacgagagaccctaatagagttttatcaactaat

SEQ ID NO: 19751 - DNA, 362 bp, Diabrotica virgifera
  misc_feature (279)..(299): n is a, c, g, or t
ttgcgtccgaaattaatatttttgaagttattttcattgagatttggtttgaacgaatattgtcaggatgaattgtgattcatcctgacaaaattgacatcctgacaatatgtggtgacttatttctgaacctagtctccttttagctcgatacacttgagtcagcgatgctccatccagtggcggctcgtggccttgagagacagggtcgacaagatttttttgcctcctcatataggtataccatctaattaaaaggcttaaatcatcataggagannnnnnnnnnnnnnnnnnnnntggattacttgacattcttgtgtcatagtgtttcgacaatacgttttgattattttgagacca

SEQ ID NO: 19752 - DNA, 507 bp, Diabrotica virgifera
aattgtctaattattgaaaatttatttcacatttatattaattatccatacagtttagtttacataaatataaaatcaggacaatcattttacgttcaaaatatattactacatattcctatgaaaatacaaacaatgaacgataagaggctctagaaaaaaatgagggtagattagtgttttggctatttagcttagaggtcgactgaataaaagtgatacataattatagattgaacaagaattgaataattagtaggcatgctatgatggaggagtgggttatttagtgatattagatgtgttataagtacgacttaaatgatgtgaagcacgtgtactgtggtgggggcttaattcattaaattaatatataaagggtctgaatgataatagtatggggtacccgcttgatagttatgataagatgatgtatatcggtgttgcatacttcaatcttccttatatttgtgatgaattaattatgattcatgaacggggatatac

SEQ ID NO: 19753 - DNA, 794 bp, Diabrotica virgifera
  misc_feature (738)..(784): n is a, c, g, or t
tttcgtccggagttaagagtcgtaagacgtaagtgaactgccttttaacaagtggttttaaatttaaagttgtgttttgtttgacaaattgagaatgcccttaccacattttgcattttgtgaagtggtacaaggctttggtcggggctcaaaggaattaggatgtcccacggcaaatctccctatggaagcagtcaaccagctcccagacgatttggacactggtgtttactatggttttgcttcagtggatggtggagaggtttataagatggtaatgagtattggctggaatccattctataaaaataaaacgaaatcgatggaagttcatgtattacacgagttcgactctgacttctatgggaaggagattaggatagttattttaggttacctacgtcaggagaaaaattttaactctttggaatcattaatcgacgctataaaagacgatattaatcaggctagagaaaagttagacgcagctaattatatttcatacaaaacaaatagctacttttgcagttcgtgaataaggaataaataaggtagtaaggaccaggacttttttatttctcccttttttcagaacgtaggttttcgtttcatacccctccctcttgtaatttgatttgtaaattatggaaaaaaagtgatttaaaggaaatatgactagaatgggacataactttttaatttaattcctttaaatgctataaaacttaatgggtcccnnnnnnnnnnnnnnnnnnnnnnnnnnnnnnnnnnnnnnnnnnnnnnncgccccctct

SEQ ID NO: 19754 - DNA, 199 bp, Diabrotica virgifera
  misc_feature (67)..(186): n is a, c, g, or t
tttattcggacggaggagaggaggcggagatgctaggcgattgtttttgttcgagtcttcgaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaaaagaaaa

SEQ ID NO: 19755 - DNA, 852 bp, Diabrotica virgifera
  misc_feature (276)..(296): n is a, c, g, or t
aaatgaataaactaatcgtattgtgtatatatttaattttacaatgttcatatggtgatgatgataccatagatgcccaagttggttgttttctccccaaagacaagggtcaatgcagaaattacactactgcatggttcttcgatgtggagtatggcggttgctcacgtttctggtatggtggctgtgaaggtaacgcaaaccgttacaaatctaaggaagaatgtgaagacacttgcgtagatccagaaggagccaagaagtgcaatttacccnnnnnnnnnnnnnnnnnnnnnggctactacgtaagctactactatgagaaggacgtaaaaacgtgctttccgttcacatatggaggctgtctcggtaatagcaacagatttaattcaagagaagaatgtatgtatttttgtggtgaagacgatattcaagtccctccgaggatctccttgaattcgactaaattagtagtctatccaggtgagcaagcttatatcaactgcagcgccactggtgatcaacccatcaaaatatcctggaggttttttggaagtgacatgcccacttcagttaccaataaagacggatacattagcttcaacgatatccaattggaacatgccggtacatatgtttgcgtggctaccaatccagctggtaattcaagtgctaaaagttgatctcatcgttaaagtccctccaaggatctcctttgattcgactaaaattagtattctatccaggtgagcatgcttatatcaactgcaacgcccctggttatgaacccatcctaaattcttcctgggagggttttttggaagtagaccttgccccctttcagttaaccat

SEQ ID NO: 19756 - DNA, 833 bp, Diabrotica virgifera
  misc_feature (56)..(816): n is a, c, g, or t
gataacatcgtcgtcatacactacacctaaccttcaaaatatcagattgggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcccaaatccgtga

SEQ ID NO: 19757 - DNA, 848 bp, Diabrotica virgifera
  misc_feature (497)..(519): n is a, c, g, or t
  misc_feature (646)..(663): n is a, c, g, or t
ggtcaaaataacgtcgcacttgtccctaagctatgaataagaatacatccagtctggctcttatacctgcgtattacgaatctacgatagtatgagaaaacaactactgtaaacatgaaaatccgtggtcttagaataggcctttttccttatgctcacgttttcagcatttggaaccacaatgacccggtataaaaacagagttaccaatcgtattaatattagtaaattacgtgaacgttgtttattttaaataggtaatgacgtcacaataggctcgattgttgattattttgtatgctgacaatgggtgtgagtaaaactcaagcttaagtcaatcaggaaggaagaagaatggtctcatcgttcacatgtgacataaattaatgtgtttttggtatgaagtacccaattagttaaaaatataaaagaataagattaaataatgccgccttttgttttatttattgttactcatataatgaaatgagtccacnnnnnnnnnnnnnnnnnnnnnnngatgaaaattattcttgataaaaataataaacttaaagataaaacccataactaaattaaaattcatggtgacgtttcaattattactttaatcatcgtcagaataataagtttcttgagcggatgnnnnnnnnnnnnnnnnnnggaacaaacaataattaatgaaaacgtaaaaatgacattgacaatcattgggttaagtcaataatttcaaacacgccatgtcttgttgcgtgtttaagggtggcttcaaaagaaatatgggataatggccttcctttgatgctgagttcccgttggagaaaatttggatggaccaaatgatttga

SEQ ID NO: 19758 - DNA, 845 bp, Diabrotica virgifera
  misc_feature (427)..(447): n is a, c, g, or t
agaaactcaaattggattcaaatacatggaaattaattgacagatttataaaagatgacaaaacaaaattgtacaatgaagacgaggcgcaaatatccccttcactgcttctactaaatcagttagatagagaattattttctgaactagagaatgaaatcgctgcaaggaagctaatagatcttataatcgaaatatccactaccgcccgtgaccctgaagtacttccggctgccagtaaaattttcaaacatattgatctgaatgcagattggattaaagagcaattagttgctatgagggaggtgcagtctcctaaacttgatgaaagtaagcgtaagaggagaatcagtgtcgtacccacagtggatatattggatactctagaatggagaaaaggtgttacgatattggaatttattcaagnnnnnnnnnnnnnnnnnnnnnctgagatcatagtgccaatatttttcgatcttcttaaacgttgtctagatttcgacgagcaaagctctgtcgaatacccaaaacaacttttactttctattgttctgcattgctgtacaaaaatcgaagcaaagatacccgaaaacgtttttaatgtggaacttattgttcagagtataagagcatcccagaatccccaacacatcaccatgcattgatggattagcccacactgcacataaatatccccaatcaagtgttgcaaaatattatggctatattccacatttataggaatcgtcggtgctgagacatgacaggtgggtaataattttctaataatgttaagaaattgggggatgctagttatttccccttaagaagccaccttagcgtcg

SEQ ID NO: 19759 - DNA, 136 bp, Diabrotica virgifera
tttaccttagggataacagcgtaaattttattgaagaggtcaaatcgataataaagattgcgaccctcaatgttggattaaagtttaaaatttgggaacaagctatataatatagtctgttccattttaaaaattt

SEQ ID NO: 19760 - DNA, 636 bp, Diabrotica virgifera
  misc_feature (7)..(53): n is a, c, g, or t
  misc_feature (57)..(172): n is a, c, g, or t
  misc_feature (176)..(197): n is a, c, g, or t
  misc_feature (199)..(211): n is a, c, g, or t
aattggnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtnnnnnnnnnnnnnnnnnnnnnngnnnnnnnnnnnnnaatgttaaattgtattgattaccaagatattcataatcaaaatttttcaaatcatgaccataaattattcttagagagaacaaatacaagaagaatactttcttatgagagatgtgaacttaaagacacaattctggcgttacttcttaggtatcttgacctctggtggtgtcgatgatgatacctaccatctgttttgtgataaccactatggattggaggaaagccgcctgtggccgaagacgtgggggaacgtgcggctgagaggcatttgtctgtctagagaaactgtttacggagagagcttcgcatgaacagcgaacgcggacgacgcggagaaagatgcggcggtaaggaacaatgactgttggaagttactttaggtgacagatattgcaaagaacttttgtcggatccagcttgaa

SEQ ID NO: 19761 - DNA, 648 bp, Diabrotica virgifera
  misc_feature (8)..(54): n is a, c, g, or t
  misc_feature (290)..(319): n is a, c, g, or t
  misc_feature (359)..(388): n is a, c, g, or t
aagaggannnnnnnnnnnnnnnnnnnnnnnnnnnnnnnnnnnnnnnnnnnnnnngaggaatcccccagggattatataggaaagaaattagtaatattaaagagtgttttatataaaaagagggagatgaaggatttttttagaagtttgattataagatttaatttgatttaagatgtggaaagatatattatatgagattataagagaaagagttgttttatattgtgaatatattattgaggaagataaaatagttgaatttgaattatgtaaagtatattagatannnnnnnnnnnnnnnnnnnnnnnnnnnnnngtattttttatgtatgataataattgaggatattataggnnnnnnnnnnnnnnnnnnnnnnnnnnnnnngttgttaaaatgttaatttaatttatataggtttgtggaattataaaatatatgaaaataagtttttattacaaagttatgaaattattgataaagatattatttatgtaataaattttgagttgataaaattaaagatttttgttagtaaaaaagaaggatttattgggagaaaatttttgaggaagtaaaatgagaaaaaacacgtttgtatgtagaatttaattaaggagatttttattggggtgtttttggtgaaa

SEQ ID NO: 19762 - DNA, 893 bp, Diabrotica virgifera
gaaaaaagtgaatgttaattttaaagaaatatggcatttttagagtggcggaaatttcacttctttaacctgaaaggaaatgttgatgaagggaaaataaaggaattgtttaaggagactaagatcacaacttcaagtggaaacaaccaccttgtgtttagtgataatcttggacaaatttatttgatatcacgatcatggcaggtcataacctttagaggatatgaaataaatgtagagttaactcagcaaatgagaaatgcacctttgttagtaactatagggcatgatgaaccaggtgtgaatcctttaataaaagtttgggatactagcagattagacaaaaatggagttccatactgttgcaggattaccagagcactccctggaaatagacctgtacaaagtagtgctttatgtgttcatgagaacttgcaaatgatggcagtgggatttgtagatggctctctccttatttacagaggtgatatcacgagagataggagttctaagcaaactcttctgagggcagcaaatgctatcattacaggattggcttttaaaacaacagcagctagtatacttctttttgttgcaaccgaaacatccgtccttgtttataatgttacacaaaaagacaaagagcaaaagtatcatttggataatattggatgtaccaaaaaatgtagtgtactggcagattccatgcaagaaaatcattttatgattggtagagatgatgtcatatattgttacacttccgatggtagaggcccatgttacgcagtagatggcgaaaaagtaatgttggaatggttcagaaattaccttattattatatccaaaacaactcgttctgcaaaactaacaaccatgcccacagaaaccccatc

SEQ ID NO: 19763 - DNA, 262 bp, Diabrotica virgifera
ccgagagagaaagaggaaaaaacccttacaaagatgggtgcaaactggagacaaagaaatagtatgtggctatcattggtgtgcatggagattaggatgagtttaagaacttgatgagtggtacttaataagttgagtgtgctagtttgattgttggtgttgggagtggagaatttgtgggatgtattaaaagagaatggagaaacaagttgaagatggtcttcttgcttatacccttgatgtaaaatgacttttttttgtt

SEQ ID NO: 19764 - DNA, 922 bp, Diabrotica virgifera
  misc_feature (850)..(850): n is a, c, g, or t
  misc_feature (865)..(865): n is a, c, g, or t
  misc_feature (878)..(878): n is a, c, g, or t
  misc_feature (883)..(883): n is a, c, g, or t
gcaaaatagttaccttgagtttgacgcgctttcacgtcttggtataactgaccaaaaaacatacattaaaaaacagcttgccaatcaggattaccaaattctcaattcttgcgtagtatccaaaaccatattggatcgcgtagaggctgatattgatgagtgcatagctagcaagtcattcatagatttacagattaatttgccttcagtatttaatcaaacagatcaagaaatgattctagacttagtattaagtaaccaaaaacgttctcaaaccgttctgttggagaactacgtctttagtaaaacattcatcgagaaactagttaaagattgtgaaaatttaattcaagaaaaagcaaagaatgttgtagaaagtggaaagtatcagcagtatcatatcagtctacaagcatcttcaactaaatcgcaaaaagtagaggatgtagaagaaaaggttgacaagagagaagaaaggaggaggaaagcagctggtggaaaaagcggtgggggaactcaaggcagagagacgaaaactaagtctacaaaaaagttatacagagccgctcaaagaaacaactcggagagtgatggagatgtggctgaaaagaaaatagtgttggaaattattaaatttgatgatattaaaaatactttgcaacttccgcttgaagaagagggcgtacaggacgatatcttagatgaaattgtgaaccatttgcttccaaaattaaacgaagatgccatacaaattgcagcaaacattttcgctactaccgttaccgatcgcacggctaatcgtcgtcaaactcacaatgaaattcaaaacaagctgaatgcgttgattggnagaatgtcgattatntgataaaggttanaactntttccagctgatttgcatcacatctagtgaagtatcttc

SEQ ID NO: 19765 - DNA, 461 bp, Diabrotica virgifera
  misc_feature (98)..(116): n is a, c, g, or t
cccaggaagaaagcagccaaggaagccggggggagagggcgaaggagagagaaagaaaattttcttattgtcgctgttacgagagcttcgaaagtagnnnnnnnnnnnnnnnnnnntagttgtaaataattattttggaatgaaatggtatttgttatggaatatatctaatagtatgagaaataaattaacgttattgatgatcaatatgttgatgattaacgatttttatattatgtaagatgatatatttggagggaggagcttaaagataaaagtttattgatatttattgttgacagaaaaggtaggatggtgggggatcatattataaactatggtaatatggatttttatatataaggagttagaggttttataaatgacgaattgaaatataacatttaaagtatttgaatctatcaatgatgataatgttggaatgacaaagttgtaaattt

SEQ ID NO: 19766 - DNA, 475 bp, Diabrotica virgifera
ccaattattttttaaaggcactatcttaaatacaggtttacaccagacaatccgggacgagagatcaccatgatttaccattcatcttttcttgctgcacattgaaaacgactagatactgtgcaaccaacagtgatgcccctggacccagatattacttttacaacatgatcactggcacatcacaagctgactgtgattacccccttgctgcagctggcagtgtctgaacttgaagcagagtatttcatagaatgaacaaacacgtgaacatgctcttcttgcttacacccttgtagtgaaactgcttattgatggtgacaactagatggactcgactgaaccagtatactatgcatcacgaaccgaggaaatcaccgaaggaagtatccctccatacatcatgacaactgaatacaacccagctgccgttgctctcagaccaaatacacgacgccccgaagactacatgtta

SEQ ID NO: 19767 - DNA, 657 bp, Diabrotica virgifera
tcgcccacgcgtccggccaggtgataccacagaggaaattcagttgataccagacccagtttttagtttaccaactgatggtgccactgttactatcatcagtagtactaatgacggaagaattttttatggcacaaaggagggaaagctctttgaaatatactatcaggctgaaagtggttggtttgggcaaagatgtaaaaaggtaaacttgtctacaagtaccctatcttttctagttccttcatttttaaatgctgctcttagcgaagaagatggaatttgtcagatttcaatagatgagagtcggcatatattgtacaccttaacagaaaaaggaactatagaagtttgtgatttgggcgaaagaggaaatacattttcaaggatagcaaaattgggccaaaatactctagtaaatcaagctatgaatactgtcaaaactttagatagtcaaaacttcagaccaatagtaagtatatcgggtattgaatgcacagaatctgccaacttgaatctagttgctgtatcccaaacaggagttccgattttacctgacaggagttagtctctccaatctgcaagcagatcagagactatatactctaagctttaggtcatgtacgggtaccagcaggatatttcatgctattttaa

SEQ ID NO: 19768 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19769 - DNA, 877 bp, Diabrotica virgifera
  misc_feature (25)..(60): n is a, c, g, or t
acgaactcaagcgcgttgtagttgnnnnnnnnnnnnnnnnnnnnnnnnnnnnnnnnnnnngtttgtttttagtttgccttttctagtaatttcggttgatttatatttttagttactttgaaacggttgtgacatttccacatgtttatttttttggatttagattgtaaatagggtagcccttgcccgagaaatacgaaaaatatacaaaaggtagccatctatttataccaataaacaaacagaacaccaactaagttaagtgtacaggataagtttattatcgtagacgatttgttaaataaaacagaaaaataggttatcaacgtttcatttgactgaattaaaaattaagaaaggaaaaaataatacaatcatgatgtccaatggtttagattccggtgtagttggacaacaaaatggcaacagtggcaacagtgtcggaggcggacaagaagaatcaaaaactaatctcattgtcaactatttacctcaaaccatgacacaagaagaaattagatctctgttttccagtattggtgaagtcgagagttgcaaactaataagggacaaagttacagggcaatccttgggctatggatttgtgaattaccaccgaccagaagatgcggagaaggccatcaacacactaaatgggcttcgattacaaaataagacgataaaggtctcttatgcccggccaagctcagaagcaatcaagggagcaaatttatacgtatcaggactaccaaaaaacatgactcaacaagatttggaatccctattcagtccttttggtagaattataacatcgcgcatcctttgcgataatatcacagtacgtcaatttgtctcgggggccggagaaaatttgcct

SEQ ID NO: 19770 - DNA, 92 bp, Diabrotica virgifera
  misc_feature (2)..(89): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnctc

SEQ ID NO: 19771 - DNA, 849 bp, Diabrotica virgifera
  misc_feature (315)..(338): n is a, c, g, or t
  misc_feature (683)..(683): n is a, c, g, or t
  misc_feature (755)..(755): n is a, c, g, or t
gtcccaatatatttcaacatcgttttcatccacgaaatatggagctattggtatacagacataaattactttgtttctccaaagtaatttatgtctgtgtcccaaaataatgttaaacgaggagcggttgttaaggttaatccgtggaattataaatatatacaaaatgaagctgccgtgctggctcaacttaagcataccaacataatagagttattgggttatgacccaaagaataaagtaattatgttagactatctgaaatttgctgaattagcagaaggattaaatgagaagctagttgatttaagcatnnnnnnnnnnnnnnnnnnnnnnnncgacctaacaaccggtatggactatgtacattctaagaaaattctacatagagatttacaaaggatgccttttctctacaacgataagaacgaatataaaataggagggtttcgtaaagctgtttatgtgggtaattccaatgaagaatctcactcgtcggtgtcggttccgttctgtgaatttgctccagaatggcgtgaaacgtacacatacacaacggaaacgtataatgaaccagaaacatacacgtacacatacaaaactgatgtttgggctatgggatcgtgttttaaagttatattggacaaacggatggaaacgttatgtgaagatgacatcacganacggttgcagctatttgtaactgactttatgctcgctgtccatccaggatccaggaaacattttactgaagntaaagcatttattcaaaacatggaagtttaaaccattttttttatgtcgtacatattaatacttaagtactataataaagctttataatattat

SEQ ID NO: 19772 - DNA, 516 bp, Diabrotica virgifera
  misc_feature (335)..(363): n is a, c, g, or t
cttcttcttccagcagaagattgtttgaaggagatcttgtaaaacaccatacgcccatacttgactttaactgcatagaacatcactgatctgttgccaaaaaataattcatagaaagcctacaattgaatctcctgtcaaatatgacactattattcaaagatcctcaagactacctgaacgatgatccctatatcacataccatcaaagtcctaaaagagcactatcacgtaaaaacaacgcgaaacacaacaatccggaactgaaagtgtctgctgcgacctcgtacaaaaatcggttcatagctttatatggattttatctgatatatagnnnnnnnnnnnnnnnnnnnnnnnnnnnnnggaaaatccaaaaccgacttcttttcaaaatgtaacaaatccctacgatgaaacgataagaacgaagacaaagatcttgctccaactattccatacttgtcaccccccaccaaaaatcaacgaaattgattcagattttattcgagaaaaacc

SEQ ID NO: 19773 - DNA, 755 bp, Diabrotica virgifera
  misc_feature (655)..(670): n is a, c, g, or t
aagaggtttatgatttacaaaaacccaccaacaagatcttaaaaatgggccatacggcaaagaaataccaaactaaaattgaagaatttcagtcctattttaaaagccataataaatataaagaacacgttggtcactcgtctaaagttcattctgtaggttggagttgtgatggcaagaggttagcatcaggatcctttgataggtctgtttgtgtatatacgttggacagggatagactgaacaaagaatatgtcttcaaaggtcatggtggatcagttgaccagctttgttggcaccagtctcatccagatcttcttagtaccgccagtggtgatagatctgtacgaatctgggatacaagagttcaaaaatgtgtcaatactattatgacaaaaggcgaaaatatcaacataacttggtctcctaacggcaattctatagctgtaggcaacaaagaagatctcgttactttttgatgctagaaacttcactatacaggccgaggaacagtttcactttgaagtaaatgagatatcttggaataataccagcgacttatttttcttgactaatggtcaaggctgtgttcatattttaagttaccccgacctaaaacgtcagcatattttgaaggcccatccaggaacgtgannnnnnnnnnnnnnnnatccaacgggaaagtattttgctactggaagtgctgacgctttggtatctttatgggatataaatgaattagcatgtaaacgagt

SEQ ID NO: 19774 - DNA, 898 bp, Diabrotica virgifera
  misc_feature (816)..(833): n is a, c, g, or t
agcgaatatttttcattaccaaatatgttaattgctactggaacatttatctttcttatatgctttttgggatgctacggagcaattaagaacagttggatcatgctaatggcattttcattactgttgggtattatattcatttttgaattttccgctggaattgctggttacgtattaagagacaaaacagaaaaatatttgacagattcgctaaccacagcgatggataaatataacagttcgtcatcaactgctaccatgtgggatctcgttcaaacaaccttcacatgctgtggagttaacagttataaagactgggagccagttatgaaaaataccgatttacccatatcttgctgtcctacgaaggcgggtacatctggttcattctattgcaacgctgttactcctactattagtacatcatcttctgagacaactagtagtaccccttctaccaattctacccctactactactatcaaaaccacaccctctaccacttctagtactgttgtcaccaacgaaatgagtgtaccaactccatcaactacttctgtacctactgcttctaccgcaaaaccctcctctattactcctactgttcaaagtacaactaccaatgagactagcgcacaacatcccaatccaacttcatctagaagaaaacgacgagatgtttcacaaccagccaccaccacatctccctacaatattggatgtgagacggcatttggaaaatgggttaaagctcatgctgtagacatcggagcagtgtgtttcacattagcagtgttacaactcatcggaatnnnnnnnnnnnnnnnnnngtccaaacaactgaagaattcatattatagtacataaagtagttatcaaatcactaattatgtta

SEQ ID NO: 19775 - DNA, 237 bp, Diabrotica virgifera
  misc_feature (7)..(44): n is a, c, g, or t
  misc_feature (79)..(101): n is a, c, g, or t
  misc_feature (109)..(130): n is a, c, g, or t
  misc_feature (135)..(135): n is a, c, g, or t
  misc_feature (156)..(156): n is a, c, g, or t
  misc_feature (170)..(170): n is a, c, g, or t
  misc_feature (183)..(184): n is a, c, g, or t
  misc_feature (207)..(207): n is a, c, g, or t
  misc_feature (225)..(225): n is a, c, g, or t
  misc_feature (232)..(232): n is a, c, g, or t
taacagnnnnnnnnnnnnnnnnnnnnnnnnnnnnnnnnnnnnnntgcgacctcgatgttggattaagtttataattggnnnnnnnnnnnnnnnnnnnnnnntgttcgannnnnnnnnnnnnnnnnnnnnnagttnaaccggtgtgagcccagtggntttctatcttttanttattactatatnntagtacgaaaggacccaatatantaaataatttttatattnagataantattc

SEQ ID NO: 19776 - DNA, 474 bp, Diabrotica virgifera
  misc_feature (30)..(52): n is a, c, g, or t
gcagttttttaataaatttatccctccctnnnnnnnnnnnnnnnnnnnnnnnaggcagctcgcgatttaaagacggatgggggaggtgacgaggcacctccggacaggtttattgtgtagtatcagatttcagtattgttagttgttttctagcttggagtaatctaggtcatagatgttttctgaaaaacttacaggtcattggatagggatcgtatccgtctatcttccataacatacatgttcacaccacgtacatcattctgcccatgaaaattttctcacatcttattagtagcggcgctatgcatatttgaaactgttattgtcttgactagtgatgtatgttagtaagcatgcgtgatatatttacgtattaaggacacagggtattcatggatacccgctcatctggcattgatttccttctgatagataacatagccgttttctttctactcagactactcacat

SEQ ID NO: 19777 - DNA, 67 bp, Diabrotica virgifera
  misc_feature (13)..(45): n is a, c, g, or t
  misc_feature (57)..(57): n is a, c, g, or t
agacgagaaagannnnnnnnnnnnnnnnnnnnnnnnnnnnnnnnnttttagtattanattatttata

SEQ ID NO: 19778 - DNA, 872 bp, Diabrotica virgifera
  misc_feature (98)..(121): n is a, c, g, or t
  misc_feature (558)..(575): n is a, c, g, or t
  misc_feature (619)..(650): n is a, c, g, or t
tttaattattagtgcaagaggccacattgttactatcaatacaaataagataaattagggcttgttatttcattgcatacgcaacatggttaacatannnnnnnnnnnnnnnnnnnnnnnngtattattaatgctatattgggaaactggatatggtgttcctgttgaaaatagtgatgatgaactagtagctgtggttgcagtttctagacatggagatagagcaccatttacttcctttcctacagataagtattataacctgacctattggcctatgggatttggacaaataacaaagaaaggtattgatcgccaatacaaactaggtcaatggcttcgccatcgctacagctcctttctaagcgaattctaccataacaaagaaatctacgcttggtctaccgatattgatcgaactttaatgtcagcatatgcaagcttagcaggtatgtatccacctaaaggctaccaactgtggaacgagcatatttcttggcaacctataccggtccatatagcaccttttctttcactcatcgaaaatttaggctgtcnnnnnnnnnnnnnnnnnntacaaaaggtaaaggaatctgtttttcctatttacgaagaaaannnnnnnnnnnnnnnnnnnnnnnnnnnnnnnnaaactggttggccaaaaagtttctatagaaatggtggacgagcttatggatcttctttttacctatgaggagcatgacttaaccttcgctccagactggagtaaactatggatcataatataactagatatctttcggctgttgtatacgaaatccagacccatacagtacctctttgcagactcaaaataggaacattctacgactacctgttcaattttt

SEQ ID NO: 19779 - DNA, 171 bp, Diabrotica virgifera
  misc_feature (3)..(87): n is a, c, g, or t
  misc_feature (97)..(97): n is a, c, g, or t
  misc_feature (99)..(143): n is a, c, g, or t
  misc_feature (145)..(159): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnnnnnnnnnataattattntnnnnnnnnnnnnnnnnnnnnnnnnnnnnnnnnnnnnnnnnnnnnnannnnnnnnnnnnnnntccatttttttg

SEQ ID NO: 19780 - DNA, 155 bp, Diabrotica virgifera; identical to SEQ ID NO: 18375
  misc_feature (20)..(33): n is a, c, g, or t
  misc_feature (36)..(58): n is a, c, g, or t
  misc_feature (66)..(88): n is a, c, g, or t
  misc_feature (118)..(149): n is a, c, g, or t

SEQ ID NO: 19781 - DNA, 937 bp, Diabrotica virgifera
  misc_feature (468)..(486): n is a, c, g, or t
  misc_feature (768)..(768): n is a, c, g, or t
  misc_feature (820)..(820): n is a, c, g, or t
cccacgcgtccgacgaaaagttaaacgttcctgttctgtctaatgctggtgtggttgagttttatacggatgatagtggtttttcttatgtattctacatacactcgtttgactgatttccaattgacccgaaatttttctcgtactagtatttgggttttccgtaacagaaagcaggacatcaagttagttaacgtcatcaaaaataattggtttatttttatttaacttttcgtacctatgcaacattactagtagcacggaatctatcgagaaatccctcaaaaatgaccttttttgggtgtcttcttttaggatacttttaagcgtaaactttagaagctaaaagacagttttaaaaatattcctgaatgcaaagtagcatgtctactctttcatagatagcgtgattattcatttttaggaacaattaaatttgaatgtatgtaattggctcggccaaagcannnnnnnnnnnnnnnnnnnattataaaagtgtaataattggtcatgaaatgcgttcaaccaatatccaactgtttagatgtaaaagtgagcttttataatttcttaaataacttgagaataagccttcttttaaaactttacattttaggaagggtcaacataactcggaacactctgtacatcggtatagggaggccctacgaaactataccttattttttgcggacaattaagagatgcaataaaatacagggcgttccatgggaaagggtataactttgatgcgccgccgtttattgngacaccctgtatatttcaaaatatttttaaggtgtagcttttatcaacttancaactactcagtttaaattttttttcaaatcttatacataccattttgctgtaatcttccgtcccgttggtggtgactcaccctgtatagtcctatatcaagtcctggaaattttcg

SEQ ID NO: 19782 - DNA, 626 bp, Diabrotica virgifera
atattcttttattcattttagttcataaacaaacgcaaaacattttagttgtatattatagaattaatataatcgacgaattcaggtatttttggaaacgctccaggactcttacgagctgcacatattgttccccatgatactattccaatttgaattccacaaactacaagtggtcctccagaatcagacctcgaaaatcttttcctccttgctctaattcaggattatccgtaccaagcttcaattctcttttacggaaaacatggatgcggcggtgcgataatctagcgatactatcttgtgatagcagcacattggacttatgatgtcacgaagtcagagcggacagaaagtgtatacttctggcttgatagaagaacatggtacagataatgcggaagaacaatacgtatgactagatgtttgaagtggacagttgtgacacaagcaaagaagactgtctcgctcgatgaaatcgttggaacgtttggtgatcagcgtttaccttacatctgattgacatcccggccggatccccttgatttatttgatggatacaaatatgacagaaaccgagatgaatgacaaaggtttgaactggaaggactctgccacaccttttc

SEQ ID NO: 19783 - DNA, 258 bp, Diabrotica virgifera
  misc_feature (5)..(46): n is a, c, g, or t
  misc_feature (52)..(74): n is a, c, g, or t
ttttnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaatgtaattaat

SEQ ID NO: 19784 - DNA, 206 bp, Diabrotica virgifera
  misc_feature (7)..(44): n is a, c, g, or t
  misc_feature (81)..(103): n is a, c, g, or t
  misc_feature (111)..(133): n is a, c, g, or t
  misc_feature (164)..(192): n is a, c, g, or t
taacagnnnnnnnnnnnnnnnnnnnnnnnnnnnnnnnnnnnnnntgcgacctcgatgttggattaaagtttataaattggnnnnnnnnnnnnnnnnnnnnnnntgttcgannnnnnnnnnnnnnnnnnnnnnnagtttaaaccggtgtgaaccagggttggttnnnnnnnnnnnnnnnnnnnnnnnnnnnnngtacgaaaggaccc

SEQ ID NO: 19785 - DNA, 743 bp, Diabrotica virgifera
  misc_feature (29)..(55): n is a, c, g, or t
cgaagaacccatctcaagaacgtaccagnnnnnnnnnnnnnnnnnnnnnnnnnnngagcgaaaaagaagagccaggattaaccgatgtttagacgagttgaaagagttgatggtgacagcgcttcaaaacgacggagaaaatgtttcaaagttagaaaaagctgatatcttagaactaacagtgaggcatttacacaacctcaagagccaccaccagctagtactaccacctgaacagtcttacgctgatcgatttagagctggctttactcaatgtgctcaggaagttactcaatttatcacaacaccttctgatatcatagatccttcagctgggagaaaactgctacaacatctgggagcttgtgtgaggcaactggattacgtgtctcataacttcaatatccagtattcccagaagtgtggatccccccaaggctctcctacgtcaaagttgaagtgttctacaccttcgcaagcttcaatgtggaggccctggtgaaaagactgttatgtttatgttagtgtagtgacgtttgtgattttttgtaagtagcttagtagtttcttaattcttaaaaataattcttttatcaatagaaaatttgttacaatattaacttacaataacgatattttaacaaatatttccaaatagtttattatcaattggcctcccttttttccgaataataagaaccttcaatttttgtcctggataacaaccaaaataatggattttt

SEQ ID NO: 19786 - DNA, 885 bp, Diabrotica virgifera
  misc_feature (194)..(214): n is a, c, g, or t
  misc_feature (359)..(382): n is a, c, g, or t
  misc_feature (795)..(814): n is a, c, g, or t
atccttgatgccttttattcatttattatttgactactgatttttagtacatttttgcaattttttatgatcttaatatttgctatcgtaaatatacctatcaaaataaatatacgatataacaaatatacgctatatgcataatacatttaaattattattctaactacttatttacaagggttaatataacnnnnnnnnnnnnnnnnnnnnnattactactgcaatttttacatattttcaccatatattgacgtattattttatctctatatttttactatatatctatatactacatatctatatacaccgtaagactatcgaatttatattttcgctaagaagtgcagaagctnnnnnnnnnnnnnnnnnnnnnnnntgtataaatgagtagcaacaaagttacttgggaagattttgtcaaaatagttgaggaaattgcacaagaaatagacaggcaaagcagaagagtcttaaagaaaaaagttccgaaatctaaggacataaaggaagaagtaacgacacagctaattaaagcttataacaagttcacacaattgactaggaaaaactgggaagcactttcggacaaacaaagggaatcgtgcaacaaatattttggaaaaatcagagacaaagttatacgatcatttcaagcagtaaatgtgagaacagtggttccaagttcaatacatcaaccaatcgacaaggaagttgaagaggaacaaagcgatgaggaaatagaagaaggaaaaagcgacgaggaaggagaagaagaaatatttaacgacnnnnnnnnnnnnnnnnnnnntgacataaaacaagatataacaatattaaacatgcttttgacaatcaatgaatttttgaatatcgcaagca

SEQ ID NO: 19787 - DNA, 877 bp, Diabrotica virgifera
  misc_feature (46)..(64): n is a, c, g, or t
  misc_feature (328)..(345): n is a, c, g, or t
ccaaattgtttttgtctggagctctattgcagaacaaaaactaaannnnnnnnnnnnnnnnnnnatggggaaaagaactttaagtaaacgggaactggaggaacaaagaaaaagggaagaggaggaagctgcagcgcatgtattccaagaatttgtagaaacttttcaagaggctcctattaatggaagttcaaaagtttgggtgaaagctggaacatatgatgcaggggcgagaaacgaagacactagagaaaaggggaagttgtataaacctacatccaggttagcaacagctcaagatcaaatgagctctgcagatagagctcannnnnnnnnnnnnnnnnnaacatcagataaaaagccagaacgattgggcaagaaaaagcaaacagccaaaagtaaccttgaatcgtttatggaagaactgaggcaaatacaagaagaaagagaggaacgccataaatacaagggtgcagtgaagaccccacttgaaaatgagttggatttgttaatgagaaatggagatataggttcctttgatactggcgatccgaacactacaaatctgtatctcggaaatctgaatccaaagatcaccgaacaacagcttttagaattattcggaagatttggtcccttagcgagtataaaaataatgtggccccgctctgatgaagaaaaagcaaggggtcggaattgtggttttgttgcatacatgtcaagaaaggatggtgagcgagctttgaagaatttaagcgggaaagatgtgtttggttgtgaaatgaagctcggttggggtaaagcgggtatcattcccccttttatctattacgtccctcccgtgttattagatatttcacaacctcccaccgccttc

SEQ ID NO: 19788 - DNA, 414 bp, Diabrotica virgifera
  misc_feature (65)..(86): n is a, c, g, or t
  misc_feature (134)..(165): n is a, c, g, or t
  misc_feature (167)..(180): n is a, c, g, or t
  misc_feature (182)..(198): n is a, c, g, or t
  misc_feature (220)..(257): n is a, c, g, or t
  misc_feature (268)..(294): n is a, c, g, or t
  misc_feature (298)..(318): n is a, c, g, or t
  misc_feature (333)..(363): n is a, c, g, or t
tattaatacaaacaattttcacatcagttattacaggattaataaattataattactgattttcnnnnnnnnnnnnnnnnnnnnnngtaggaggaatattaattctttttatttatataaccagaattgcttcnnnnnnnnnnnnnnnnnnnnnnnnnnnnnnnncnnnnnnnnnnnnnngnnnnnnnnnnnnnnnnnctatattaagatttattttagnnnnnnnnnnnnnnnnnnnnnnnnnnnnnnnnnnnnnnatgaataaccnnnnnnnnnnnnnnnnnnnnnnnnnnncttnnnnnnnnnnnnnnnnnnnnncaaataatttaatcnnnnnnnnnnnnnnnnnnnnnnnnnnnnnnnctttaattgcagtagtgaaaattacaaaatttttatatggcccattacgac

SEQ ID NO: 19789 - DNA, 1068 bp, Diabrotica virgifera
  misc_feature (89)..(108): n is a, c, g, or t
  misc_feature (371)..(385): n is a, c, g, or t
  misc_feature (664)..(681): n is a, c, g, or t
  misc_feature (892)..(912): n is a, c, g, or t
  misc_feature (925)..(942): n is a, c, g, or t
  misc_feature (1000)..(1020): n is a, c, g, or t
  misc_feature (1042)..(1066): n is a, c, g, or t
attgtacccaaaatgacaagtcatgatatcaaaatagataatagtcagaaacgaaacgtcaagtttcacataactagttatcaatttannnnnnnnnnnnnnnnnnnnggaataactggataagtcgatgtatcacattagatatagtggcattctaacaagtgtaacatcacaaaatgagttataaaaatacgtaaaggaatctaaagtaaagattatgtcaacaactcgactggtcaaatttaaattttctttatcaatttgatatctatagatattagatatatctcggctttcaacccaaacagcacaagtacatccctgggacttacccgggacgtaccgctaggacattcgtacgtccagaggannnnnnnnnnnnnnnctgggacatccgcgggacgtaccgaggacgtctgatgttacaaaatcatccgtactcaggacatccgaccaaaccctccttaggacatctgagcaagacttcctagggacgtctgaccaaaacctccttgggacgtccaaccaaaccctccttggaacggccgactaaaccctccttgggactgcctaccgaaagtttttataaaatttcagcgtaagcgcaaaattttgcaccaatgttttttagatgcattcatttttttcgaatcctgataaaacnnnnnnnnnnnnnnnnnncatttaaacacagaatgaaagattacattattaccgagggccgaaagtcccttaaaataaacaaagtttcttttgaatgagatatttgatattaaaaatcaccctaaattttctgtttaattacccctgtaaccttggtaaaaataaacattaatagaaagttttcaggaaatttccggcccccagaaataagggaaatgtttctttcacnnnnnnnnnnnnnnnnnnnnntccctttttcccnnnnnnnnnnnnnnnnnnggaatttaaaaagggattgggccaaaattttttgccccaaagtccttaaaaaaagtgnnnnnnnnnnnnnnnnnnnnngtgttttttattggaatttctnnnnnnnnnnnnnnnnnnnnnnnnncc

SEQ ID NO: 19790 - DNA, 925 bp, Diabrotica virgifera
  misc_feature (67)..(86): n is a, c, g, or t
  misc_feature (496)..(511): n is a, c, g, or t
  misc_feature (514)..(531): n is a, c, g, or t
  misc_feature (538)..(555): n is a, c, g, or t
  misc_feature (916)..(916): n is a, c, g, or t
attcctcatatttctcataatattattgataatggatcaacacaaatcatatttatattcctaaccnnnnnnnnnnnnnnnnnnnntttaataaattattatcacaatacttcgctacctcaacaaaataccttcacatttcaaaaaaaccttatagctatagcatatagccatgagcgaatcacatactcaattattaaaaaaaccagtagtctaggaaacagaggttgaacctcgcaaaatggacgtaagtacggttttattttaactttttctacggttaaatttttcttaaaaaatttcgttccggaaccccccctttcatccatttaaagggggtaatttgtggtctttgcgaaacgtagtacttcctgtacgtttcgcaaaaaatgcacttaatagcaaaatgaagaggaccatatttcccactatctatttcccgacagcacatgtcaatcacccaccgtttagcgggggtggcgccccaaaattaacnnnnnnnnnnnnnnnntgnnnnnnnnnnnnnnnnnngctaacnnnnnnnnnnnnnnnnnngaaaccctgcgccaataaatctcaaatgagtggctgattttttggtataggcctcatctacggccaagcaaattttccaattacagagtgttacattttaaaaacccccccctataccatccgaaccgcctatgctagagtaaaaaaactttcagcgaccatccactcactggtgttatctacaaatttgtacaatacacgcccatattttccccggaaccaccaaaaaaaaggagaactaataaagaaaataatcaaaaattaattttgggccaccactgtggcttcagggtacaaagaaaataaaatatgcataggtcataatgtgtagcagaacgtgtggtcttttattttccataanttacgtacc

SEQ ID NO: 19791 - DNA, 657 bp, Diabrotica virgifera
agagagagagagagagtggagatgagtacctatcacaacctcgctaaaaattgagatatacaattaatctgacaatacatttgaatataaaaaaaacgaatacaagataactaaaacagctcaagatatggtacaacatgtacaaagaacaaacgcagtgaatccaggagccccatattacgccatggcgtttgtgaaccgtggggatgtacactctgatgactgctgcaatgctttgtgagacattgtcgactgcggttcctgatcatgcttattacagcgtgtagcaaagaattgattacacgtagattcctgtgcaatgggtacctatatttccagcatcctggtgaagctgaatgtgggctggatatattgaactttgatttgattataggatgttgcatcagaataatgaggatctcagagacatacatcattgagaccatctgatgttggagatggttttattaggaatctcaatcggaccgttgacaaaagaggtcttgtatgagactctctcagatttcggaaatattcttagtatgtaggaaactcaagatgataacggatctagtcatcgatatatatttgttctttttgaaactgaagaaactggaagtacgtctcttgaagacgtaaatgacatgctgttgaatg

SEQ ID NO: 19792 - DNA, 231 bp, Diabrotica virgifera
agcaaggaaaagaacaatcctacaggaggacatagccgatgaacgggactacgggactagaaccgcgcgcgatgcgccaaccgcgcggaagcgcagacggagttcgttcgaacctttacgctatgtacaacatgacagatttttttattctgaaagcgaagcatagcagttttttggggggggaaagcaaaccctcgccgtcctccccccccggaccccaaacggccccgc

SEQ ID NO: 19793 - DNA, 724 bp, Diabrotica virgifera
  misc_feature (133)..(159): n is a, c, g, or t
  misc_feature (260)..(278): n is a, c, g, or t
ctaatatttttatctgagattattaaccttattttaaatctgaagcatttatcgttactatccttaagttgatactcccttgcaactgctctatgtattcaattatttcttcatttactatgcataagttatnnnnnnnnnnnnnnnnnnnnnnnnnnnctcgtaatagtactgagaccgtactttaggtgtaccaagttcagttctactaggtctcgtgaatgtccacgcctatattgtagcttttgtcttctgtatgnnnnnnnnnnnnnnnnnnncaattatttggattctctttatagttttatcaaaaactgtttatgactacattctacgcatcaccatcttttttctacagttgtatttttttctaactatgccatatggaccacccattccactcttgcacacacttaatgtatcgatttttgatcttatgagatcatctttactatcatcttgcgtttgcactacatcaattgtacctacagcaccatcatatacatatgtaatgtattcatctttatttttattaagattactttttatactatgaagctcatattgatgattttcttcattacctatctaccttgtttacttatcctctgatactctaccctctaccacgcctaattatcaattattgcctgtggttatgctcaccatcgcttatatgctgaaatgtattcatcattgtctgcttcattactatcattaccta

SEQ ID NO: 19794 - DNA, 828 bp, Diabrotica virgifera
ccgcaatatgaagacgataatgatattatgtgcctttgtaatttttgtgattgcacaaatccaatgccaagaagatggttgtggtccacatgaacgaagagtagaatgcaagtcttgttgtaaagtaccaacctgccaacagaaagtccctcccaaatgtaaccgcatttgccttcaagtatgctttccaggatgtgaatgtttaccaggatatatcagacttcgtgaaaatgggccgtgtgtgaaaacatgttaaaaaagttttctaggtagtcaataacaacaaatgtagttgaaccaaaatgagtattagtttttttatgttagacaaagaaaaaacctctcttaatactacttatttctccctcagactttccccgttacagataacaattgccagattaatgtcaacaatttccatatacagtccgtctagaaagtatccgaaaaaaagaaagcagaattataattgtatggtatttatttatatcacttgcaatataaaatttcaacaaataattcatctcatttacttatacaacctccatttaaatctaaacacttaactaaacgtccaggtacacccgaaactaggtcaaggccataattttcagtaatggtgttccaggcctgtaaaactgaccgaatcaaaccttctttatctcgtggcgctgctcgttacacttcaatcttaatcagtccccatcggttttcaatggggctaagatctggagatgttgctggccacggagttgttgccaattcgtgttcttgcatacacgcttgagtataagcagaagtatggcatcttgtattatctttgctgaa

SEQ ID NO: 19795 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggggtgagccaggttggttnnnnnnnnnnnnnnnnnnnnnnnnnnnnnnnngaaagg

SEQ ID NO: 19796 - DNA, 913 bp, Diabrotica virgifera
  misc_feature (746)..(746): n is a, c, g, or t
  misc_feature (777)..(777): n is a, c, g, or t
  misc_feature (835)..(836): n is a, c, g, or t
  misc_feature (896)..(896): n is a, c, g, or t
cggagacatcccaaaggcaatttacgttgtttttaaatcattttgtacaatcccagagcagaacagagtacgtggatgttaatttaatattccacagtattccaatattccataatattattatagttagttaaaaagtagtgtgtagtgcaaagataatatcgtcaaagaaaataatgcctagtaattcgaaaaaggagattcctcctcttacagaagatcaacaacacgctataaaaagtttaagaaaaagaatagaagatgagctcaaccatattaagaatataaataccaaggatacctacctgcttaggtttctgtattgtactgattttaacacagaactaggttttaaaaagataaaagactattacgaaaacatactagcttatccaaaatggtactccacagaccctcctattaaaataaagccacttatagacaaaaacattagtgtaatggtccctgcttctgttgataaggatgatagacaaatatatctttttaaagtaggaaatgtcgatattcaaaatatatcgatacaagaaatctcattcctagatgacatttggtttgaatatttattggagaatgagcctcatttatcaggaaaaggaatttgtataatagttgattttgagtacgtaacctggaagtttgccaagtggttcaactaccgaaacgtaaaaataggatttaaaaaattggcattagtaccatttaaagaaatcaaaattcactttgtnaataattcaaaatcaatgaaatattttttanaactaattgtatcctgcgtgcctgaggacattaagaaacaggtgcattttcacttttnncgatcagaaacattagcaaaacatatcgataaagattttcttcttcccgagcatggtggnatacacaaactaaacta

SEQ ID NO: 19797 - DNA, 238 bp, Diabrotica virgifera
  misc_feature (78)..(100): n is a, c, g, or t
  misc_feature (108)..(130): n is a, c, g, or t
  misc_feature (159)..(187): n is a, c, g, or t
  misc_feature (198)..(237): n is a, c, g, or t
taacagcgtaattttattgggagagtcaaatcgataataaagattgcgacctcgatgttggataaagttataattggnnnnnnnnnnnnnnnnnnnnnnntgttcgannnnnnnnnnnnnnnnnnnnnnnaagttaaacggtgtgagcccaggtggttnnnnnnnnnnnnnnnnnnnnnnnnnnnnngaccgaaaggnnnnnnnnnnnnnnnnnnnnnnnnnnnnnnnnnnnnnnnnc

SEQ ID NO: 19798 - DNA, 240 bp, Diabrotica virgifera
  misc_feature (3)..(133): n is a, c, g, or t
  misc_feature (135)..(219): n is a, c, g, or t
agnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnncagaagaccctattaagtttt

SEQ ID NO: 19799 - DNA, 500 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(301): n is a, c, g, or t
  misc_feature (308)..(345): n is a, c, g, or t
  misc_feature (365)..(378): n is a, c, g, or t
  misc_feature (381)..(403): n is a, c, g, or t
  misc_feature (411)..(433): n is a, c, g, or t
  misc_feature (463)..(494): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 19800 - DNA, 950 bp, Diabrotica virgifera
  misc_feature (347)..(365): n is a, c, g, or t
  misc_feature (495)..(515): n is a, c, g, or t
  misc_feature (547)..(566): n is a, c, g, or t
  misc_feature (749)..(774): n is a, c, g, or t
  misc_feature (908)..(909): n is a, c, g, or t
  misc_feature (921)..(921): n is a, c, g, or t
agttttgataatatctacaagaaaaattaatagaagtaaaattgtttgcagtcatacagtgtgttgcatttaagatgaagacacttgtatatttcggttatcaaaataaatacagatttgaaattttgcacagtcatacagattgatggttcacgttttttaagatggtcaactgaaatttaaattttaaacccggcctactgcgaatccataaattcctacttggataacgacctttgaagtggaagtcgaaacgtcaataaaatcatttttcaagttaaattgtggcttatttcccaattagaatagtaaattacataaatgccacaaagaaatggcttcagaannnnnnnnnnnnnnnnnnnttctaaggtattgcagttaggagtcgagtagctatatcgataattctaaaaacatttagctaggaataatttcttcaattttcaagctcaaaacaatgccttgttgaaaaagatacatgtttacattgcnnnnnnnnnnnnnnnnnnnnngatcatcataataagacttaaaatgtctcagnnnnnnnnnnnnnnnnnnnngttgtttactattatcttcttaaaataaatgtaattaccctaatctatgttacaatgtatttaaggcggtcaaaaattatcaaaatgatgtttggtttgcatctttttgttgcaaaagttttgaatccaaaatagatcaggaaatctagtgtattaatgggcagacatagtttcttaatttgnnnnnnnnnnnnnnnnnnnnnnnnnncacaaaatatctgattttggtataaaaaacttttgttcttgttgtgcaccaagtatcattttcataactatgtaattagacaatacatttgtattataaagctttgctgttttataagtaatatctgaaattcnnataattgatttngattattttgcgtagtccttactttacta

SEQ ID NO: 19801 - DNA, 810 bp, Diabrotica virgifera
  misc_feature (500)..(517): n is a, c, g, or t
  misc_feature (589)..(609): n is a, c, g, or t
  misc_feature (652)..(671): n is a, c, g, or t
cgttacacggatgaccaacgtggggtaaaaaatgaccccaggtcaaaaatgacctggaatgaatgttttcagcttttaaatcttcatctaacaatacatcctcgttttctgatactatttcatctttatgttgttctgaagctattttcttgtgcaatgcttgtttcccattataaatagttaaaaaatatttcatctttatatcatcataaaaatcgctagcagtaacaatttcctgtaactcagcctcagtaagatatttgcgggccatatcttatatgtacacaaaatactaagatactataataatatacgccaggaaataataataatgactaactgtagcagacaggaatgtcatgattcgtgcataacaggcaccacagtctaaaaatagatgttgataacgcgcagtgtaaaactacttggaattccacataatagacggtattttactaaacatcaacttcagaatatattttttattcgtaaaatatagnnnnnnnnnnnnnnnnnnaaaatatgaggatatttagaatgatattaaagtcaaataaaaaaataatgagttaaaaattgaaaatacttnnnnnnnnnnnnnnnnnnnnnatacgctggtgtccaaatttacccccttggtcatccgaaggtnnnnnnnnnnnnnnnnnnnnataaatattactcaaccttacaccctccgttactcgcacacggtgtatgagaccgggtctctaataacttcctataactgattgtagtggatattttgaattgatactgcatatacctcttcagtcattagtcaactct

SEQ ID NO: 19802 - DNA, 521 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(497): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttattcgtttttaatatatcta

SEQ ID NO: 19803 - DNA, 904 bp, Diabrotica virgifera
  misc_feature (286)..(315): n is a, c, g, or t
  misc_feature (784)..(784): n is a, c, g, or t
  misc_feature (873)..(873): n is a, c, g, or t
ttcaattgtaacattttctccttgtggaaagtacattttgtctgcttcacttgagggagattttgtcatctggaatgtagctactggtgaagtattaaactttagtaaacatgaaaaatctatagctatatgtggtttaacatggaatcctttaggaaatggtcaagtagtatatacagatgttgaaggtcagttgggcgttatggagtgctcagtaaaaagtagtccgactaatctagaagatgacgcttttaatgatgatgtgaactttgataatgttccattnnnnnnnnnnnnnnnnnnnnnnnnnnnnnntgttttctctgttagtaaattgaagaagcagtatatgggagatgatgaacaagaattaaaatctattgcgggttcttctcgtgctgcaagtccgagacctcgcactccagaaattgctctccaacctccatttatgccttcttctacatcagagcatttagatcctagatatatgtgctggaatgatgttggtataattaagtgttatggaaacaactcggatgaatcagctataaaatcgattgaagtagattttcatgattctagttttcataatagtatgatgatgcaaaactatcaagaatacactttcggatccgttagcaggagtgctctcgtagttgctaattctagtcaaattcatgtagttccattaaatgccagctctaaagagtggatgttaaaaatggaagatgatgaggaaatagttcttgttgctgcttctgaaaccttgtttgcattgcaatgnctaactacatagtaaggatagcatccgcttttggtactcaacggggtgttgtttcaatacctggtccagtagtatgtatgacagcattncaggatttacttatggtagcttttcatacat

SEQ ID NO: 19804 - DNA, 218 bp, Diabrotica virgifera; identical to SEQ ID NO: 7300
  misc_feature (6)..(28): n is a, c, g, or t

SEQ ID NO: 19805 - DNA, 938 bp, Diabrotica virgifera
  misc_feature (336)..(349): n is a, c, g, or t
  misc_feature (352)..(365): n is a, c, g, or t
  misc_feature (868)..(868): n is a, c, g, or t
  misc_feature (872)..(872): n is a, c, g, or t
gttgttctgcttacgttaaaatggttcgctacggcagatagtcaccaaccatcttctaatttcgttacaattcttgattttagttctttgccagcatgtagagccatattttgaggttgaacagaataagttatctgacaaattttaagatttggcagtgacattgacagtatgtaaataataagtatttatccttcaaaatacactgctcaattttctataaaataagctttaagagtcgtatcagttttttttggaaccaactgtacatttcatacttattgtcatttaagaagaataattatatattgcttcacaataatgatatgatatgcnnnnnnnnnnnnnnggnnnnnnnnnnnnnntgtattttgcttgcagtactgcattttaataactaattttatttactacatacaattgtttacgttttaataacataacctaaatcttattttttcttcttattattttttttggactatggccttgacaattatccagtaaccaggaccatataattggccaatataatgaaaagtgcgaatcgaaagtgcagagcgaagaaaccaggtgtcgcttttccgaacttgcaccgtcccaatagcacattatagcaatcgccatgaaaccgcttttcggcatgaaaataatgataagcaattaagattaagcatgaattgtaatttcgattaccaaatgtcgaattccaattccaactccatgccgaaaactttacattttacatgacaagtgtgtgagttttttcaaaaatcgtggaagatatggggaatgagctaaggctgtgggaatcatgttgtaattattcccttaagtcttttgctcactctgctttgaataactctgntcanaacattgcctattcgtgatgataactgctggtcttgaaaacgaaaatcttaatttgtatgcaaaaa

SEQ ID NO: 19806 - DNA, 911 bp, Diabrotica virgifera
  misc_feature (880)..(904): n is a, c, g, or t
aaagaagatgcagctgctgctaaaaagtttgtagaagaaactatagcaagagttaaatattgtccggatcccctaaaagctttagacaatgctgaccttgtcgtggaagccatagttgaaaacattgatatcaaacacaaactcttcaagagcttagatgaagctgctcctgcaaatacaatatttgcttccaacaccagctcattatctatatcggaaatagcttcggtcacaaagaggaaggataaatttgggggactgcatttctttaatccagtggcagtgatgaagctgttggaagtaattaggattccagaaactagcgaagagacctacaaagccatgatggaatggggtaaatcagtggggaaggtctgtattacttgcaaagacacccctggatttgtggttaacaggcttttggtgccttatttagctgaatctatcaaactgtttgagagaggagatgcctcagctaatgatattgatacagctatgaaactaggtgctggatacccaatgggaccattggaattggctgattatactggcttagacaccacactcttcattattgatggatggcacaagaaattccctgaaaatcctctgttcgaaccaccagcaatattgaggaagtttgtagcagaaggaaaattgggccgtaagactggtcaaggcttttataactactcgaaatagtaggagactgatagataatgtaagttttacaccgggtgtgcttaaagtcggcagaaatgatattgtacatcataataattggtttattatatatctttttatattatatttgtgcataaactgcgtttttttatgcaaaaaaattgtatgagtatctttttaaaataaatagtatttnnnnnnnnnnnnnnnnnnnnnnnnngcgctct

SEQ ID NO: 19807 - DNA, 765 bp, Diabrotica virgifera
gttacttatcagatgccgctccattttttatcttattctttgacccgttatattatacggtaagcagtcagcctcgtttgaaaatattattatcctttgcttcaagaggttagttatgggatgccgtgctacatttatttccgcttgccactatggtattaaaaaatctcaatccacatagacacagccattcacactgtctctagcctgaagaatatcattctcatgatatgtctgtaggcttgtggttccttgccggcattatgtaatttttggtggagtagaatactgtaataatccttaaggatcccagtcatatccattccctatatatgatccagcctgcattccatctataagactgccactaagaaagatatcgtatacaaataagtgttctaaacaccaaattaatgaataagaaccatcgtattatattataggatctgaatatttgaatctgattgctaattttattcataattttacagacgatttagctatcggttcttcttatttagctgtaaatactgtaagaatattcactacgatcactattcttctccacgaagttcctcatgaaataggagatgttgccattttacttctatctgcctgttcatgaagaactggcatgcttctactattaactaccgcccttgctgccacagatgaactgctatgtcgcttcttgctcacaccagctccggtgcaatggtcatcacatgtattatggctttctctgccgaaggtttcatatgacat

SEQ ID NO: 19808 - DNA, 915 bp, Diabrotica virgifera
  misc_feature (3)..(16): n is a, c, g, or t
  misc_feature (755)..(755): n is a, c, g, or t
ttnnnnnnnnnnnnnngtagaacaagtgtagcacactatttttaaataatgaccactgcagctcgccctacatttgagcctgctagaggaggacaaggaagaaatgagaaagatcttagtgctatttctcgacaatattcaagtagagatttaccaggacacacgaaattaaaatatagggaacatggacaaggaactgttgatgaaaacagaactagagatttcagaaaagaacttgatgaccgtgaaaaagacaagagatctacaggcaggggtggtgatcacgccaaacgattaaaaattgaccaggttccagctgctagtttggatgcagatgatcctctagaagaagatgactcagattcagatgatgacaatgacgataccgaagctctcctggcagaacttaacaaaatcaaacaagaaagagctcacgaaatggcaaagaaagaagtggaaaagagacatgaggaagagaggataagaatggagaatatcttaagtggaaatcctttattggtgcattattcatcaggttcaaataaaacggaccataaggtgaagagaagatgggacgatgatgttgtgtttaaaaactgtgctaaatctgaaccacaaaaagaagccaatgtctttattaatgattctttaaggtccgagtttcataaaaagttcatggaaaagtatgtcaaataatttttgtacatctagttttagtactatatctgtaaaataaatcattaacatcaacattntttgtacagctggttcctaaaaaaactgatacgactcttagtaagatttgattattttgagcagtgtatttgattggtctggcattatattatatttattatgacagacaaataataaaataaacaacaaacaacaaacaactgattacatatttttaat

SEQ ID NO: 19809 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19810 - DNA, 57 bp, Diabrotica virgifera
ggtctatgtagtatgtatgtagattctttaaatgttaaatatagagtaattttaact

SEQ ID NO: 19811 - DNA, 151 bp, Diabrotica virgifera
  misc_feature (3)..(70): n is a, c, g, or t
  misc_feature (77)..(144): n is a, c, g, or t
agnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnnnnnnnnnnnnnatttttt

SEQ ID NO: 19812 - DNA, 891 bp, Diabrotica virgifera
  misc_feature (301)..(319): n is a, c, g, or t
  misc_feature (784)..(784): n is a, c, g, or t
acaatacgttggaaaaacaggaaacaactgttgaaaatatgatttttgcaaaacaggatgaccaaggtggttggttgttgagatgggatgtacagagaaaaagtgatgctgactttatagcactctgctatgaaggtaagatgacgaattctgtttaaatacccattctctgtgtaagtaaaatctatagtttttatttactttttttgcaataacacattcgcccgataatgcgaacatcttttcattattatggtctgaaaaaaattttggacatttgaatgcattttctgtcagaatnnnnnnnnnnnnnnnnnnnccaacacaccaccaaaatgtagtattaccccacaccagcttgcatttttccgtataggtcaggatccctactgtaaggactgcaatacgccaatgttacaatgtattagaaagttttaataccaatatttacctaaaataagaacacacataacataataagaaggtgtgtagtacccggcttaagtcccctatacacacatttcatataaattaatacatttttgggtaactgttagttgtttttaatacgtttcagctacataatctttaaacatggcagacgagtgtcatttttgaacttaattttaaatagaatcatatgatatggcaaatccaagtcgagtcttttaaaacgacatccattccaaatccatactcttatctgtaagacattcaaaattaagacattcaattagacaaaagaagtagaggaagaccacctactcgttggactgacgatctncagaaaatgtgaagaaattggatgcaaagtgctcaaaatagatcacaatggacaaaaatgagggaaggccatgtccagcagtggacgcaaagggctggagggaggag

SEQ ID NO: 19813 - DNA, 100 bp, Diabrotica virgifera
  misc_feature (10)..(95): n is a, c, g, or t
gttaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnattta

SEQ ID NO: 19814 - DNA, 915 bp, Diabrotica virgifera
  misc_feature (43)..(73): n is a, c, g, or t
  misc_feature (86)..(103): n is a, c, g, or t
  misc_feature (108)..(125): n is a, c, g, or t
  misc_feature (794)..(812): n is a, c, g, or t
  misc_feature (838)..(856): n is a, c, g, or t
tatacttctaaatatgatttcaatgaaataaatatactttcgnnnnnnnnnnnnnnnnnnnnnnnnnnnnnnnttactactttccnnnnnnnnnnnnnnnnnnaatannnnnnnnnnnnnnnnnnattagaaaacacaaggatttgaaccggagacctcttgatctccagcccaacgctctaccactgagctatacccttttgtttatacgggctacaagatttgtcagacatagtgacgtgacaaacatacgaagtgaattataaaatactttaattattacttattatcttattcccgaggtagacaagtccaaatacacaaaaattataataatagttatttatgatatagatgttaaaagcacaattttaaggcacgtatgtgaaagattcgcttcgctcattctgcattcacatgagtgccttaaaagtgtattttttaacacctatatcatacaatattttttctacaaacgtcttatatatcaacaattataatttattcattctcaattacagcacaatacctacaaaaacttttacttgaacttgactgacattccttttttatatttttcttgacattacatcaaaactgcctatactgtcaaaacgtaaatcataacaactatagaataacatctacttttgttgtttgtttgggtttatatgactgcggacactaaatccattcgcctaaacatctacttttatttttgtatattctaacaaattttaatagtttttttttctacaaacgtgttaaaaatgcaataatacagtttaaattannnnnnnnnnnnnnnnnnnaaccacctttttcaaattgcgcaagnnnnnnnnnnnnnnnnnnnggttataaatgggaatataatattttgacgtttcacaatttgacaattcagttttaact

SEQ ID NO: 19815 - DNA, 607 bp, Diabrotica virgifera
  misc_feature (2)..(525): n is a, c, g, or t
  misc_feature (528)..(586): n is a, c, g, or t
  misc_feature (588)..(601): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacnnnnnnnnnnnnnnnnnnnnnnnnnnnnnnnnnnnnnnnnnnnnnnnnnnnnnnnnnnncnnnnnnnnnnnnnnttgcga

SEQ ID NO: 19816 - DNA, 71 bp, Diabrotica virgifera
  misc_feature (6)..(62): n is a, c, g, or t
aaagcnnnnnnnnnnnnnnnnnnnnnnnnnnnnnnnnnnnnnnnnnnnnnnnnnnnnnnnnngttttttag

SEQ ID NO: 19817 - DNA, 845 bp, Diabrotica virgifera
  misc_feature (120)..(134): n is a, c, g, or t
caaactctttacaggttgagtatagcagtttaacagtatcttcaacaaggtctcgagttacatatgtttcgtgttaaagtgcagtgtaagtgaagttacaactttgcggtgcatcgcctnnnnnnnnnnnnnnntgtagccagctcctggcgagagacatccttaggtaacccggtgagcctgaactctttgcccaacggtttgaatcctttacctcagactagtactttaactcctttacccaccaacattaatcctattaatcttgaaacatccgatccttcgctgatcaatcgacaaacgccgtcacaaaactcacaaaatagtaataacagtgtagataagaaccagaacattgagtgtgttgtgtgtggggacaaaagttctggtaaacactacggacaattcacatgcgaaggatgcaaatcattttttaaaaggagtgttagaagaaatttaacgtactcatgtcgagggagccgaaattgtccgatagatcaacatcatagaaaccagtgccaatattgtcgtttaaaaaaatgtatgaaaatgggcatgcggagagaagctgtgcagcgtggcagagtaccaccgtcgcagccttcgcttccaggtttaccaaatcagttccttaactcaacagactcgatgaatacatctctaagcaaccacacgtacctcagtagttacatatcactattattaagagcagagccgtaccctacgagtcgatatggtcaatgtctgcaaagtaataacattatgggcattgacaatatatgcgagttagcagcgcggctgctattctcagcagtagaatgggcaaggaatataccgttctttcc

SEQ ID NO: 19818 - DNA, 222 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattaccctgttatccctaaggtaatttattcttataatc

SEQ ID NO: 19819 - DNA, 581 bp, Diabrotica virgifera
atcatgttgaatcaactacatgttatatactcccagttgatattgcagaactcgctagaaaatcatgaagaatcacacgtctagagcaaagaagatatgataaatattactttttggaacgttaaggaactagatgttaggttaatccttttgtatgagattctcatgatattggtattgtatcgaaatatgtgtaattagaaattttactacctatctcagctattctcttgtagcgtatagaggcacagaaatttaataatgttaaaataaactcattcttcaaacctaaagatgattgcttatcccatataaaaaaatgctatgatttactattagctattattgtacgtattgtctatgctgtatgtaaatattcccggagttataattttatgtagatatagtcgcgattgtgacactattatctttatactgagaatataaggaaaggacatgatcataattaaaatgatactttttctatttattcgcttgtcacttataatcttgacatatttgtgttaaatatataattctcgtactgcgcactgatttacaatagactgttctatacctta

SEQ ID NO: 19820 - DNA, 184 bp, Diabrotica virgifera
  misc_feature (2)..(49): n is a, c, g, or t
  misc_feature (60)..(78): n is a, c, g, or t
  misc_feature (89)..(107): n is a, c, g, or t
  misc_feature (116)..(159): n is a, c, g, or t
  misc_feature (161)..(175): n is a, c, g, or t
cnnnnnnnnnnnnnnnnnnnnnnnnnnnnnnnnnnnnnnnnnnnnnnnncaaattattcnnnnnnnnnnnnnnnnnnncaatttactcnnnnnnnnnnnnnnnnnnnctcgcggtnnnnnnnnnnnnnnnnnnnnnnnnnnnnnnnnnnnnnnnnnnnncnnnnnnnnnnnnnnncattttttt

SEQ ID NO: 19821 - DNA, 911 bp, Diabrotica virgifera
  misc_feature (370)..(388): n is a, c, g, or t
cgactattaaaacagaaatgttaggtgacaagaatagaaataattcgaatatctgtttaactgtggaactgtgtgttgtttgtggagacagggcatcagggaggcactatggggctatttcctgtgaaggttgtaagggattcttcaagaggtcaattcgtaaacaattaggatatcaatgcagaggtaaccagaattgtgaggttaccaaacatcataggaataggtgtcaatattgcagactacagaaatgccttgcttgtggaatgagaagtgattctgtgcaacatgaaagaaaacctgtcattgataagaaagaattccctagtaataatgatattaagtttaaccaatctactgtaaatgttgnnnnnnnnnnnnnnnnnnnaaaagacttaaactcagagtatgggcttctacctccattttgtcccagtgatttgggccttcagtttttaaatcaaggaatagcaaacagcagtgctacacctgaatcctttcacctatcacctagtcatgcaagtatggaagatgatgtctccatggatagtgcccatactggaactgaacttaatgatgctctaactactgctagagacaagcagcttatttcgaaggctttagacacaatggctagagtgcaatgtttgaatggaactaatataaatgctttgaccaatgaagaaaaatgttttgattatgatggaccgatccttcaggaacaaaatatggcttttaatttattgataccaggacctgtacctccgtacttaaatattcattatatttgcgaaagtggatctcggctgttatttttgtcaattcactgggcccaaaacatacctgcctttcagtattttaagttcagagacgcaaattgctctcttaaaaaattgctgggccgaactctt

SEQ ID NO: 19822 - DNA, 936 bp, Diabrotica virgifera
  misc_feature (614)..(632): n is a, c, g, or t
  misc_feature (649)..(664): n is a, c, g, or t
  misc_feature (666)..(678): n is a, c, g, or t
  misc_feature (758)..(777): n is a, c, g, or t
  misc_feature (797)..(797): n is a, c, g, or t
  misc_feature (849)..(849): n is a, c, g, or t
  misc_feature (915)..(915): n is a, c, g, or t
aaataagtatgccaatagcgtcgggaaggttatgaatgctcccaaggagtattatcctgtaggatatgataagaattttgatgacaactttgcctccagagtagagttaccagaaacttcgttttactgtggtgaccagaaacattttccagggctctacgctgatgaagacctgggatgtatggtgttccatgtttgtgctctaaccgatgacgggttaatcatgaagagttttctatgtccagagtcaactttgtttgaccaaacaatcctcaagtgtaattggtggttttatgtggattgcaagaattccaagaaactgtatgattccaatattcccatatcaaaaagctatcagttgatgaaagcactaacattcttttcagcttataagaacgataacaaaaacaaaaccaatgataaagactgataatttgtagattttagatttttaataatttgtacaaggagttatattatagtccaggaaacgaaggttttcacctcgcaattttttcggaatagatttgcttgaaaatgtgagactaagtagtggttagtccaaggattaaaatctacatgatgccgaaaggcgcttttactatgcgggtggnnnnnnnnnnnnnnnnnnngaccgtaaaaattgacnnnnnnnnnnnnnnnngnnnnnnnnnnnnnatacacttttctgatgaaataatagtattcgaattattcgctattatcaaaaatgtaccttggtacaaaacaaaatggtnnnnnnnnnnnnnnnnnnnnggggtagttttacccattanaagttaatttttaaagtgttgaaatagtcaataattatagttagaatataangacatcattatttaattaatctgaacaaatttcactctttttaagcttttttatagattttggtantaagggggtagttttcaccct

SEQ ID NO: 19823 - DNA, 904 bp, Diabrotica virgifera
  misc_feature (790)..(790): n is a, c, g, or t
gttttcgcagtgtttactattattgttctattagcactacctttcaaggctattttagcctgcgaaggcatcaaaaatgttttaatagaagtgaaagaacgggagactggagaaagaagtaacatgacattcagtggttgcctcgagagaaagaattttggcggcaaaacgattaccgaaattcatataagaaaccaaaatattccaaatataggaaaggattatattagacatttaagattggatattttagaactgaacaactgcaaaattaaaactattgctcggggtgcactaagaaatttgctaagaatccgagttgtcgaagttactcataatttgataactgaggtcactggaggaatctacgacgtattcaacacaatcaaaatattacgtttaaataacaacaaaattagttcaatgacagatgaagccctatccaatatgacaatgactgaagttaattttagtcacaacgagtttagagaatggaagaaagtctggtttgcttattcaccaaatatagaaattttcgatttttcatttaataaaattgaatccattcctcaaagagcgtttgatgggatgcctgtattgaaggaagttgatttttcatataacaggatttcatctataggtaaagaagcatttagggcgctcaaatcattaaaagttttaaatttaaagagtaacctattatcaagccttaatacgaacattttttcaagtaaaatatcaataaacactctaaacatagcatcaaataacttttttaaactggatcttncagaacacagagaacttaccttagagcagataggcatagatcataacccatggtcttgtccttgtatggacatttacatgcatggttaaatgcaaaccaagttactctcttaat

SEQ ID NO: 19824 - DNA, 168 bp, Diabrotica virgifera
  misc_feature (8)..(8): n is a, c, g, or t
  misc_feature (10)..(53): n is a, c, g, or t
  misc_feature (55)..(80): n is a, c, g, or t
  misc_feature (85)..(161): n is a, c, g, or t
attttttntnnnnnnnnnnnnnnnnnnnnnnnnnnnnnnnnnnnnnnnnnnnngnnnnnnnnnnnnnnnnnnnnnnnnnntatannnnnnnnnnnnnnnnnnnnnnnnnnnnnnnnnnnnnnnnnnnnnnnnnnnnnnnnnnnnnnnnnnnnnnnnnnnnncattttt

SEQ ID NO: 19825 - DNA, 765 bp, Diabrotica virgifera
  misc_feature (15)..(42): n is a, c, g, or t
  misc_feature (77)..(112): n is a, c, g, or t
  misc_feature (160)..(174): n is a, c, g, or t
  misc_feature (176)..(196): n is a, c, g, or t
  misc_feature (341)..(362): n is a, c, g, or t
  misc_feature (519)..(544): n is a, c, g, or t
  misc_feature (546)..(561): n is a, c, g, or t
  misc_feature (606)..(623): n is a, c, g, or t
  misc_feature (698)..(751): n is a, c, g, or t
cgcgacgcgcgcccnnnnnnnnnnnnnnnnnnnnnnnnnnnngacaaaagtcaagaaaaatcttatttactgatacnnnnnnnnnnnnnnnnnnnnnnnnnnnnnnnnnnnnaaagaaaactttatttcctgtaccttgtgtcccaggcattattccccnnnnnnnnnnnnnnncnnnnnnnnnnnnnnnnnnnnnctcaaagatcaaaatcttcattgtaaaataaatattctaaacactttttcttgtaatgacatgttctccgattttaactatatctaattttctaagaaataactgaaatttatttactaacaatatctttataatcaaatatttnnnnnnnnnnnnnnnnnnnnnnctctagggatgagcttacaaacaacactttattaacatgtaactcccaaataaaacttaggatgaaaaattttcatattctatcatacgttcttacttatctttatatcttatcactttccttctctacaaattttttattaacatatcaatttccnnnnnnnnnnnnnnnnnnnnnnnnnncnnnnnnnnnnnnnnnnctgtatattcagtagcaatatctaggattcacaaaggacttcgcnnnnnnnnnnnnnnnnnncttattaggaacatgtcttgttgcactaaatatcacctctcgcctgcccaccgattaagtctgatggccgcggannnnnnnnnnnnnnnnnnnnnnnnnnnnnnnnnnnnnnnnnnnnnnnnnnnnnntgaagggatggatg

SEQ ID NO: 19826 - DNA, 961 bp, Diabrotica virgifera
  misc_feature (893)..(893): n is a, c, g, or t
  misc_feature (918)..(918): n is a, c, g, or t
  misc_feature (923)..(923): n is a, c, g, or t
attttacatttgttagtttatcactagcttatgggagtaatgtgtaatgtttatgttaaataaatatcttgttacttagtaaagtcgacttcattgtctttacaaagagacgtttattgaatcactctcctacagtccttcttcatcagaacaattactctgcataagttcgaagtttccagaaaatggagacatcagaaatttcaaaatggtatcggaaccagcacgtctttataactggagccactggtttcatgggtaaaattttgatagagaagttattaagatcatgtccagatgttgctgctatatatgtaattatcagaagtaagaaaggaaagaatgcaacacaaagattggaagagcttttaaattcagtggttttcgacaatatcagacaattaccagacgccaaatcaatatttgaaaaagtcaaatgcatcaccggcgatgtaacggaagaaaactgcggaatctctcctaaagatcaagaattattggaaaaatcagtaaccagtgtatttcatatggcagctaacgtaaaatttgacttaacagttaaaacggcggtacttttgaacaccggaggtacctttaatgttctggaatgggcttgcaagttacaaaatttaaaaatcttcgtacacgtttcaacgtcttattgtcactgtgatgttacagagttagaagaaaagttatatgatgctcctcaggatcctagaaaaatgcttgacatggtaaaatggatgagtgatgatttattggagacactaactcccaaacttttaagtaaatatccaaacagctatgcatatacaaaaggtctaactgaacaacttgtttctgaatatagtaccaaatttgccatttgtatcactagaccttccatagtnattgctgcatacaaagaacctattncctgnatggattgacaactttgaatggtccctactggtatcct

SEQ ID NO: 19827 - DNA, 750 bp, Diabrotica virgifera
cccacgcgtccgaactacgatacagtgcgaagaatatacgttctatttggctattttgaaatataaagtaactccaactacttgtactttggtactaaataatataattcatatgtgtgacaatgagaatgtaaatcttaaaaatacattcaatgaaattattaacattattaaaagtgttgaaacaccaattgttcgaattaattttaaagcgtttcttcttaaacactaagtggatgcatttttatccagcactggttaggatttaaccctttcgttcacaaattaaatttctttaagcaaaaaatttgaaatttgcaacataacgataatgatttttttgcgaatttttgatattagttttacattttcaaaatgcacagtttggtcacgacaatatgtcatcatttgacgacatcaatggagtaagaatattagatatttttttaaatactgacaaaaaacaaaaactgaagtattttattcaataagtatgctatcttacaaaacaatttgtatctttacttatacccgtataatatttcaatcaacgcttatacagagataaacaactcgaaataattggcgctgtatacaccagtcataagtaactatagaaacctatattttaacaaattaaatatttggttcaaaagctcttagatggcaccgcaagtactcattggacggaatgggatgtccataatcggggacaacgtgttacaaggataaaaacacatggagctacat

SEQ ID NO: 19828 - DNA, 958 bp, Diabrotica virgifera
  misc_feature (348)..(368): n is a, c, g, or t
  misc_feature (738)..(758): n is a, c, g, or t
  misc_feature (771)..(793): n is a, c, g, or t
  misc_feature (898)..(898): n is a, c, g, or t
  misc_feature (900)..(900): n is a, c, g, or t
  misc_feature (933)..(955): n is a, c, g, or t
cccacgcgtccgcgttctttaacgctaaaatattgcaagactttaaattttacagaattgcttggattgatatgaaatttggcaaacacatcggcacaatattactttttttcttgttagcgttatgttagctatgcgtatgcctaatttcatgtcaatccaggcggttctttaaaatttacagcaaaaaccatgaaagaatgtactatagcttttccaattataactcagctttcatacttgcgattatctttcaaaatcccctctttaaaagtaattgtttcagctaaaaaaaaccttatcttcagcaaaattactttatttttattgatatacaatgtggtaacnnnnnnnnnnnnnnnnnnnnnctaaacagttgcgaattaatatgtttataagagatttaaacaaaatgaggctttatataccttaaaaacctggtaaacggaagttatagaacaactcaaaaggatcggggtaaatatttctatttaaatttttcgccgagatattgaaaattgtattgcgcgataaaaattgcatacatgtcttggtcaaaaattaacatagaaacatttaccaaagcttaaaatgttcgttttgagttgttctataacttagattagttagattttcaaattgtatctcttaattttgtttaaatctattataaatcggttaagttgcgaataattcgcaacttaatagtgacgtctttaatgcttaattgttatagcnnnnnnnnnnnnnnnnnnnnngaattaatttgcnnnnnnnnnnnnnnnnnnnnnnntacttttaaaagagggatttagaaagttaatcgcagctaagaaattttacttcaaaaagtctattctattttgcaatgtttttcacgaagtttgttataactcangntctaacaatcgaattaaaattagcaaacaccannnnnnnnnnnnnnnnnnnnnnncat

SEQ ID NO: 19829 - DNA, 738 bp, Diabrotica virgifera
  misc_feature (86)..(105): n is a, c, g, or t
  misc_feature (149)..(161): n is a, c, g, or t
  misc_feature (163)..(175): n is a, c, g, or t
  misc_feature (468)..(488): n is a, c, g, or t
  misc_feature (501)..(518): n is a, c, g, or t
accctctcattcatttttatatactcccctcttttttacatgaagtatcacatgaattttgtctaatgcatgttaattagtatccnnnnnnnnnnnnnnnnnnnncctgaaagaaaactttattttttgtacctcgcgcttcatggccnnnnnnnnnnnnngnnnnnnnnnnnnncttctcaaatgcaaaaaagctagaaacctagcattcttattgtaaactgaataccttaaatagtctttctgtaatgagatgatcttcagttttaaatatatctaagtttctaactaactaaatatagatttatttattatcattatatttatcactatatacctgtatattattaatattagatattcttcatgatgaacattgaaaatcaaattgtattaaaatattaatttcctacaatcaaccataagccattgaaaactatcccatataaatactatatgacattaccnnnnnnnnnnnnnnnnnnnnnctattttacaccnnnnnnnnnnnnnnnnnnctagttgacctctgcaaattaatgctatcgatgatcactagtagcatcaacaaattgtatatgcaataaaaatatatatgtctgatatagcaattcggcaacatcatccttcacctggctattaataacatgtctttgtggatcaactacaaagtctcgcctgcccgctgataaatatgaatagacgcgatatcctgaccttgctaatgtagcatcatct

SEQ ID NO: 19830 - DNA, 898 bp, Diabrotica virgifera
  misc_feature (23)..(41): n is a, c, g, or t
  misc_feature (72)..(100): n is a, c, g, or t
  misc_feature (592)..(610): n is a, c, g, or t
gacatttaatctgagtcggaggnnnnnnnnnnnnnnnnnnngaaattttgttttaaactaataatttctacnnnnnnnnnnnnnnnnnnnnnnnnnnnnngtcttcaagtgacgggttgccgccaaagtcgtacttgattccaagtccaataattacaaaaagaacaagaacaccatccgtttgtgaacgtatcgttaagaccaagaatatttatggggtaatcaaggaattttgccgtcagaaagggcatggttttatcactccagaagatggtagtgaggatatatttgtacatgtttcagatgttgaagatgagtacgtcccaataccaggagatcgtgttaagtatcaaatatgtcctatccctcctaagttcgagaagtttcaagcagtccacgtgaatatagtggatttgaagcccgaagtgcacaagaaatgggagaacttataaatgtccttgccagaaaatatataaagatcttcaattctcccttcttactgttattgaatgtatatttggttctattgattaatgttctgtatgtatatatgtaacactaattggatgtctataccttcccagactcgagnnnnnnnnnnnnnnnnnnnataatcttttttcacttctttgcataaggtaaaactgtagatttgcagagttgctgtgatcagtaaactgtttaaaacgcagtatagaccagggcatttagcacaaaataagtcgatttttaaatgcagtacttagagacttgcaactttttgcattgtgttcaggatcatgagaacaagaatagtagacttttttcctcacaacacatcattttgaacgcaatgcaaaagttgcaggtctctggatgccgtatttaaaatcgatttattcgagtgtttttagtcact

SEQ ID NO: 19831 - DNA, 907 bp, Diabrotica virgifera
  misc_feature (449)..(469): n is a, c, g, or t
  misc_feature (780)..(780): n is a, c, g, or t
  misc_feature (840)..(840): n is a, c, g, or t
cgatttagttaaggagcatatggtatcgataggatacccacaagaaattttacaatttgagtatgatccaacatttgcagtaagaggattgtggttcgactcattgtatggaaatcttttaaaagtagacgcatatggaaatattttagtatgtgtgcatggattcgaatttataaagcattcccgtgtttatgaactatatcccaataaatttttaacgctggacgaatctcgagtgtacgtactgaatacactatttaatttacctgagacttatttgttagcttgtttagtagactttttcaccaattgtaaggaatactccaaaaccgacacgggagtaaaatgtggagaacttctgatgtcgtacaaatctatttttcaggatgttagaaacgcagtagactatgtccatttacatggggacctcaaaaataggacaatcgaannnnnnnnnnnnnnnnnnnnnaaagatgaacgtcttccaatgtttttgagtaggctaagagagagtggagccaagactttcttattaacgaacagcgattatacgtataccgataaaattatgaactatcttttcgacttctcccatggacctaggcccgaagatcctcatcgaaactggaaaacctactttgacatagtcgtctgcgacgctcgcaaaccactcttcttcggcgaaggaactattctccgtcaagtggacacttccaccggaggtcttcgagtgggcgtccatacaggtcccctgctatccgaccatgtctattccggagngtcttgtgatgtcttcacgaaattcatcggggctaaaggaaaagacgtgctctatgttgnggatcacattttcggtgatattttgaagagtaagaagatcagaggctggcgaacctccttgatcgtg

SEQ ID NO: 19832 - DNA, 154 bp, Diabrotica virgifera
  misc_feature (8)..(8): n is a, c, g, or t
  misc_feature (10)..(32): n is a, c, g, or t
  misc_feature (40)..(93): n is a, c, g, or t
  misc_feature (95)..(152): n is a, c, g, or t
attttttntnnnnnnnnnnnnnnnnnnnnnnngtttatannnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnat

SEQ ID NO: 19833 - DNA, 289 bp, Diabrotica virgifera
  misc_feature (3)..(18): n is a, c, g, or t
  misc_feature (70)..(94): n is a, c, g, or t
  misc_feature (220)..(249): n is a, c, g, or t
ggnnnnnnnnnnnnnnnngcaattgatattattaatgcaattactcctcctaatttatatattttacccnnnnnnnnnnnnnnnnnnnnnnnnngaactcaattttatccaatcaataaaatattattttgaagattactatccattgtaattttattaacatgaattggagcacgaccagtcgaagacccatatattttaactggacaaattttaactnnnnnnnnnnnnnnnnnnnnnnnnnnnnnnccattaataagaaaatgatgagattcaattatttttaatt

SEQ ID NO: 19834 - DNA, 540 bp, Diabrotica virgifera
tttctcttctctggatcaaaggagacacatgttgtgctgctaatccaaaaaactattactatttaggagatacgcaggtaaattgggctaatgctgttaaagcatgccaagtcgttggaatgagattagttagtatccagagtgaagctaagaataacgaaatcgccgcatttttgcaatccacaggagtgaactacctaggattcaataacggtatctggacttcaggaactagacaacaggacaaagttcattggctttggctagctcaggaaccttttgtgtacaccaagtgggatactctttttggggaaccaaacaatggtactgggaacgaagaatgcttacaagtaattaataacggaacaactactgattggaatgatatcgcttgtaatcgcttgttttatcctttgtgcgagaaacaggtatgttgctctggttgcaactgtagatcttagtgctttgtttaagcaattttacagcaatataaattacaatttcttatttatgtaacaataatggtgtttatattataat

SEQ ID NO: 19835 - DNA, 844 bp, Diabrotica virgifera
  misc_feature (13)..(14): n is a, c, g, or t
  misc_feature (16)..(16): n is a, c, g, or t
  misc_feature (30)..(30): n is a, c, g, or t
  misc_feature (57)..(57): n is a, c, g, or t
  misc_feature (66)..(66): n is a, c, g, or t
  misc_feature (75)..(75): n is a, c, g, or t
  misc_feature (92)..(92): n is a, c, g, or t
  misc_feature (96)..(96): n is a, c, g, or t
  misc_feature (110)..(110): n is a, c, g, or t
  misc_feature (133)..(134): n is a, c, g, or t
  misc_feature (156)..(156): n is a, c, g, or t
  misc_feature (159)..(159): n is a, c, g, or t
  misc_feature (161)..(161): n is a, c, g, or t
  misc_feature (166)..(188): n is a, c, g, or t
  misc_feature (194)..(195): n is a, c, g, or t
  misc_feature (224)..(224): n is a, c, g, or t
  misc_feature (230)..(232): n is a, c, g, or t
  misc_feature (248)..(250): n is a, c, g, or t
  misc_feature (258)..(258): n is a, c, g, or t
  misc_feature (262)..(262): n is a, c, g, or t
  misc_feature (264)..(264): n is a, c, g, or t
  misc_feature (266)..(266): n is a, c, g, or t
  misc_feature (296)..(300): n is a, c, g, or t
  misc_feature (303)..(303): n is a, c, g, or t
  misc_feature (305)..(332): n is a, c, g, or t
  misc_feature (360)..(360): n is a, c, g, or t
  misc_feature (371)..(372): n is a, c, g, or t
  misc_feature (374)..(374): n is a, c, g, or t
  misc_feature (378)..(378): n is a, c, g, or t
  misc_feature (381)..(381): n is a, c, g, or t
  misc_feature (401)..(402): n is a, c, g, or t
  misc_feature (405)..(405): n is a, c, g, or t
  misc_feature (417)..(417): n is a, c, g, or t
  misc_feature (431)..(431): n is a, c, g, or t
  misc_feature (438)..(438): n is a, c, g, or t
  misc_feature (450)..(450): n is a, c, g, or t
  misc_feature (494)..(494): n is a, c, g, or t
  misc_feature (497)..(498): n is a, c, g, or t
  misc_feature (510)..(510): n is a, c, g, or t
  misc_feature (518)..(518): n is a, c, g, or t
  misc_feature (524)..(524): n is a, c, g, or t
  misc_feature (526)..(526): n is a, c, g, or t
  misc_feature (552)..(552): n is a, c, g, or t
  misc_feature (566)..(566): n is a, c, g, or t
  misc_feature (578)..(579): n is a, c, g, or t
  misc_feature (588)..(588): n is a, c, g, or t
  misc_feature (594)..(594): n is a, c, g, or t
  misc_feature (600)..(600): n is a, c, g, or t
  misc_feature (633)..(633): n is a, c, g, or t
  misc_feature (644)..(645): n is a, c, g, or t
  misc_feature (648)..(648): n is a, c, g, or t
  misc_feature (663)..(663): n is a, c, g, or t
  misc_feature (670)..(670): n is a, c, g, or t
  misc_feature (677)..(695): n is a, c, g, or t
  misc_feature (702)..(702): n is a, c, g, or t
  misc_feature (725)..(725): n is a, c, g, or t
  misc_feature (744)..(744): n is a, c, g, or t
  misc_feature (758)..(780): n is a, c, g, or t
  misc_feature (789)..(789): n is a, c, g, or t
  misc_feature (816)..(816): n is a, c, g, or t
gttacccagggtnngnaaagatattggaantttataatttacctttgaaatttgagnaggaatggnaggaagttnattaagaattttagtangagnagaattaggaaggnttggtcctttaattggaaatgannaaatttataatgttattgttanagntnatggnnnnnnnnnnnnnnnnnnnnnnnttatanntattataattggtggttttggaaattganttgtannnttaataattggtggtnnngatatagnattntntngaataaataatataagattttgattggttnnnnngtntnnnnnnnnnnnnnnnnnnnnnnnnnnnntatattggggggttggtaaaggatgaanagtttagaagnntntgtnatnaaatattgtttatggaggtnnatnagtagatttagntatttttagattanatttagntggtatttattnaattttaggtggaattaattttattagaagagtaattaatatangannaataggaataangtttgatngaatangngtatttgtttgaggtgtagtaattanagaaatagttgttntattatgtttannagttttagntggagntattanaatattattaagagatggaaatttaaatagatnattttttgatnnagntggtggaggggatgnaattgtntattaannnnnnnnnnnnnnnnnnngtgatgntgaagtatatattttaattttangaggatttggattaatttntgatattgttaggnnnnnnnnnnnnnnnnnnnnnnnttttggtantttaggaataatttatggtataatagnaattgggttattaggttttattgtttga

SEQ ID NO: 19836 - DNA, 661 bp, Diabrotica virgifera
cgaaaatatattttgttgtataacctcttttataaaagatttctagaacaccatctgtgtaccttcaagtggtgtgtaattgtacctgctctcaactgctgcagttttagtatggtttagtcgttgagctacgttgacgtaaagttttcttgtggtatcacgtacctcatgtcagtgtttacgtttctataattaaaagcagtaaagtgtattctttcgctattattatggcagcaaattcatccagttgtcctatcttcaagtagaaagcactattttactatgtttgagttaccaatactcaagttttttttggaattcaggttataaaggttttggtaagaacctccaccatttttttaataaatgcatgcgttcataattttcttgaaaaagtaaagtttagtttatttggagcagtattttattctacagcagtcaaaagaatcattccgcaattgatgtaaagaaacaaatacagtgacataagacaaattcttattgaaaacaaaggataataggcaacggtatgacatactatatgtctgagtctacctcctaaaacatccatgtcggtagttaggggttaaccgcatttgtttttttctgtaaaaatttaaaagtagttgtaaacaaaataaattccaataaaagctagtac

SEQ ID NO: 19837 - DNA, 850 bp, Diabrotica virgifera
  misc_feature (780)..(780): n is a, c, g, or t
gacagaagagactacagtatattatacagttttgtgataattgattatgttttcgtgatattatggaagttaagagtgttttactggtttttatttttataggtttaacaaattcaaaatttgaaagttcttcaaattctataagatctattgtcagacagcgacgccaaagcagcttcaactgtactctcccgacacaattagaaaatggaagggtgttagtatacggaaaagatattaaaccaggtgatcaggtagacatcgacgtattaataaaattggaatgccacaaaggttataaattatctcctaatactcctttcattatttgtgacggcaattgggaggaaatacatttagtgacgtgtaaaaaaacatgtccccctttttattcaacggcaactactacggttaaatgtagagataaagattacaatacagtcccttgtgataaagcaattgatggtacgtacttaacttatgagtgtgcttcttatcatgaaataccaccaggcggtagaaatatactctactgtaacaatggcctttgggactttcccaaacctgtgtgtcaaccaatttgtggaagaaaagtttatacggaaccttcacttatttggaatggcaacggagtcaaccattttgaccacccctgggttatagcggtattcaagaatttagggaaaaattacgaaaatatatgtggggggacgttagtgagcataagaactgtcataactgctgctcactgtgttacggatacctatggtcatgctttgngtagagagaactttcaaagtgttgcgggaaaaatgtacaatgcctttggagacgaacgagatacgcatgc

SEQ ID NO: 19838 - DNA, 763 bp, Diabrotica virgifera
  misc_feature (2)..(564): n is a, c, g, or t
  misc_feature (571)..(608): n is a, c, g, or t
  misc_feature (628)..(641): n is a, c, g, or t
  misc_feature (644)..(666): n is a, c, g, or t
  misc_feature (674)..(696): n is a, c, g, or t
  misc_feature (726)..(757): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 19839 - DNA, 542 bp, Diabrotica virgifera
  misc_feature (2)..(117): n is a, c, g, or t
  misc_feature (143)..(192): n is a, c, g, or t
  misc_feature (196)..(314): n is a, c, g, or t
  misc_feature (334)..(363): n is a, c, g, or t
  misc_feature (367)..(402): n is a, c, g, or t
  misc_feature (423)..(441): n is a, c, g, or t
  misc_feature (461)..(478): n is a, c, g, or t
  misc_feature (493)..(531): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttttttgggggttttttttagannnnnnnnnnnnnnnnnnnnnnnnnnnnnnnnnnnnnnnnnnnnnnnnnnccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaagcaaaccaaaannnnnnnnnnnnnnnnnnnnnnnnnnnnnngggnnnnnnnnnnnnnnnnnnnnnnnnnnnnnnnnnnnnttttaaactccgcggggggcnnnnnnnnnnnnnnnnnnncccccaggggttttgtgggnnnnnnnnnnnnnnnnnnataaaaaacccccannnnnnnnnnnnnnnnnnnnnnnnnnnnnnnnnnnnnnncgggggttttt

SEQ ID NO: 19840 - DNA, 903 bp, Diabrotica virgifera
  misc_feature (876)..(876): n is a, c, g, or t
gcaggtttagaaaaatcaataggccgttaaggtggcataatagtggtggggtggatatttttagaacattttgtaaatttattgtgtcgtgttttgttttaattaataatttcttgtttatcttcgtgtccaaaaaatacacatgaaacataaagcatgaaagtatttgagggattgtatgggaagattttagggattgtcctcatgacacacattttcgccaaggtagtaatgcgctagtctgtataaaagagctatagctcaacatgacgaacaccaacggaactgcgccagctacaaactctgcagctgataccagccatgcagcctcaacgtccagctcttccgctcaaggaggacactgcaaagggcatcgtaggcaggagtctatgtacacaatgactggtctctactcagaaaccatccccgaaacaacggaaattgctgagacgaagtgttcaacgaatttctatcatgacacagtcattaaatgccacagtagaaacccttcggctagttttgacagagataaagctgcacatacggctacttatactgaaacacctgtgatattaaagaatacaaaagaatgcggcattttccaatgccggccttcgtttatacaaaaatatgcaggaattaagtccttcgtattactattgtcatttcttgttaccttacaacaagcattaagttctggatacataaattctgtgataacaacaattgaaaaacggtttgagattccatcgagtctatccggcctggtggcatcatcgtacgagataggcaacgtcatcactgttatatttgtaaagtatttaggtagcagaaggcacatccccgtttggattggtgttggagctgtcatcatgngcataggatcacttatatttcatggtc

SEQ ID NO: 19841 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19842 - DNA, 604 bp, Diabrotica virgifera
  misc_feature (75)..(92): n is a, c, g, or t
  misc_feature (144)..(164): n is a, c, g, or t
  misc_feature (318)..(336): n is a, c, g, or t
  misc_feature (372)..(389): n is a, c, g, or t
  misc_feature (442)..(481): n is a, c, g, or t
cgaaaataataaaatatcacttagtttaaatttaaaatgatttattatagatgatagttagttatcaatgagagnnnnnnnnnnnnnnnnnnaatagaaaatattatttcttgcaccctgtgatccggcatatttaaaaacacnnnnnnnnnnnnnnnnnnnnngattattataggctagaaaatctcaccatctcctattggttaatgtatctctaaactaactacttcgtaaagaaatgaaatccgttttaaaagatatctaatattttactaaaaaaagtaaatttaattatgaacattatattaaacataaacnnnnnnnnnnnnnnnnnnnctaaacacttctaacgacgaatttaaatataatgtnnnnnnnnnnnnnnnnnnttaacctaagattatctattaataatcctactataatgaaatacgctattatnnnnnnnnnnnnnnnnnnnnnnnnnnnnnnnnnnnnnnnnttcatacaaatcccaatatttgattatttgaatatggattagactataatattagtattgaaaaattgcatataataatgacacttaataagtatattaaggtaattccgcctactttttttt

SEQ ID NO: 19843 - DNA, 687 bp, Diabrotica virgifera
  misc_feature (2)..(595): n is a, c, g, or t
  misc_feature (597)..(674): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnaaccctataaaga

SEQ ID NO: 19844 - DNA, 864 bp, Diabrotica virgifera
cttggaacatgagcagcacttcgtagagccaatgatctgttttattgatataaaatatgcttttgggacagtacaacatgtaaattccacgacttatatcggaattatgcagacaaatacaaatgactttataataagattagatatggatttctgcaataatttgtgggcaactagacaattattccctaatataccattacaatgtcaacgaaaagattcacctcaatcaaattctgcctacgactagtaaatcatatattatcattgacagaaaccgtttttttttgtttataattgggaatatgaacagatatttattttgcggtagtgtacacatctgcaatattttattattatgaacatatgaatttaataaccttctaatcgatatttacgtgaaaagttctcgaatgaaatgtgacgttcctattgccttatgtggaaaaaggtgctttttctttgtttatctctaaattgttacatttttgtagtattctaaacgttaaaggatgattattgttgcctgttggatattgaaacatttttaaaacctctggttttgatgctgttatatttggatacagaagtgcctaatagtgtatcaaaaagcggcagtacctgaaaaaatatataataagattccatttgaattgattgatgtataatttgtttaagtaaatttacaatttactccaattatggaccagtggagtaaatttacaatttactccaattatggagtaaattgtaaatttccaaatgtattttatgataaatgtacggtatttatattttgtcactttaaataatttgttgataagttgagaagggaatgtattactcgacttgtggatattcctc

SEQ ID NO: 19845 - DNA, 934 bp, Diabrotica virgifera
  misc_feature (824)..(824): n is a, c, g, or t
cggacgcgtgggcagtgatacagttacagcaaccaatataatattcgttggttacagtgataataatctagcattatttttgttcaaaaaatatctttcattgtttgtagtgttttgttttaacgtgtttttgactattttaatttagtgaatttttttgttcgatctggcagcaaaggaaggaatgctgagaactaccaaggactgcctggcacttagaatccgtattaactccttacaccaaacttggaagtggttgcatcaaactatcgcccttcacgactatctcactgcccttacatcagcttctaaaaacgtgtgttacatcaacttcttaacacattaaggtactttttaaaggcacaacatctacaaaattaatattcgtaaatactctcatactatatatacatatttcaaaatggcattattccaacgtacctacacaagagcaattgctttgatttcaagaaataacaaatcctactcaacatcgtcagaccaaaacattaaaaaatctgtgttcgtttcccaatctaaggacatttatacaaacttagcattagaagattggttgtatcgtaattttgattttaaaaatcaccacgtcttgatgttgtggcaaaatgatccttgtgtagttatcggcagacatcaaaatccttggcttgaagcaaatgtcaacgagttgccatatattggcgaacaaggagttcaacttgctagaagaaatagtggaggaggcactgtgtaccatgataacggaaatctaaatcttacattctttacacctagagatcagtataatagaaaatacaacctgnaaaattattagtagaagccttttcagaaattacacatgaaagtggatatttcccccagagagatttgacgataagaaatttgaaacagatatctggaactgctgcaaaat

SEQ ID NO: 19846 - DNA, 588 bp, Diabrotica virgifera
  misc_feature (305)..(327): n is a, c, g, or t
  misc_feature (509)..(527): n is a, c, g, or t
ttcaagaagtgggctgatgacgctatcctttggcttcaaacgaatagtttttaacattttattagcttctatacaaaacaccgtctatctactaaaatccacgttagaaaatatgcggcactggggaaaaaccccgtcagtcaatgcatttgtatggaaggaccccgtgagtcaaatgatattgtagtaatccgttaccggagttggtttagcctccagaattgaaaaaacttaaatggttgttttctcgaaatttactttttttgactgacgggttttttccctgtgcccttcatatgttatgnnnnnnnnnnnnnnnnnnnnnnntgtgtagtgagggaggaccgaaataaaaaggtgatggtttgaaaattacgatcctgttgcctgtatcttttccgtaaataccggtcaactttgactgactgtatctcaggaaccactcatcacaattaaacgttttcttttgaaagaagcgtcctgccgctttttttccaataccgttttcnnnnnnnnnnnnnnnnnnncccgaggtattctatttgtttataagccggaaaattgtttataattttgaaatattcgtga

SEQ ID NO: 19847 - DNA, 782 bp, Diabrotica virgifera
ggaactgtagttgaacaaggaacacatgatgaattaatgtcattaaaatgtgagtattttaagcttgtaacagcccaagttgcaagttccaatcagatcgaattatcaaatgatgaaacagaaacaaaaggcaataatgaagcatatgaagaatataacgacgatgatgatgacatatctgacgatgaaaaaaatgaaatagatgactttaaaaatggcaaaaaaatcactctttttagcatcatgaagttaaatgcaccagaatggccatatattttaattgctggagtaggatctatagtagttggttggggatggccaatatttgctgtgttctttggtagtgttcttggaacactggcaaaatacgatacagagtatatagaaacagaaactacaagatattgtatatttttcgtgattgcgggtgtcatatgtatgatctcagtatttcttcaaaattatctgttaggaatagcgggagagaaaatgacagaacggattcgaacccagatgtttacagcaataatatcccaagaaatgggtttctttgacaaaaaatctaacggtgttggggcattatgcgcaaaattagctggagattcatccagcattcaaggagctactggacaacgagtgggtgcaatactgcaatctctttcaacgttcggtatagcaatagctctgtcaatgtattacccaatggaaactaggtctgctaatggcatccctttacaccattaaatgttggttgcaatatttatagaaaaaacgtaacacta

SEQ ID NO: 19848 - DNA, 160 bp, Diabrotica virgifera
  misc_feature (2)..(159): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 19849 - DNA, 957 bp, Diabrotica virgifera
  misc_feature (826)..(827): n is a, c, g, or t
  misc_feature (849)..(849): n is a, c, g, or t
  misc_feature (869)..(869): n is a, c, g, or t
  misc_feature (915)..(915): n is a, c, g, or t
  misc_feature (931)..(931): n is a, c, g, or t
attaaaaagtttgaacaaagtggttactttgttctgctttgatttctttaatttaaatctgtgagtaaggcaaaaagttaacatggaagaagccacaaaaaacgaaaacaccaaagaaataaatccgttagatacatctaacgtattttccaaggtattattttggtggttgatacctctttttaagaaaggatacaataaggaactgactgaagatgatatgtaccaacatcgtgaaagtcacgactcaggagatcttggggatcagtttgagaagatatggaataaacaattgaccaaaaggaagccttctgttattaaagccatagctaaacggttcataccagaatggataatgttgaattgcattatcattatttctgaaactatcagaatatcacagcctttcatgatcactcaactaatttacgtctacgaatccaatcaggtcaacgatgacaagagcgatgtctatatctacgcactattaataataataacctcattcataaccaacaacatggcacataactttaacctactcaacagccagatggctctgaagatgagagtttccgtttgctcgctgatctataggaaagcattgaggttgagtaagtccgctttggcggagactactattggacaaatggttaatttactgtctaatgacgtagacagattcgataactccattttttacttccaatatacgtatgtggcacctatagagatgttggtggttatgtatttactttatcataatattggtactacagccttagccggagcagtgttgttattgtccatcattccttttacattnntggcttggcaaaaagacatcanaattcaggctcccaactgcnaacagaactgatgagagagtaagactgatgaatgaaatttatacgngaaatacagttattangatgtatacttgggaatatcccttta

SEQ ID NO: 19850 - DNA, 256 bp, Diabrotica virgifera
  misc_feature (2)..(115): n is a, c, g, or t
  misc_feature (117)..(149): n is a, c, g, or t
  misc_feature (151)..(188): n is a, c, g, or t
  misc_feature (190)..(216): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnncnnnnnnnnnnnnnnnnnnnnnnnnnnnnnnnnnnnnnncnnnnnnnnnnnnnnnnnnnnnnnnnnnccctgcttattaaaaacctgtcgttttggattaatataaa

SEQ ID NO: 19851 - DNA, 865 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(843): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnncgctcatccctaaaaaatattc

SEQ ID NO: 19852 - DNA, 660 bp, Diabrotica virgifera
cttataagcgtccgcgcatattctcagcatatacgtaattcccattgggaatgtgcagagcagatgctgagtatatactactttacagtacttaaacgttctatttatatacttatagtaaactaccgcgcttcttttcagtatataccaagaatatatttttagaatattttaaggaggtgctataaaccttctatttatatgcttagaatgtactaccgcactctttttaatagtgaatgtgtcaagcatatacttttatatgcttcaaagaatattcgataaaggtatataaatgtgctcagtatattcggtacgagaatattctttgaagtaaactgctcgtcgaaagttggggatgtggaggattgtgctgttctcatagttgattttttcgcgaacagacgaattccgctatttctttgttattttaagtgtttctttgggttttacacggttgtgcaaatgtttgctcaaacttgtttttggtacatataccgggtggaagaaaagaaatgtttttcttatgttgagtttgggacaccctgtagggatagcgaggtgcgaatgtgggtatgctttgaaatcgcattgtacttcttgtgttttgtgaacatgttgattgagtctccctgatggctttggaagcaaaaaaaagat

SEQ ID NO: 19853 - DNA, 921 bp, Diabrotica virgifera
  misc_feature (59)..(78): n is a, c, g, or t
  misc_feature (97)..(129): n is a, c, g, or t
  misc_feature (273)..(291): n is a, c, g, or t
  misc_feature (499)..(513): n is a, c, g, or t
  misc_feature (759)..(759): n is a, c, g, or t
  misc_feature (874)..(874): n is a, c, g, or t
ctacaactcggtcaaagacgaaagacacactacactcatagtaagcgagtcagtgcggnnnnnnnnnnnnnnnnnnnncgttgttaagctttggtgnnnnnnnnnnnnnnnnnnnnnnnnnnnnnnnnngtaataaaactaatttggcgctttaaaaaatgttgtgtatttgtggaaaagatgtcagttgaaatggaatattacttgtagagatcattggatacggaaataaatttcaaaaaataaatagtagcagtagtgagccatggcagnnnnnnnnnnnnnnnnnnnaaacatcatcaccatcattctactagtaattccaacatcaatatccaaagaaggtgccaaatctagacaaaagaggatactttgggtgacgcaagatggccggttagcattaccacctggcactacattagtaatagccccatcactctcgctaccttttgtgaggtatcctcccgaaggatttttctctaatttaactatcagtttnnnnnnnnnnnnnnnctttgcaaaacttggtcttacggacaatgaaaatccttatggagtactacctccacttttggctcgttctatgggcagagcagcgggaactatcttagcagactatataggaactatattgaagaaacgaggaaaaaggtctgctgataagatatccaatccagttcctcacgcttttcacggcggagagagagcattattatatgtaatgttagaagatttattggaacagtttggattagatgngagagcttgtttattaagggcaatttgtgaggtacatgcacattctatggaaaattttggacttttcggagaaatactcaaactctttttcagtgcaagtaaatcaccatatgcncacttattaactgagtatgtggaagcagaaaacgctggcacaggtcg

SEQ ID NO: 19854 - DNA, 684 bp, Diabrotica virgifera
ctatatttttatttgtgcactgcatagttattttgagttaagtgctgttgataacatctctgtaatcctcgctgaaatgtgcaattcgttagtatattgaatctaacggtttaatctatccccaacaagcaactgagattctatgaactggcgctaatcccgcctacagaactgaacccgtacttgtaactgattgtaaattactcggatctcctctccataacttatatcaaatgtcttcggtgcctccacacactctggatggatcatttcctccatttaagacaactacgactcttgaggtactgatgataacctttaaatgatcccccggcatcgttccctagaatgatcttatctttgagatgtttgctcatacattcttgaactaccatacttttttttcatacctgccgcctcctcctgagaatccacggacatcgattatgaaatgaaaggcgattaccactcatacttgatggaatttgccactgttaacgatcgccaggactctgtcgaacattctctaatagcttacacatcgatcaccgactatctacttgacagagttaacgatccctcttcccatcagactggatcttgcgctcttcttctccgtcttctatcacgagattcttgacggaccacatcgcacatgccatttgaacaccactgctttcgatg

SEQ ID NO: 19855 - DNA, 110 bp, Diabrotica virgifera
  misc_feature (51)..(51): n is a, c, g, or t
gttaaaaagctttaatcttttaccagacgagaagacctatagagtttatanattattttatagttttttagtatttaattcattatatcataaattatttcattgcggtg

SEQ ID NO: 19856 - DNA, 1001 bp, Diabrotica virgifera
  misc_feature (4)..(922): n is a, c, g, or t
  misc_feature (925)..(1000): n is a, c, g, or t
ctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnnnnnnng

SEQ ID NO: 19857 - DNA, 56 bp, Diabrotica virgifera
  misc_feature (5)..(5): n is a, c, g, or t
  misc_feature (7)..(52): n is a, c, g, or t
aatangnnnnnnnnnnnnnnnnnnnnnnnnnnnnnnnnnnnnnnnnnnnnnntgat

SEQ ID NO: 19858 - DNA, 716 bp, Diabrotica virgifera
ctagttctagatcgcgggcggcccaaaaatttgcacgttgagtgctttaagtgttccacttgtggctcctctttaaagaacgtagggtattataacattaacaacaaactttactgcgacgttcacgccaagtcagctgcactcaaaaaccagactaatccaaatctagttccaattaccatcccaccaggtggaagagctccagctcacgctatctcgtctgccctttctagccattcttatccaacatcatctccattatctccaaagttaaacacagctggtacccaatatcaggcagaggaaactaatgagaatgtcgatgttacgtcttcgtcttcacttttagctaaatctaacgttatcgagtctaatactagcaataataatttatttagcaattctacgcctgtttcgtatagcaaatacttaaacaataagacaaattactccggtcccaaaccattctcaagcgtaaatgcgccactctctccccataacactcttccaagagcagccccattatctccagtagctccagcaccatcttttaatagtcattcttatactccttctgcttacagtccttcatcagattatgcaaattcgctgtgccatgctacagagagcgaaaatctagtagaactgcatgaaatagcttacaaataccaaatcagcctccaccaccgccacctgttcccggttatagccaaaat

SEQ ID NO: 19859 - DNA, 901 bp, Diabrotica virgifera
  misc_feature (15)..(39): n is a, c, g, or t
  misc_feature (102)..(121): n is a, c, g, or t
  misc_feature (150)..(172): n is a, c, g, or t
  misc_feature (277)..(316): n is a, c, g, or t
  misc_feature (417)..(440): n is a, c, g, or t
  misc_feature (656)..(679): n is a, c, g, or t
  misc_feature (692)..(709): n is a, c, g, or t
aaagatattggaacnnnnnnnnnnnnnnnnnnnnnnnnngcaggaatggtaggaacttcattaagaattttagtacgagcagaattaggaaggcccggatcnnnnnnnnnnnnnnnnnnnntttataatgttattgttacagctcatgcnnnnnnnnnnnnnnnnnnnnnnnttatacctattataattggtggttttggaaattgacttgtacccttaataattggtgctcccgatatagcattccctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcaagagagaagacaataagaagcttttggtactttaggaataatttatgctataatagcaattggcttattatgttttattgtttgagctcatcatatatttacagtaggaatggatgatgatactcgagcttatattacctcagcaactataattattg

SEQ ID NO: 19860 - DNA, 464 bp, Diabrotica virgifera
  misc_feature (122)..(155): n is a, c, g, or t
  misc_feature (286)..(301): n is a, c, g, or t
  misc_feature (304)..(316): n is a, c, g, or t
cggacgcgtgggcaaaaataccatcatatctgagccaacttcaaaattgagcgccgccgggaaaagtgaagccccgacacacgatcagtccatctgacacaagccacaccttacgagtcatnnnnnnnnnnnnnnnnnnnnnnnnnnnnnnnnnngtggctggctcagatatgatgtgctcttatttgcagggttatccaaaaatggggagagggatgatttttttcgatgacgccacggcgatacactaacataaatgaactcgtacgaccttgtgtttttagannnnnnnnnnnnnnnnagnnnnnnnnnnnnncactaagagttttctcgctttgacgagttataatttaaaataactgaatgaaatagatattttgtctctgggatagctattgtcatgcatatactctataacggagagcccctggatctgtgcacgagcgtgattatactggagcata

SEQ ID NO: 19861 - DNA, 894 bp, Diabrotica virgifera
  misc_feature (259)..(273): n is a, c, g, or t
  misc_feature (275)..(289): n is a, c, g, or t
  misc_feature (692)..(713): n is a, c, g, or t
  misc_feature (852)..(869): n is a, c, g, or t
cacggcggtacgtatggctctggatccttctacggacggcgggcctgcccacccttttttttttttccggttacctaattttatattcatccgtctctccgaaaagaacgattctctaaaacacgaatcatcaaatcaacgatcaatctcatcatctttaacccaaggttcaatttacacggaaatccaacatctcagtcgattttctaatttttcgttttcttgagaacgatttctcggcatcgaaagtcgaaacgtnnnnnnnnnnnnnnntnnnnnnnnnnnnnnngtaattatcattacaactcattccatcacaaaaatttttcgtcaacataaaaatgttaaataatcaataaaatcgatcgatcgatattaaagttttatacgtatttaaaaaaaatgggcccgattttcaatgaaaagtcccggattttaggtagttttttcagtcttgtcccgaattggactaaattggagttggtcacactaactataaccgaaacagtggcttaccgaggagggtcaataatgatttgaggaggtatctcttacgaagctggtacggatcttgtgcattgtgaatgctcaaagatacgtggaagaagttttccaagaccatggcatgcctttcgcaccgttcattggtgaaaaccctagattaatgcattacaatgccgttgtcacaccgnnnnnnnnnnnnnnnnnnnnnnttactgttttgttttctttgaaggtggtcttcaccatatctttcataaaatgtggttcaagattgacaataatctgcaaattgacagaaatacaaagtgggcggttaattttgcaggcgagtataaaaatggtgggaannnnnnnnnnnnnnnnnngataccattacacatttgaggattg

SEQ ID NO: 19862 - DNA, 415 bp, Diabrotica virgifera
cgtggtgttcatcacttcccgaagatcaagataacgtaaatccaacacaacactcaaagaaaaatacgaagacgcagatcttcacaatgaagattctgtgaatagggcttttcatccacagtcattcgcctcgagcccccgtcatgtgtcacataatatcaatatacccacgacatacgtcattggtatatacaataatacaaaccacagacgtatgacgtacatatatcaatattatgcgacacacgacagaagctcgaaaaaatgacaaccgatgaaaagccctatatctgatagcctaaaacagtacaagatctaattttagatatgaaaagtatccataaatatgtatgtagtagtctttattaaaaacagaaattatgaggattgaattataaagcaagatttgacaaag

SEQ ID NO: 19863 - DNA, 768 bp, Diabrotica virgifera
  misc_feature (15)..(80): n is a, c, g, or t
  misc_feature (86)..(108): n is a, c, g, or t
  misc_feature (299)..(372): n is a, c, g, or t
  misc_feature (377)..(442): n is a, c, g, or t
  misc_feature (460)..(478): n is a, c, g, or t
  misc_feature (487)..(501): n is a, c, g, or t
  misc_feature (503)..(519): n is a, c, g, or t
  misc_feature (524)..(542): n is a, c, g, or t
  misc_feature (557)..(577): n is a, c, g, or t
  misc_feature (715)..(764): n is a, c, g, or t
ctttttcctttcctnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctaccccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngacannnnnnnnnnnnnnnnnnncccttcattccagcnnnnnnnnnnnnnnnnnnnnnttatgctaccttagcacggtcaaaataccgcggccattcaaattaatcagggggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 19864 - DNA, 1049 bp, Diabrotica virgifera
  misc_feature (49)..(73): n is a, c, g, or t
  misc_feature (435)..(435): n is a, c, g, or t
  misc_feature (956)..(985): n is a, c, g, or t
  misc_feature (988)..(988): n is a, c, g, or t
  misc_feature (1007)..(1007): n is a, c, g, or t
acggtcgcatgcacgcggtacgtatggctcgggatccttctcgtggcgnnnnnnnnnnnnnnnnnnnnnnnnnggaaaaaaaacgtcacgtcaaccatcgggttattctagcgactcacatcaagaataagttcatcatcatgatggggtggtccacgaaaacttctcaccagtacacaatggaaataaccagggaagaatcttccttcacgaataaattctttcaagaacatattttatagcccacattctcactttatattcccgaaaatacggctcttcctcaaggggaaactcaagaatctaattcttgaaagaactgggcgtctcgggtaaatttaattttctttctttataattctccttccgagaaacggctttctacatttaagaaaaagacataaatattcgggtaacgcggtattccattctttnccagatgaacataattctaacttccattccattcggcaaattttctaacaccgatcacaggcgtccgtcttgggatcaggacaacggttactctatcgcatcaacttcttttcggtctttaactttttaagcattttttcgacttctcggggttattatattgatacgtattcttcgtactaaaatataactcctggttttaagtcgatagggtacaccgttttctataaaaatcaatttgaaaatttttcgttttgttaatttcaaaagaaatttcaaaaaaaatctatttaaaaaaccgaaaacttttacgattaattatattccagagatgaatcgttttcattaattgcgaatttctagtaacggtcatatggcgtcggtttttgggtaggtcaaggttattttgtcgaataacttttttgtctttaatccttaaacatctttgacattagcttattaaattatgaggtattccagtagtaaaagtcactcttgctttatgttggtaaatacaccgnnnnnnnnnnnnnnnnnnnnnnnnnnnnnnttncagggacgaaaaatttcanagtcgatttttctagaaaatgatgtgtcccaccgattaaatc

SEQ ID NO: 19865 - DNA, 708 bp, Diabrotica virgifera
  misc_feature (13)..(60): n is a, c, g, or t
  misc_feature (108)..(127): n is a, c, g, or t
  misc_feature (141)..(168): n is a, c, g, or t
  misc_feature (211)..(227): n is a, c, g, or t
  misc_feature (230)..(242): n is a, c, g, or t
  misc_feature (576)..(597): n is a, c, g, or t
atcccaagcaaannnnnnnnnnnnnnnnnnnnnnnnnnnnnnnnnnnnnnnnnnnnnnnnttcggttttcccatcttaagccgacaacaaaattaacaaaatttcccnnnnnnnnnnnnnnnnnnnntggatattatttannnnnnnnnnnnnnnnnnnnnnnnnnnnccaatacccttccttcagccggtggtttgaaaaacccgagggnnnnnnnnnnnnnnnnnccnnnnnnnnnnnnnttttcaaagcttaaaaaaaaggcaaaacaaaagcaaaaaaaccatatttttttcaaattgaattcaatggttagggaataccccagaagggggcaaaaaacccagaactgaaaattgaaattgaaggccggcccccttcagcattccccatatgaacccatcagggggggttaggtctgatgaggggggatcccccaaaaggatcgagcagaattcaaaaacccccccgggccgggggcaaaattgccccgcccggcttgaactagggggaatttgctgggaccgggttccctaccttttccgaatgaccgaaaaaaaaccccatatatcgggnnnnnnnnnnnnnnnnnnnnnnggcaaaactgaaaaccatcctgaagcccctaacattaacatgacattcccataagttataaggacgttcggaaactactcggaacgtttcggcgcagggcacatacaaatt

SEQ ID NO: 19866 - DNA, 691 bp, Diabrotica virgifera
  misc_feature (11)..(33): n is a, c, g, or t
  misc_feature (224)..(296): n is a, c, g, or t
  misc_feature (302)..(367): n is a, c, g, or t
  misc_feature (385)..(403): n is a, c, g, or t
  misc_feature (412)..(426): n is a, c, g, or t
  misc_feature (428)..(444): n is a, c, g, or t
  misc_feature (447)..(465): n is a, c, g, or t
  misc_feature (480)..(500): n is a, c, g, or t
  misc_feature (589)..(618): n is a, c, g, or t
  misc_feature (638)..(674): n is a, c, g, or t
ccctttcgtannnnnnnnnnnnnnnnnnnnnnngatagaaaccaacctggctcacaccggtttaaactcaaatcatggaaaattttaaaaggcgaacagacttaataatatagctgctaccccaattataaactttaatccaacatcgagggcgcaatctttattatcgatttgaactctccaataaaattacgctgttatccctaagggaatttattcttatnnnnnnnnnnnnnnnnnnnnnnnnnnnnnnnnnnnnnnnnnnnnnnnnnnnnnnnnnnnnnnnnnnnnnnnnncccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacgggcaaaataccgcggccattcaaattaatcagggggcaggcgagactttatatttaatacaaaaagacatnnnnnnnnnnnnnnnnnnnnnnnnnnnnnnccgaattcctttattaaacnnnnnnnnnnnnnnnnnnnnnnnnnnnnnnnnnnnnnaatattatcctcattac

SEQ ID NO: 19867 - DNA, 1069 bp, Diabrotica virgifera
  misc_feature (11)..(36): n is a, c, g, or t
  misc_feature (82)..(329): n is a, c, g, or t
  misc_feature (339)..(402): n is a, c, g, or t
  misc_feature (406)..(423): n is a, c, g, or t
  misc_feature (447)..(479): n is a, c, g, or t
  misc_feature (484)..(618): n is a, c, g, or t
  misc_feature (636)..(682): n is a, c, g, or t
  misc_feature (691)..(724): n is a, c, g, or t
  misc_feature (726)..(793): n is a, c, g, or t
  misc_feature (802)..(820): n is a, c, g, or t
  misc_feature (830)..(852): n is a, c, g, or t
  misc_feature (871)..(949): n is a, c, g, or t
  misc_feature (959)..(1048): n is a, c, g, or t
  misc_feature (1051)..(1063): n is a, c, g, or t
agaagaggcgnnnnnnnnnnnnnnnnnnnnnnnnnncccccttcttttttctcttctcttctctcttctcttccctcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggggggnnnnnnnnnnnnnnnnnnnnnnnnnnnnnnnnnnnnnnnnnnnnnnnnnnnnnnnnnnnnnnnnaaannnnnnnnnnnnnnnnnngggggggaaattttaagggggggnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggtggggtattgggnnnnnnnnnnnnnnnnnnnnnnnnnnnnnnnnnnnnnnnnnnnnnnnaattttttnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnntttgggtgnnnnnnnnnnnnnnnnnnnggggggaaannnnnnnnnnnnnnnnnnnnnnntccccatatgggggggttnnnnnnnnnnnnnnnnnnnnnnnnnnnnnnnnnnnnnnnnnnnnnnnnnnnnnnnnnnnnnnnnnnnnnnnnnnnnnnngggggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngannnnnnnnnnnnntgggtg

SEQ ID NO: 19868 - DNA, 119 bp, Diabrotica virgifera
attagaaaggtaaaataaattaaggaacatagtaatgagttttacaattttttttattttcccatagtattaggctaataatatgatagtcttactttgcacaggtaataaattacaaa

SEQ ID NO: 19869 - DNA, 87 bp, Diabrotica virgifera
  misc_feature (7)..(41): n is a, c, g, or t
ggccccnnnnnnnnnnnnnnnnnnnnnnnnnnnnnnnnnnnataggtcattctttcgaaaacccaatctagcaaataaaatgaaaaa

SEQ ID NO: 19870 - DNA, 528 bp, Diabrotica virgifera
  misc_feature (183)..(205): n is a, c, g, or t
cctggattatgtattttaattatcgtcttccgaaaagacgattttacaacatgaatatcaaataatgataattatattttaacccacggattaatctacttggaaatccaacattacttgattttctagttctccgttttttgagaacgatttactggcatgaaagttgaaacgtcatagacnnnnnnnnnnnnnnnnnnnnnnngtaattatcattacaactcattccatcacataaatattaggcaacataaatatgttaaataatcaataaaatgatgatgatattaaagttctacacgtatttaaaaaaaatgtgccgattttctatgaaaagtcccgcattctaggaacttttttcaagcttgtcccaaatagaaccaaattaggagatgcccactcaacctataatcgattcaggggcttagtgaggatgatccatattgatgtgaggatgtatactcgtacaaagctagaacggttcttcttatttgaacaagatcaaagatacttgtaagaattatacct

SEQ ID NO: 19871 - DNA, 879 bp, Diabrotica virgifera
  misc_feature (553)..(576): n is a, c, g, or t
  misc_feature (822)..(839): n is a, c, g, or t
ggaagagcatacaggagaataaaatatggttcagatcattatattgtaaggtcaaaggtagcttttccattcattcataatacaaaaaacacaagatagatatcccaaacaagaagaaatttttaaggaagtgaattacaactttgatataacaaatgaaatctcctaaatatcagcttaataggtaaagttcaagtttcgtttgcagcaacattaacaagaaacaacattaacaagaaggggaagacggatttctgtacattcgacaaccaatgaatgtctacactctgcataacatacgccaccgaatgaagaagatttaagaagtatatagacttttctgaagttatttttttctgctaaattatttcagagttttgagcacccaaaatagagtatctaaacaaacatgtgaaaataattctaaaagtatttgtttatttcaactgatattaaatttacattgaaactgaaagctatattattaaaactttacaactacattgtataatattgtatgacgtcattttttctaacataaaatagttctagnnnnnnnnnnnnnnnnnnnnnnnncaataaaaagagaacaaacataggtacttgtattacgattatattttacataaactatatctaatacatatctaaaagtgtgatgattacttatttctcactatcatcaggaaaaagaacagttgaggcgctcagagcaacagtggactaaccccaaaaacgaagttctgagataaatgtaatctttgcgttcgtatttacattatgcttatgggatggcactataaataatttatagtaatgtgnnnnnnnnnnnnnnnnnnataagtattattatgtatttatacacgagcgggataccct

SEQ ID NO: 19872 - DNA, 695 bp, Diabrotica virgifera
ctccagacctcccgcgcggccggccctccccccctttttttcgctttcagaattttattaaaacgtttattacacaatttatatttaataactacataagtgcaggtcctttttcttttaacgtagcacgaatattgtctacatcatcttctgatttaccgccttcatccttttcctccttttcggcaattacatctaacatttttcttaacctttcctttacataatctatatcctctggattttcttttgctgatacgggaattatttggctaaatttgagattgttagcaggcctcatattatctggatagttgctaaagaaaccttctaaatgtttaagctgttcttttatttcctggaatttttcaactgccccttcagtatccattttatttataaccatcatcgccggttttgatagcaaagtttcgttatacatttccaattccttaattaaaagcatcacagtttctaaacaacttctatgggggtactgaggacttaattgaaatccattaatgtcaaccaccataagaattaatttcgttctttcaatatgtttaagaaattgatgtcccattcccttattaaggtgagcaccttctataagacctggtaagtcagccatggatatctgtcgatggtctggatacattaagattcctacattaagttttacagatgtaaatgga

SEQ ID NO: 19873 - DNA, 285 bp, Diabrotica virgifera
  misc_feature (2)..(48): n is a, c, g, or t
gnnnnnnnnnnnnnnnnnnnnnnnnnnnnnnnnnnnnnnnnnnnnnnnctacttcttcgttcttttgttctaagaaattataagatatgtttccgagagaacccgtccttgtcctcacgcggggctataatatgataatggaccatttttgttgtctaagtgacttaaaactattgcttgtacactttattataagtctaatatccccttcaccgagtgtcctcgctcgttggagtctcgagtaatgtactctcccagtaaatgtacgctgctattccttttgta

SEQ ID NO: 19874 - DNA, 114 bp, Diabrotica virgifera
  misc_feature (15)..(32): n is a, c, g, or t
cccataggatattcnnnnnnnnnnnnnnnnnngctaagactatgaagaatgaactgaaacaactgtgcattgctcacgagagcactaatatgaatattgaggattttttttgtc

SEQ ID NO: 19875 - DNA, 801 bp, Diabrotica virgifera
  misc_feature (6)..(28): n is a, c, g, or t
  misc_feature (221)..(294): n is a, c, g, or t
  misc_feature (299)..(364): n is a, c, g, or t
  misc_feature (382)..(400): n is a, c, g, or t
  misc_feature (409)..(423): n is a, c, g, or t
  misc_feature (425)..(441): n is a, c, g, or t
  misc_feature (444)..(462): n is a, c, g, or t
  misc_feature (477)..(497): n is a, c, g, or t
  misc_feature (635)..(684): n is a, c, g, or t
  misc_feature (689)..(784): n is a, c, g, or t
  misc_feature (786)..(786): n is a, c, g, or t
tcgtannnnnnnnnnnnnnnnnnnnnnngatagaaaccaacctcggctcacaccggtttaaactcagatcatcgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanaatttttaaatctaa

SEQ ID NO: 19876 - DNA, 799 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(497): n is a, c, g, or t
  misc_feature (635)..(684): n is a, c, g, or t
  misc_feature (689)..(797): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 19877 - DNA, 652 bp, Diabrotica virgifera
  misc_feature (5)..(163): n is a, c, g, or t
  misc_feature (167)..(278): n is a, c, g, or t
  misc_feature (281)..(331): n is a, c, g, or t
  misc_feature (345)..(395): n is a, c, g, or t
  misc_feature (403)..(424): n is a, c, g, or t
  misc_feature (430)..(452): n is a, c, g, or t
  misc_feature (455)..(468): n is a, c, g, or t
  misc_feature (480)..(535): n is a, c, g, or t
  misc_feature (549)..(575): n is a, c, g, or t
  misc_feature (611)..(636): n is a, c, g, or t
aaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnntttttccggggggnnnnnnnnnnnnnnnnnnnnnnnnnnnnnnnnnnnnnnnnnnnnnnnnnnnccccaaannnnnnnnnnnnnnnnnnnnnnccttcnnnnnnnnnnnnnnnnnnnnnnnaannnnnnnnnnnnnngggggttttttnnnnnnnnnnnnnnnnnnnnnnnnnnnnnnnnnnnnnnnnnnnnnnnnnnnnnnnnggggaaaaatttannnnnnnnnnnnnnnnnnnnnnnnnnngggggttttttaaaacccggggtacaaaaaaagtgnnnnnnnnnnnnnnnnnnnnnnnnnnaaggaggggggcccct

SEQ ID NO: 19878 - DNA, 807 bp, Diabrotica virgifera
  misc_feature (13)..(71): n is a, c, g, or t
  misc_feature (73)..(136): n is a, c, g, or t
  misc_feature (204)..(229): n is a, c, g, or t
  misc_feature (294)..(306): n is a, c, g, or t
  misc_feature (309)..(323): n is a, c, g, or t
  misc_feature (327)..(356): n is a, c, g, or t
  misc_feature (401)..(422): n is a, c, g, or t
  misc_feature (487)..(504): n is a, c, g, or t
  misc_feature (623)..(661): n is a, c, g, or t
  misc_feature (664)..(676): n is a, c, g, or t
tcctccccccccnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnntgtaaaaatattctattatttaattgttttattacccctgaacttccataatattcaaatcatcctannnnnnnnnnnnnnnnnnnnnnnnnnccaaaataaattggataataattaattcctaaagtaaataaaaaaggtatatttcatattattcnnnnnnnnnnnnntcnnnnnnnnnnnnnnnaccnnnnnnnnnnnnnnnnnnnnnnnnnnnnnnctaactcataacctaatcaaactccaactataataaaaatcaaannnnnnnnnnnnnnnnnnnnnngaagacaaataaaaataggagtagaaaatactaatcaagaaaataatcttccactaaaaactacnnnnnnnnnnnnnnnnnntatacccttaagtattaaataaccagtttcagataatatatttaaagctagataattaaatctacccgttaaagaataataagttaaacgaaatctataagcaactgtcaaaccaatannnnnnnnnnnnnnnnnnnnnnnnnnnnnnnnnnnnnnnctnnnnnnnnnnnnntcaacaattaaatctttagaataaaatccagacataaaaggaaaaccacataaagaaagattacaaatatttaaataagtacaagtcaatgggtaaatgtttaattaaacctcctatataacgaatatcct

SEQ ID NO: 19879 - DNA, 762 bp, Diabrotica virgifera
  misc_feature (26)..(152): n is a, c, g, or t
  misc_feature (158)..(183): n is a, c, g, or t
  misc_feature (185)..(198): n is a, c, g, or t
  misc_feature (204)..(324): n is a, c, g, or t
  misc_feature (348)..(375): n is a, c, g, or t
  misc_feature (396)..(420): n is a, c, g, or t
  misc_feature (457)..(474): n is a, c, g, or t
  misc_feature (511)..(542): n is a, c, g, or t
  misc_feature (581)..(606): n is a, c, g, or t
  misc_feature (634)..(659): n is a, c, g, or t
  misc_feature (663)..(681): n is a, c, g, or t
ctagggaatctatagaggggcaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnngnnnnnnnnnnnnnntgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaaaagggggtaaaaaaaagnnnnnnnnnnnnnnnnnnnnnnnnnnnnatgaaaaaaaggttttaatgnnnnnnnnnnnnnnnnnnnnnnnnnagaatttttaatgtagaaaagtaaaaaagagaagggnnnnnnnnnnnnnnnnnngggagagaagagagggggggggagtttttttatggtnnnnnnnnnnnnnnnnnnnnnnnnnnnnnnnnagaggaatatattaaaatttgtattgtaagaaaaaaggnnnnnnnnnnnnnnnnnnnnnnnnnnggtgggtggtaaaaaaggggcttggagnnnnnnnnnnnnnnnnnnnnnnnnnngatnnnnnnnnnnnnnnnnnnncttggagggggatgggggggaagagtagcaagaagaaaaaagatcagggggaaggagggaggaaaaggggttctctggggg

SEQ ID NO: 19880 - DNA, 589 bp, Diabrotica virgifera
  misc_feature (9)..(44): n is a, c, g, or t
  misc_feature (54)..(111): n is a, c, g, or t
  misc_feature (121)..(147): n is a, c, g, or t
  misc_feature (150)..(180): n is a, c, g, or t
  misc_feature (201)..(241): n is a, c, g, or t
  misc_feature (365)..(401): n is a, c, g, or t
  misc_feature (478)..(496): n is a, c, g, or t
  misc_feature (535)..(553): n is a, c, g, or t
tatgaattnnnnnnnnnnnnnnnnnnnnnnnnnnnnnnnnnnnncaaaaagccnnnnnnnnnnnnnnnnnnnnnnnnnnnnnnnnnnnnnnnnnnnnnnnnnnnnnnnnnnggttttttcnnnnnnnnnnnnnnnnnnnnnnnnnnnggnnnnnnnnnnnnnnnnnnnnnnnnnnnnnnnccatttggggggggtttcctnnnnnnnnnnnnnnnnnnnnnnnnnnnnnnnnnnnnnnnnncacttttttcttttttccgaaacccccaattttttttggaccgaaaggaaacctaaagggggttttaaattttccgggcttggaaatctttttttttttccaaaccccaaattaccccttgtgnnnnnnnnnnnnnnnnnnnnnnnnnnnnnnnnnnnnncctaaaaagggggggtttaccaaaaattttccggttaaagccaagaaaccccttcttggaattttggcccccccccnnnnnnnnnnnnnnnnnnnggggaatgacctactttttttgccctttgaaaaaaattnnnnnnnnnnnnnnnnnnnttttttaaaaccaaagcccccggggaatctttttgc

SEQ ID NO: 19881 - DNA, 815 bp, Diabrotica virgifera
  misc_feature (48)..(79): n is a, c, g, or t
  misc_feature (81)..(124): n is a, c, g, or t
  misc_feature (135)..(157): n is a, c, g, or t
  misc_feature (348)..(420): n is a, c, g, or t
  misc_feature (426)..(491): n is a, c, g, or t
  misc_feature (509)..(527): n is a, c, g, or t
  misc_feature (536)..(550): n is a, c, g, or t
  misc_feature (552)..(568): n is a, c, g, or t
  misc_feature (571)..(589): n is a, c, g, or t
  misc_feature (604)..(624): n is a, c, g, or t
  misc_feature (762)..(811): n is a, c, g, or t
tctcgtagcgggccggccctcccccctccccccctcctccctccccannnnnnnnnnnnnnnnnnnnnnnnnnnnnnnnannnnnnnnnnnnnnnnnnnnnnnnnnnnnnnnnnnnnnnnnnnnccctttcgtannnnnnnnnnnnnnnnnnnnnnngatagaaaccaacctggctccccccggtttaaactcagatcatgtaaaattttaaaagtcgaacagacttaataatatagctgctaccccaattataaactttaatccaacatcgagggcgcaatctttattatcgatttgaactccccaataaaattacgctgttatccctaagggaatttattcttatnnnnnnnnnnnnnnnnnnnnnnnnnnnnnnnnnnnnnnnnnnnnnnnnnnnnnnnnnnnnnnnnnnnnnnnnncccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagggggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 19882 - DNA, 742 bp, Diabrotica virgifera
  misc_feature (273)..(285): n is a, c, g, or t
  misc_feature (288)..(342): n is a, c, g, or t
  misc_feature (353)..(397): n is a, c, g, or t
  misc_feature (399)..(421): n is a, c, g, or t
  misc_feature (440)..(458): n is a, c, g, or t
  misc_feature (469)..(483): n is a, c, g, or t
  misc_feature (485)..(501): n is a, c, g, or t
  misc_feature (504)..(519): n is a, c, g, or t
  misc_feature (540)..(559): n is a, c, g, or t
  misc_feature (697)..(733): n is a, c, g, or t
catcattatcctaaatctaaaaattatctttatatcacccggtccttctcgtactaaaatatatctaataaattaaagatagaaaccaacccggctcacaccggtttaaactcagatcatcgtaaaatctttaaaagtcgaacagacttaataatatagctcgctacaccaattataaactttaatccaacatcgaggtcgcaatctttattatcgatttgaaccctccaataaaattacgctcgttatccctaaggtaatttatttcttatnnnnnnnnnnnnncgnnnnnnnnnnnnnnnnnnnnnnnnnnnnnnnnnnnnnnnnnnnnnnnnnnnnnnntaatcaccccnnnnnnnnnnnnnnnnnnnnnnnnnnnnnnnnnnnnnnnnnnnnncnnnnnnnnnnnnnnnnnnnnnnntctatagggtctttctcgnnnnnnnnnnnnnnnnnnngctttttcaannnnnnnnnnnnnnncnnnnnnnnnnnnnnnnngannnnnnnnnnnnnnnntccaacccttctttccagctnnnnnnnnnnnnnnnnnnnngattatgctaccttagcacggtcaaaataccgcggccattaaattaatcagtgggcaggcgagactttatatttaatacaaaaagacatgtttttaataaacaggtgaaaaaaaggttgccgaattcctttataaacnnnnnnnnnnnnnnnnnnnnnnnnnnnnnnnnnnnnnaatattatc

SEQ ID NO: 19883 - DNA, 860 bp, Diabrotica virgifera
  misc_feature (804)..(804): n is a, c, g, or t
acgacaaagtaacatataattaattataaacactgttttattgaaattacaaaactaaacttatcctaaaaatgatttgtaagcttatgtatatccgtaaggtcttcaataagttcttccattttagtaccaattttttgaaacctctgacttttctgttagcgaaaggtttaggaaattccacactaactccccatcgattatagatctagcagggttgttttgtagttttctccaacttttaaatgtcctgaaagccttgggatttaggccggcaatatgagctccttgggaaactaatacattttgcaacataagtaaacggcgatatgttttctctggaactggcataatgtatcctatacctccatccaaagtagcaaacattgtaataaaccttctatctgctccagaaaaatgctttttatcatcgcctagttcacctagtttacatttaattttaaagaatgtgttgacagtttggcctaaatggaaatccgctttccttaatagtctttgacctcctaaagattctcttgattctggttgatacatatacatggctagattttgttctccatctgatactaaaaatcctagtgatgaattatctatcatgtattctattgaatatacttcgtttggtttgaaatccctagataccattgacagtgttcggtactcttcttgaaaccttaacaacgcgatagatttgtagacatcaccaaccaacagcaaacttttgatagtaagtatttgatgagtatagacttgtgtatctataaatgctactccaataaatcngtatctttgagttgccaaatatatatcttttgtcccactgctgacacaggaaacct

SEQ ID NO: 19884 - DNA, 411 bp, Diabrotica virgifera
  misc_feature (18)..(40): n is a, c, g, or t
cgcgacctcccgaggcgnnnnnnnnnnnnnnnnnnnnnnngcaaaaaaaggaacgggaaccaagcttcttttttctccccgaattctgggctctgggtttcgaaactcaaaacctttacgccacgtaattctctcacttcatcctcagtcaggggaagtaacgggtagtggggggggtgagtaagtggcttgttactttgcaaagtcgacgtcatttgtctttgcaaagagacgctaatttgtttccgaacgtctgcggtccctccggtgaagggatcaagctatttgtcaaaatataatatcaaaaatgttgctgactgttgttggttactcaatgatgaagttttgagcccagattactatgatggatgttcagcgatgaaagttttacaaaaatggttttgttcatgc

SEQ ID NO: 19885 - DNA, 790 bp, Diabrotica virgifera
  misc_feature (3)..(103): n is a, c, g, or t
  misc_feature (109)..(131): n is a, c, g, or t
  misc_feature (322)..(396): n is a, c, g, or t
  misc_feature (401)..(466): n is a, c, g, or t
  misc_feature (484)..(502): n is a, c, g, or t
  misc_feature (511)..(525): n is a, c, g, or t
  misc_feature (527)..(543): n is a, c, g, or t
  misc_feature (546)..(564): n is a, c, g, or t
  misc_feature (579)..(599): n is a, c, g, or t
  misc_feature (737)..(786): n is a, c, g, or t
tcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcaaatcatgtaaaattttaaaagtcgaacagacttaataatatagctgctaccccaattataaactttaatccaacatcgagggcgcaatctttattatcgatttgaactctccaataaaattacgctgttatccctaagggaatttattcttatnnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcggggggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 19886 - DNA, 908 bp, Diabrotica virgifera
  misc_feature (502)..(524): n is a, c, g, or t
  misc_feature (619)..(636): n is a, c, g, or t
ctccgctctaatctcaattccgcgcaatttgcacgcagctcgtagagagagcagcaattttttcgatatatacttcacggcaaactccgttcgccgcatcggctaagattcgaattaaaattttcctcgtaaaaaaaggtaattgtattcagctcgagttccattttaatccataacctgactttaatctcatattctcgcgtattcccccgaaggcgaactcttcaagagtcactaggtcaagtcatcgtcggtgaggcggctcgctagaggttcctttgtttcttcggctgtgttgccacattaccaaacattttgaggtacatatcgaccgttaagtaccaataccttctatctaacgacaagtaaattttacaggagaagcaaaaaacttatttaattttgctctgccaatcagaataatttaatatatggactttctacttttttatgtataagattatcgtacctcacatatttgattttgaaagagcttttgaannnnnnnnnnnnnnnnnnnnnnnggtattggtttttctctgttacttgaaatatatgtgtttaatggaagataggaggtcttaaatgtaattaaaaaatgaattaaactcaaaaaacnnnnnnnnnnnnnnnnnngatatcaacacattaagacttctgagatagtgagtcatagaatgtatgacagtcttgcggtaacacagttttcaattgttgtaaatgagagtacttcgtagaactaataggtagcactttgtcatgcaagggagtataaatcggttcaggaataattttaggtcttatgggcaactcactccactcatcatcaaagtttagtttatattgtatttttccatctatggtatacagtaaagccctcagatctgttacaacaggatctcctactt

SEQ ID NO: 19887 - DNA, 1114 bp, Diabrotica virgifera
  misc_feature (19)..(132): n is a, c, g, or t
  misc_feature (143)..(190): n is a, c, g, or t
  misc_feature (340)..(368): n is a, c, g, or t
  misc_feature (373)..(427): n is a, c, g, or t
  misc_feature (435)..(468): n is a, c, g, or t
  misc_feature (470)..(498): n is a, c, g, or t
  misc_feature (516)..(603): n is a, c, g, or t
  misc_feature (611)..(641): n is a, c, g, or t
  misc_feature (691)..(745): n is a, c, g, or t
  misc_feature (770)..(788): n is a, c, g, or t
  misc_feature (793)..(811): n is a, c, g, or t
  misc_feature (825)..(851): n is a, c, g, or t
  misc_feature (898)..(920): n is a, c, g, or t
  misc_feature (947)..(965): n is a, c, g, or t
  misc_feature (971)..(1018): n is a, c, g, or t
  misc_feature (1022)..(1068): n is a, c, g, or t
tccccccctcccttccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctttccccnnnnnnnnnnnnnnnnnnnnnnnnnnnnnnnnnnnnnnnnnnnnnnnnggtttaaccccaaaccttgaaaatttttaaaagccaaccaactttaaaaattttcctccccccccattttaaaattttaccccccccccggggccccaatttttttttcctttttaacccccccaaaaaaattccccttttccccccagnnnnnnnnnnnnnnnnnnnnnnnnnnnnnggtcnnnnnnnnnnnnnnnnnnnnnnnnnnnnnnnnnnnnnnnnnnnnnnnnnnnnnnncccccccnnnnnnnnnnnnnnnnnnnnnnnnnnnnnnnnnncnnnnnnnnnnnnnnnnnnnnnnnnnnnnnccctttggggcctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccccnnnnnnnnnnnnnnnnnnnnnnnnnnnnnnncttaccccggcaaaaaacccccgcccttttaatttatccagggggcgggnnnnnnnnnnnnnnnnnnnnnnnnnnnnnnnnnnnnnnnnnnnnnnnnnnnnnnntgttcccaaatcccttttttaaccnnnnnnnnnnnnnnnnnnntcacnnnnnnnnnnnnnnnnnnngggggaaaaatttnnnnnnnnnnnnnnnnnnnnnnnnnnncccccacacaccccccccccgttcccaaaaatataaaaaacattggnnnnnnnnnnnnnnnnnnnnnnngtggttttaaaaaaggggatttcgggnnnnnnnnnnnnnnnnnnnccctgnnnnnnnnnnnnnnnnnnnnnnnnnnnnnnnnnnnnnnnnnnnnnnnnagannnnnnnnnnnnnnnnnnnnnnnnnnnnnnnnnnnnnnnnnnnnnnngggggtttttttgttttcccgggggaaaagggggggttttttaatc

SEQ ID NO: 19888 - DNA, 347 bp, Diabrotica virgifera
  misc_feature (12)..(36): n is a, c, g, or t
  misc_feature (65)..(81): n is a, c, g, or t
  misc_feature (84)..(107): n is a, c, g, or t
  misc_feature (292)..(311): n is a, c, g, or t
cctctagagggnnnnnnnnnnnnnnnnnnnnnnnnnattttctattagaatataggtttaaatcnnnnnnnnnnnnnnnnngcnnnnnnnnnnnnnnnnnnnnnnnngcatattgagtatgcctatataggactaataaaggaattctgcgacattttttcctccgtgcttattatcatctttgtctttttggattaaatataacgtctcgcccgcccacagatcaatctgatcggcctcgggatattgaccgtgctaatgtccatactcattattctttttattgaacctnnnnnnnnnnnnnnnnnnnntgaaaaaactgtctgttattcgatggcgaaatagtt

SEQ ID NO: 19889 - DNA, 541 bp, Diabrotica virgifera
  misc_feature (118)..(140): n is a, c, g, or t
gtggagatgtctgtttaagaattcaaaagatatgccattacttgggaaccacactgaaagaatagtctcggggccgaaccgacaatgcgaactcacatttataatcaaacaattctcnnnnnnnnnnnnnnnnnnnnnnnatcgttaccttttttccaatgatatttatattagtatttagccctactgggccgatcgaggcaactacactagtggactggtcgtggccacatgaacccctctatggtttatgctccttaatcgatataagagaatctaatgggtataaataaacttttctttacaagaaatagcgagtaattaaaccaatacaacgccgatagtgtaaagaaaacctaattgccaaaaacgaaaggccttgtttcttgcaaaatagcctattgacaattagctacgaaagtttccttccgctgacaagtgggacattattatgacgactggtcattacggacaacgcaagagccctaatatgacccattacattaagactttgcgatggcatttatggcaagttttctgc

SEQ ID NO: 19890 - DNA, 616 bp, Diabrotica virgifera
caaatttttcattataaaagataaagacgctctcgaactcaaatgaactccgtgaaaaatataagaataacatccaaattcttatcctacggtcctggaatcacaaatcttgtaactacggactgtagcacctgcacacaaccccagaaatagaaaaggcgcgtaccttccccctaccgaacttacaaagatagtgagcacccaaagctaggaacctcccaccactcttaacgaacgcggacgtcgctactgacctggacatatcgcttgctaaaagaaactccccgagcctactaccaggcatgaaagcaactccgaaacaggagcaccccagacaggaaaataacgatgtgattgggagacaactcaaagaggacatgtcaaacgccgtacacaaattgttctaaataaaaatactatacccttacaaccaatattatggaacataccgatgaggaatttgagacttcgatagagttccatcccaaataaagcaaactcctcatactgacagaaatgaatgagtagagacgcaaagaataccgaatataataaaagccaactggggcaccacccaccctccatctttgtagaagccctaatgcccgaagtggat

SEQ ID NO: 19891 - DNA, 928 bp, Diabrotica virgifera
  misc_feature (59)..(80): n is a, c, g, or t
  misc_feature (398)..(415): n is a, c, g, or t
acgtcgcattggcacgcgttacgtaaagctttgggattccttctacgtagcaggccggnnnnnnnnnnnnnnnnnnnnnnaacaatgaattataattttcattagatcaaaggtcaaatatacataaaatcataaatattggagggtataacagttctttcataacacaaaaataaaactttgagcctatacattacattaacatcatttaaggcacttatttggtatagataaaacatatatgtacacatttaaataaaaacatgccaaaaaacagtaaaatccagataaattcattcggctttaacatttatttaaaaccgtagtttgggtaaaggtacagtaacacagaatcaatattttgtttgctactttgtacaagcagacgtttgagattnnnnnnnnnnnnnnnnnncgttatacttagtctttttttttgatacaagatattgtcgcaattacataaactaggtattagagttccaaaaggcagcagctttcctaaaactgtcactcttcggtttatctttgttattcacagtaggagattgctgatccggaacatacttgccatgtttactaacatagtactcgttgctttgttccttagcaataacggcttgagtcttcctcagtaaagaacggggaaggacttctgaaccttacggtaggagaagctgctgagagagtgttgagtttctcgttgctggagagtttttctttgatctgttctacacgcgacgtatgcgtgctggtctttttaaatgtagaagttgtatggatgctggtaactccattgccgtttggtttgagtgttctgtggttttgttcggttttgagagggggtggtttgtccgtcgtgtcgcgggtgtcgaattttttaatcgttcccgccacagttctcgatgtgtagatgggtaaccttttc

SEQ ID NO: 19892 - DNA, 817 bp, Diabrotica virgifera
  misc_feature (11)..(33): n is a, c, g, or t
  misc_feature (224)..(296): n is a, c, g, or t
  misc_feature (302)..(367): n is a, c, g, or t
  misc_feature (385)..(403): n is a, c, g, or t
  misc_feature (412)..(426): n is a, c, g, or t
  misc_feature (428)..(444): n is a, c, g, or t
  misc_feature (447)..(465): n is a, c, g, or t
  misc_feature (480)..(500): n is a, c, g, or t
  misc_feature (589)..(618): n is a, c, g, or t
  misc_feature (638)..(687): n is a, c, g, or t
  misc_feature (692)..(772): n is a, c, g, or t
  misc_feature (774)..(795): n is a, c, g, or t
ccctttcgtannnnnnnnnnnnnnnnnnnnnnngataaaaaccaacctggctcaccccggtttaaactcaaatcatgtaaaattttaaaagtcgaacagacttaataatatagctgctaccccaattataaactttaatccaacatcgagggcgcaatctttattatcgatttgaactctccaataaaattaccctgttatccctaagggaatttattcttatnnnnnnnnnnnnnnnnnnnnnnnnnnnnnnnnnnnnnnnnnnnnnnnnnnnnnnnnnnnnnnnnnnnnnnnnncccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagggggcaggcgagactttatatttaatacaaaaagacatnnnnnnnnnnnnnnnnnnnnnnnnnnnnnnccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnntaatcctaatttttatttaaaa

SEQ ID NO: 19893 - DNA, 682 bp, Diabrotica virgifera
  misc_feature (9)..(45): n is a, c, g, or t
  misc_feature (112)..(134): n is a, c, g, or t
  misc_feature (454)..(473): n is a, c, g, or t
  misc_feature (482)..(501): n is a, c, g, or t
ccaggaccnnnnnnnnnnnnnnnnnnnnnnnnnnnnnnnnnnnnncaaaaacctaaaaaaaaggcttacaaaaaaggaaacaagggtggggaaaaacccagcctatgggaannnnnnnnnnnnnnnnnnnnnnncggttattctttctagaaagggaggaggggagggagcccaaccaaagaaagggaaacctttattggaaaaccctaaattatcttttttcatttgaccaacccccctttctaaacccccaaatttccctaaatccccaccaaagcctccacctggaaatccaaactttctaaaaaaccaagcctttaggaagttaaaaactgttttatccggcttcttaacttactgcaatactacaaaaagccctaccagaacgggcctaactttaacaaacccaaaaccttcgaataagggtccgaccttaaatataacaaaaaacccnnnnnnnnnnnnnnnnnnnntaccctgcnnnnnnnnnnnnnnnnnnnnaagggggctggggacccaaggccccatttcgggaaaaaatactgctaggatttcttcttttttgcttccggacccatcacccttaggcaaaaatgaatcaaacaacccaattctttttgatttaaataacccataaaaataggcgttactatgaaaaaatcttttggacccttctactaca

SEQ ID NO: 19894 - DNA, 456 bp, Diabrotica virgifera
  misc_feature (86)..(99): n is a, c, g, or t
  misc_feature (101)..(113): n is a, c, g, or t
  misc_feature (164)..(164): n is a, c, g, or t
gtgtgttgtttattggttgctccataaaaaagatggaagtttttagatatgaatagaaaaagttgtttaaatggattgaaattatnnnnnnnnnnnnnntnnnnnnnnnnnnnagaatttaaaaggagagaaaaaaggaaaagggaagagagagaggaaaggangagtaagaggaaagagagatatgatgagattataaatagggttaatggagtttgataggtggggagggatgtggaagtaaggatagggggagtgtatttgtaatatgaaaggaggaaaagtagaaaataaattgttgtagaaaggggaaaaggtgtataggagaattggttgggaagaagatgtaaaggaaaatgggtagtggagtgaagaaaaaggatgagaaggagatatgagattaattagaaggaagtaggaagtgagggataaggatatgggggtgtggaagaaagg

SEQ ID NO: 19895 - DNA, 535 bp, Diabrotica virgifera
  misc_feature (4)..(34): n is a, c, g, or t
gggnnnnnnnnnnnnnnnnnnnnnnnnnnnnnnnttttaatctaaaaccccttccttcatcctcactagtactttcgtcaaatttatcagaataagatattaatactcgatcctacgattcgggaagcattaatcttgtctccaggtttgctttccctgcacaccttcctcgatactgagaaaactctgaccatctctataccatccttccaaacaagaccgaccctatgttttcaatttaacatcaccaataaccaacgccgatggtcccactgacttcgatattgtgctgcctgagaagaatcgcctatcatgccgtcatcttgaaaagaaactctgaaaccggtgcttcactgatatgtgacattagatttgctctcgtgactcctcaagatgtttgtctctgacgatacatttactttgctatctaaagctacaataccattcaaatccgtattatgctacttttctattatgtgtttgagatatcgataggatccatacgcaaactgatacctcatccttttgactgaac

SEQ ID NO: 19896 - DNA, 582 bp, Diabrotica virgifera
  misc_feature (16)..(148): n is a, c, g, or t
  misc_feature (151)..(203): n is a, c, g, or t
  misc_feature (214)..(250): n is a, c, g, or t
  misc_feature (261)..(281): n is a, c, g, or t
  misc_feature (300)..(325): n is a, c, g, or t
  misc_feature (328)..(340): n is a, c, g, or t
  misc_feature (365)..(407): n is a, c, g, or t
  misc_feature (415)..(440): n is a, c, g, or t
  misc_feature (470)..(482): n is a, c, g, or t
  misc_feature (484)..(496): n is a, c, g, or t
  misc_feature (537)..(561): n is a, c, g, or t
  misc_feature (564)..(581): n is a, c, g, or t
tccccccccctttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnccccccggggnnnnnnnnnnnnnnnnnnnnnnnnnnnnnnnnnnnnnccgggcccaannnnnnnnnnnnnnnnnnnnnaaaaatcccccaaaaaaannnnnnnnnnnnnnnnnnnnnnnnnnaannnnnnnnnnnnngattttccccagaaaaaagggaggnnnnnnnnnnnnnnnnnnnnnnnnnnnnnnnnnnnnnnnnnnnagatgttnnnnnnnnnnnnnnnnnnnnnnnnnngggggaaaggggggggaaaatatttccccnnnnnnnnnnnnncnnnnnnnnnnnnncccgggaaaaaaagggggaggggccccccccattttctccnnnnnnnnnnnnnnnnnnnnnnnnntannnnnnnnnnnnnnnnnng

SEQ ID NO: 19897 - DNA, 626 bp, Diabrotica virgifera
  misc_feature (184)..(249): n is a, c, g, or t
  misc_feature (289)..(306): n is a, c, g, or t
  misc_feature (308)..(428): n is a, c, g, or t
  misc_feature (435)..(473): n is a, c, g, or t
  misc_feature (538)..(560): n is a, c, g, or t
  misc_feature (596)..(620): n is a, c, g, or t
gtattcaaataatcaaagtcttcgcctcagcccactcgatctaatctcagaacgagccagcaggtattcttcagaccgtagctcaagagtaagcatcaatccattcaggtttttcttaatcagaaagctcggaaacggaaggagttcggatcgaaataaaaaactcgtctttcattcaattttnnnnnnnnnnnnnnnnnnnnnnnnnnnnnnnnnnnnnnnnnnnnnnnnnnnnnnnnnnnnnnnnnncagagttttatcaaaattcattaatcaagtttttttcagnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnnntgcgacctcgatgttggattaaagtttataattggtgtagcagctaattattaagtctgttcgannnnnnnnnnnnnnnnnnnnnnnattttaaaccggtgtggcccaggttggtttctatcnnnnnnnnnnnnnnnnnnnnnnnnngaaagg

SEQ ID NO: 19898 - DNA, 691 bp, Diabrotica virgifera
  misc_feature (11)..(33): n is a, c, g, or t
  misc_feature (224)..(297): n is a, c, g, or t
  misc_feature (302)..(367): n is a, c, g, or t
  misc_feature (385)..(403): n is a, c, g, or t
  misc_feature (412)..(426): n is a, c, g, or t
  misc_feature (428)..(444): n is a, c, g, or t
  misc_feature (447)..(465): n is a, c, g, or t
  misc_feature (480)..(500): n is a, c, g, or t
  misc_feature (638)..(687): n is a, c, g, or t
gcctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagggggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 19899 - DNA, 454 bp, Diabrotica virgifera
  misc_feature (2)..(24): n is a, c, g, or t
  misc_feature (119)..(137): n is a, c, g, or t
  misc_feature (392)..(406): n is a, c, g, or t
gnnnnnnnnnnnnnnnnnnnnnnntattttctattttccgatggttcatactgctgtgcagatgatatagcctgatacttttgagattacatccgagacaacagtttaggctcataggnnnnnnnnnnnnnnnnnnntgacctctgttgcgcacgtctagaatactatctatttcttttcggctttttatgaccggctctgctcgctcacaggcccagctgttcgacctagggatgttcctcgggactacgtctgccgcgcgtttctcctatgtcgtggaccttttagcgttccattggtggatgtggcctggtgaggtccttcgccaccgcggggcttggggggttataaccggacactgccgggatccccgtacttgatggcttggggannnnnnnnnnnnnnncgtccctgaccactttttggtctgttattttctcgccgggactactgg

SEQ ID NO: 19900 - DNA, 689 bp, Diabrotica virgifera
  misc_feature (99)..(145): n is a, c, g, or t
  misc_feature (244)..(263): n is a, c, g, or t
  misc_feature (302)..(325): n is a, c, g, or t
  misc_feature (327)..(341): n is a, c, g, or t
  misc_feature (344)..(372): n is a, c, g, or t
  misc_feature (524)..(543): n is a, c, g, or t
  misc_feature (584)..(604): n is a, c, g, or t
  misc_feature (624)..(647): n is a, c, g, or t
aaattggggaaaagggttattgatcccgaattcaaagaaaagggaaaacattattaaaaatgaaccccacttaggaaaaaacccaaaactaaaaacccnnnnnnnnnnnnnnnnnnnnnnnnnnnnnnnnnnnnnnnnnnnnnnnccccccggaaaacaaaaatcaatccccaaaaaaagggtttgatcagaaaaacaaaattgcatcccatctaaaaaaaacaacaaacttgatttctttccnnnnnnnnnnnnnnnnnnnngggcattttgccaaaaaacggttaggaaaaactaatttnnnnnnnnnnnnnnnnnnnnnnnncnnnnnnnnnnnnnnnggnnnnnnnnnnnnnnnnnnnnnnnnnnnnntaaaccaacattctgctatgttagccccccccaaaatgaaaattaagaatttcatatatgggaaaaaaacctacatgaaaaattggaatttatacaactaagtcggtttccaaaaaatttcaaactattttataaaaagctttacccaaacnnnnnnnnnnnnnnnnnnnngttatagccctgacccaaaggacttacttctttaaaaaacnnnnnnnnnnnnnnnnnnnnngcttacagtctaaactcccnnnnnnnnnnnnnnnnnnnnnnnncccttacattacacatcataaagttacatcttatcatgttat

SEQ ID NO: 19901 - DNA, 833 bp, Diabrotica virgifera
  misc_feature (22)..(43): n is a, c, g, or t
  misc_feature (50)..(78): n is a, c, g, or t
  misc_feature (420)..(437): n is a, c, g, or t
  misc_feature (487)..(509): n is a, c, g, or t
  misc_feature (512)..(524): n is a, c, g, or t
  misc_feature (736)..(736): n is a, c, g, or t
gaaaagaacaaactttaatacnnnnnnnnnnnnnnnnnnnnnnataaagnnnnnnnnnnnnnnnnnnnnnnnnnnnnnctaataatatagtgctccaccgtagaccgatgagtaggggccgtagaccgctcccccatatccaagtccataggctgagctcggcgtagccggtgtacgctgaaggatagtaccccgaatatcctgcagaataggctaaaggtgaataagcgtactgcggtacaggagcgggaatcggtcctggagcaggggcgcacattcctaaggcgaagaaacagactagaacgatctggaagaaataaaacttacaattatctgatatattttttacttctatgctttgtaaacaggtcaaagtttatttgaggtgaaaacttgcaaaaatcagtaaataaagggttnnnnnnnnnnnnnnnnnngtatatagctatctttctgtaatgtatatagacattctgtgagatttcgnnnnnnnnnnnnnnnnnnnnnnngcnnnnnnnnnnnnngatacaacgattttaaactaagcaatgcaatcactaacaggaaccaacaaagccaatcaaattgaccatatcatcgtcttaaaaagtggtaatagacataactaatgtcagaacgtagcgtggggcgaaatctgactcagatcactatcttcatcatccaaccaattcacgtccagtgctggacataggtctcccccaattgtttccacacnttcacggttttgtgctgattgttgccagtttttactaatccgcctgatatcatctgtccatcgtgtaggcggccttcctctactgagtttatcttct

SEQ ID NO: 19902 - DNA, 810 bp, Diabrotica virgifera
  misc_feature (40)..(67): n is a, c, g, or t
  misc_feature (340)..(352): n is a, c, g, or t
  misc_feature (355)..(414): n is a, c, g, or t
  misc_feature (419)..(484): n is a, c, g, or t
  misc_feature (502)..(520): n is a, c, g, or t
  misc_feature (529)..(543): n is a, c, g, or t
  misc_feature (545)..(561): n is a, c, g, or t
  misc_feature (564)..(582): n is a, c, g, or t
  misc_feature (597)..(617): n is a, c, g, or t
  misc_feature (757)..(806): n is a, c, g, or t
cacggcggtacggtaaggctcgggatcctccacgtggcgnnnnnnnnnnnnnnnnnnnnnnnnnnnncttatcctaaatataaaaattatctttatatatttcggtcctctctcgtactaaaatatcattaataaattaaagaatagaaaccaacctcggctccacaccggtttaaactcagatcatcgtaaaattttaaaagtcgaacagacttaataatatcagctcgctacaccaattataaactcttaatccaacatcgaggtcgcaatctttattatcgatttgaactctccaataaaattacgctcgttatccctaaggtaatttattcttatnnnnnnnnnnnnncgnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacattgtttttaataaacaggtgaaaaaaatggttgccgaattcctttattaaacnnnnnnnnnnnnnnnnnnnnnnnnnnnnnnnnnnnnnnnnnnnnnnnnnnttac

SEQ ID NO: 19903 - DNA, 795 bp, Diabrotica virgifera
  misc_feature (6)..(28): n is a, c, g, or t
  misc_feature (221)..(294): n is a, c, g, or t
  misc_feature (299)..(364): n is a, c, g, or t
  misc_feature (382)..(400): n is a, c, g, or t
  misc_feature (409)..(423): n is a, c, g, or t
  misc_feature (425)..(441): n is a, c, g, or t
  misc_feature (444)..(462): n is a, c, g, or t
  misc_feature (477)..(497): n is a, c, g, or t
  misc_feature (635)..(684): n is a, c, g, or t
  misc_feature (689)..(790): n is a, c, g, or t
tcgtannnnnnnnnnnnnnnnnnnnnnngatagaaaccaacctcggctcacaccggtttaaactcagatcatcgtaaaattttaaaagtcgaacagacttaataatatagccgctacaccaattttaaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatc

SEQ ID NO: 19904 - DNA, 797 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (688)..(794): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncct

SEQ ID NO: 19905 - DNA, 474 bp, Diabrotica virgifera
acgattagttatgatgcaattacttgccccgataaaaaatatttctttctatacatatataacataaataagaatataattaggggatataacatcgtaaaattactgatggctagataattccctaggggcttatgaattatgagctagacgaggtgaccactaggcaaacaacatgactaattggttataatgcttcacttgattgaatggtttattatatctatgcggtggacatatcaggggccggggttctcgaatattggtctgaggagccacctatgttgcacgatgccaaggaaagtacaggagaatcccacgatccaaaaaagtactctttccttgaatttgcacggtggcgcttcatcctgactgaccattgcagatcgggggatgctatcgtttgtgagatgagctccagacgggctgccacaggatggtagcttcggacctagagtcgcagggccaccagtt

SEQ ID NO: 19906 - DNA, 348 bp, Diabrotica virgifera
  misc_feature (8)..(27): n is a, c, g, or t
ctctgtgnnnnnnnnnnnnnnnnnnnnatgtaagaaaatgggacgacgcacaacattatggacgcttctgtcccatacaaatctctgtgtgactcacgctttctataaaattagaattagttattagtcaaagcaagtgtatggatgtgcgtcgtgcggacataatgaccgcgaggtctcttataatggtctggatactggggtacttcgaatatgtaagcctcgactgggactgccttatgcaggccgcacttgcggagaaaggacagctccctgcgccttgcttcgggagagaagccctgcaccatgtacagtgcttatgtaagtggtatgatacactaattattc

SEQ ID NO: 19907 - DNA, 941 bp, Diabrotica virgifera
  misc_feature (11)..(11): n is a, c, g, or t
  misc_feature (57)..(120): n is a, c, g, or t
  misc_feature (126)..(148): n is a, c, g, or t
  misc_feature (342)..(415): n is a, c, g, or t
  misc_feature (420)..(485): n is a, c, g, or t
  misc_feature (503)..(521): n is a, c, g, or t
  misc_feature (530)..(544): n is a, c, g, or t
  misc_feature (546)..(562): n is a, c, g, or t
  misc_feature (565)..(583): n is a, c, g, or t
  misc_feature (598)..(618): n is a, c, g, or t
  misc_feature (756)..(805): n is a, c, g, or t
  misc_feature (810)..(918): n is a, c, g, or t
  misc_feature (926)..(926): n is a, c, g, or t
cgcatggcacngcgtacgttaaagctttgggattccttctacagtaagcaggccggnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctcggctcacaccggtttaaactcagatcatcgtaaaattttaaaagtcgaacagacttaataatatagctcgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaattnttattaaaaattaaa

SEQ ID NO: 19908 - DNA, 798 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(668): n is a, c, g, or t
  misc_feature (670)..(683): n is a, c, g, or t
  misc_feature (688)..(785): n is a, c, g, or t
  misc_feature (791)..(791): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnncnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattnttaatcc

SEQ ID NO: 19909 - DNA, 651 bp, Diabrotica virgifera
  misc_feature (34)..(61): n is a, c, g, or t
  misc_feature (331)..(404): n is a, c, g, or t
  misc_feature (409)..(474): n is a, c, g, or t
  misc_feature (492)..(510): n is a, c, g, or t
  misc_feature (519)..(533): n is a, c, g, or t
  misc_feature (535)..(551): n is a, c, g, or t
  misc_feature (588)..(608): n is a, c, g, or t
cacggcgtacgtatggctcgggatcctctcgtgnnnnnnnnnnnnnnnnnnnnnnnnnnnnctttcatctaaatctcaaaaattaattttatcatcattcgggtccttttcgtactaaaatctattaataaattaaagatagaaaccaacccggctcacaccggtttaaactcagatcatcgtaaaattttaaaagtcgaacagacttaataatatagctcgctacaccaattataaactttaatccaacatcgaggtcgcaatctttattatcgatttgaactctccaataaaattacgctcgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngacacgtttttttttcatccaacccttcattccagcnnnnnnnnnnnnnnnnnnnnnttatgctaccttagcacggtcaaaataccgcggccattcaaat

SEQ ID NO: 19910 - DNA, 317 bp, Diabrotica virgifera
  misc_feature (86)..(103): n is a, c, g, or t
  misc_feature (287)..(306): n is a, c, g, or t
gttcggtggctttctcactaaaatcgtgtccttatatgagggatagataactgcgtggctcaccccgggtaagactcagattttgnnnnnnnnnnnnnnnnnnacatattgtgtaacatgtgctgatactccagttatgttctttaatccaggatggggggagtggtctttcttatccttttggactctccaataaagaccctgtgttttccatagggtatttgtactcttatattctaaaatgagggggtcggaaaattatttattcatatattgaaatgagaaannnnnnnnnnnnnnnnnnnnggccccattta

SEQ ID NO: 19911 - DNA, 416 bp, Diabrotica virgifera
  misc_feature (8)..(30): n is a, c, g, or t
gagggggnnnnnnnnnnnnnnnnnnnnnnngttcagttatatatacgattttttgtcactataacggatccttcttactataattgattaattaaataagaatagatgtcgaccggtctcccacggagacctactgatatctagtaattttctaaggggcgaagaaactatgtactatggtaggtgcgacttaagctaacaacatgcttaatcggtttcaatacttcacttgactgaatggtgtattgtatatatacggtgtagttggcagtatggaaggtttttgcagatgcgtctaaggagcgcgactatgttttacaattccaagaaaaagacaggaaaagctaagtataccttatatactcactcattgaattttcttattggcgaaatatacgtactgccaataacagttc

SEQ ID NO: 19912 - DNA, 402 bp, Diabrotica virgifera
  misc_feature (39)..(76): n is a, c, g, or t
tgcgcgcgcacgtgatcgtgtattctctagagggcgcgnnnnnnnnnnnnnnnnnnnnnnnnnnnnnnnnnnnnnnaattttatgtaagggaaccgtacgacgcaacaacatacttgaacattgagcgacataccaatctctgtgattactcacgttttctataaaaatatatttagttattattcaaagcaagtgtatggatatgcgtgcgtccgacattgacacggaaatcctacaagaacggaactgggtactgcgaaatgaggcctaaactggaactgccatatgaagctagcacttgcggagaaaggtcatctccctgcacaatgcttcggaagagaagctcagcaccaagtacaatgctatgtaagcggtaagatacactaattagtctgcccaac

SEQ ID NO: 19913 - DNA, 898 bp, Diabrotica virgifera
  misc_feature (276)..(295): n is a, c, g, or t
  misc_feature (392)..(412): n is a, c, g, or t
  misc_feature (589)..(610): n is a, c, g, or t
aacaaatactctcttttattacacataaatattaacgccacacgaaattgtcataaaatagacaaccaacatcgagtcacagatatatcgaaaataacgtcataggcaggcagtaagcctcgtaccataataacaaaagttaaacttagtgaaaacaatataaataaatatcgcttacttactacgtaaaggaaactcagactgaagaaacattatattcaaacatctctgttgcagaatttcatttttatatcctttaatatttcagctatattnnnnnnnnnnnnnnnnnnnngcaggatatgcatagatcataaagcgtaccatttttatttcaaatttgatgttgaatggtacctggtcaaagaatcaaaatttgtttcacaaaatgnnnnnnnnnnnnnnnnnnnnncgtacgtagtagtaggttttatttcctgtttgctgttcatagtaccaatagtgttatcggtactttcattttggtgacaaattcagtaccaccatactttcctatttaaaaaatgcaaattaaaaccttaaacgaacctctcgtacattatgaatcatttttacgagtaaatgtctnnnnnnnnnnnnnnnnnnnnnnttagatgtcatagaaattttgatttatgcaacacaagtcaacaaaagaagcaattattttcgttataaggcagctaaaacaaaatataaggatacaggaacaattatggtttagataaaacatacctgtaaagaagattaattttggtatggcgcaaggcacaaacagatggagccaaaaatgcttaaacacatcgaacgagaaattctaagaatatatggaggagcagaagacaaatatagtgcgtagccttatcacgaaaatatggggagaaaaaaatatgactaa

SEQ ID NO: 19914 - DNA, 870 bp, Diabrotica virgifera
  misc_feature (5)..(61): n is a, c, g, or t
  misc_feature (75)..(97): n is a, c, g, or t
  misc_feature (290)..(363): n is a, c, g, or t
  misc_feature (368)..(433): n is a, c, g, or t
  misc_feature (451)..(469): n is a, c, g, or t
  misc_feature (478)..(492): n is a, c, g, or t
  misc_feature (494)..(510): n is a, c, g, or t
  misc_feature (513)..(532): n is a, c, g, or t
  misc_feature (547)..(567): n is a, c, g, or t
  misc_feature (705)..(754): n is a, c, g, or t
  misc_feature (759)..(857): n is a, c, g, or t
  misc_feature (867)..(868): n is a, c, g, or t
gccgnnnnnnnnnnnnnnnnnnnnnnnnnnnnnnnnnnnnnnnnnnnnnnnnnnnnnnnnncggtcctttcgtannnnnnnnnnnnnnnnnnnnnnngatagaaaccaacccggctcacaccggtttaaactcagatcatcgtaaaattttaaaagtcgaacagacttaataatatagccgctacaccaattataaactttaatccaacatcgaggtcgcaatctttattatcgatttgaactctccaataaaattacgctcgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttttaanntc

SEQ ID NO: 19915 - DNA, 331 bp, Diabrotica virgifera
  misc_feature (17)..(136): n is a, c, g, or t
  misc_feature (160)..(201): n is a, c, g, or t
  misc_feature (272)..(298): n is a, c, g, or t
tcccccccccttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttttgtttctggattcttgannnnnnnnnnnnnnnnnnnnnnnnnnnnnnnnnnnnnnnnnntattgttttttccccccaacaggataaaaaaaaaatgggtggggggggctaaacaaaaaaacccacccctnnnnnnnnnnnnnnnnnnnnnnnnnnnggcgggggccctttccccccccggggggggggg

SEQ ID NO: 19916 - DNA, 661 bp, Diabrotica virgifera
  misc_feature (10)..(41): n is a, c, g, or t
  misc_feature (89)..(104): n is a, c, g, or t
  misc_feature (107)..(168): n is a, c, g, or t
  misc_feature (271)..(289): n is a, c, g, or t
  misc_feature (372)..(393): n is a, c, g, or t
  misc_feature (408)..(443): n is a, c, g, or t
  misc_feature (468)..(510): n is a, c, g, or t
  misc_feature (514)..(526): n is a, c, g, or t
  misc_feature (529)..(551): n is a, c, g, or t
aaaccccccnnnnnnnnnnnnnnnnnnnnnnnnnnnnnnnnaaggggtgggcaaaaaaattttggggggggttttaaaatccccccaannnnnnnnnnnnnnnnccnnnnnnnnnnnnnnnnnnnnnnnnnnnnnnnnnnnnnnnnnnnnnnnnnnnnnnnnnnnnnnttttgggtttttccggggggagaaaaagttcccaaaccttttttcaaagtttggggatccccaaaaaattcaaaacctttttgggggtcaaaattttccccannnnnnnnnnnnnnnnnnnttccggggggaaaattcaagggaaaaattgggccacaaaaaaggggggaaaaaggtttaaaaatccccccaaaaggggaaccnnnnnnnnnnnnnnnnnnnnnnttccccccctaattnnnnnnnnnnnnnnnnnnnnnnnnnnnnnnnnnnnnccccccattggttattttaagggannnnnnnnnnnnnnnnnnnnnnnnnnnnnnnnnnnnnnnnnnngggnnnnnnnnnnnnnggnnnnnnnnnnnnnnnnnnnnnnntcccttggggggggggggaagggaaaaaggggcccccaaaaaaacaaccggcccccccccaaatttggggggggtgccgggttaataaaacccgggggggcccccaaaag

SEQ ID NO: 19917 - DNA, 851 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(843): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatccc

SEQ ID NO: 19918 - DNA, 806 bp, Diabrotica virgifera
  misc_feature (626)..(642): n is a, c, g, or t
  misc_feature (683)..(702): n is a, c, g, or t
  misc_feature (782)..(782): n is a, c, g, or t
cccttctatttttaactttattttttacttctctccagcttagtcctattgattcgtgttcattccttacactcctcttccaagtattgcctgacctcccctttcttcgtgtacccaatggctcgtactcaagttcttgtttcgttacattgtttgaacctttcctaagcgtgtgaccaatccatttccatttccttctcattatagctttaaagacgtaccttacttatatcttgtttatcgtttttgtatgtttcagcagcgtatagtaatacgcagctgttaaaaactctaattttcgtgtttcttgttatctcgctggaactccaaattttagatagtgagttaaaggtccattgaggtttaattattctgttttgaacgactgtttttgtcccaccatctgtataactgctcctagatatgtgcatttttctgcttcttcgacttcttcctgatccagcttaattttgtcattttcttctaagatcgacttaaggatgtacataatgagaaggaaccgaagagaatggtgacaaatcttagagaaggtcaggatatacaaaggattgtcgagctagagatgttgatgatgacagatacgatgacgatcgcaacagtttacnnnnnnnnnnnnnnnnntagatatattaatttatgtaaaatttttaacgcctttaacnnnnnnnnnnnnnnnnnnnntatactaataaattttatctctcatccataaaaataatatcttataaacaattgttttatttaaatactacactatattnaatcacctgccatactcacatttt

SEQ ID NO: 19919 - DNA, 348 bp, Diabrotica virgifera
  misc_feature (7)..(30): n is a, c, g, or t
  misc_feature (266)..(310): n is a, c, g, or t
atctagnnnnnnnnnnnnnnnnnnnnnnnnggtcctttcgctctaaaatatatcaataaattaaatatagaaagcagcctgtctcccaccggaataaactcagatgatgtagtattttaaaggtagaacatacttaataatatagctgcgacaccaattataaacttgaatccgacatcgaggtggcaatcttgattatcgatttgaactcaacaataagattacgctgttatccctaaggtgatttattcttatcatcaggaaannnnnnnnnnnnnnnnnnnnnnnnnnnnnnnnnnnnnnnnnnnnntacatttatgaatgtatatacagactagtactcgcagt

SEQ ID NO: 19920 - DNA, 953 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(768): n is a, c, g, or t
  misc_feature (775)..(795): n is a, c, g, or t
  misc_feature (798)..(845): n is a, c, g, or t
  misc_feature (854)..(952): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnctattcnnnnnnnnnnnnnnnnnnnnnccnnnnnnnnnnnnnnnnnnnnnnnnnnnnnnnnnnnnnnnnnnnnnnnngtcttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 19921 - DNA, 691 bp, Diabrotica virgifera
  misc_feature (11)..(33): n is a, c, g, or t
  misc_feature (224)..(296): n is a, c, g, or t
  misc_feature (302)..(367): n is a, c, g, or t
  misc_feature (385)..(403): n is a, c, g, or t
  misc_feature (412)..(426): n is a, c, g, or t
  misc_feature (428)..(444): n is a, c, g, or t
  misc_feature (447)..(465): n is a, c, g, or t
  misc_feature (480)..(500): n is a, c, g, or t
  misc_feature (638)..(687): n is a, c, g, or t
ccctttcgtannnnnnnnnnnnnnnnnnnnnnngataaaaaccaacctggctcaccccggtttaaactcaaatcatgtaaaattttaaaagtcgaacagacttaataatatagctgctaccccaattataaactttaatccaacatcgagggcgcaatctttattatcgatttgaactctccaataaaattaccctgttatccctaagggaatttattcttatnnnnnnnnnnnnnnnnnnnnnnnnnnnnnnnnnnnnnnnnnnnnnnnnnnnnnnnnnnnnnnnnnnnnnnnnncccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagggggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 19922 - DNA, 797 bp, Diabrotica virgifera; identical to SEQ ID NO: 8964
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t

SEQ ID NO: 19923 - DNA, 957 bp, Diabrotica virgifera
  misc_feature (15)..(42): n is a, c, g, or t
  misc_feature (322)..(347): n is a, c, g, or t
  misc_feature (391)..(412): n is a, c, g, or t
  misc_feature (777)..(807): n is a, c, g, or t
  misc_feature (813)..(825): n is a, c, g, or t
  misc_feature (828)..(857): n is a, c, g, or t
  misc_feature (859)..(880): n is a, c, g, or t
  misc_feature (898)..(925): n is a, c, g, or t
ctctctagagggcgnnnnnnnnnnnnnnnnnnnnnnnnnnnntctagatataaaatattccttttataacgaggccctctcgctctaaaatataacaaaaacttaaatagaagacagagcgggtctcacatcggttgattctcagaaggtgattatattttaggggtagaacagacttactagtatagctgcgacaccaattatcaacttgactccagtcgtcgaggtggccatcatgattattgatttgagctcaacaaaatgagtacgctgttattcccgtggttgtttattcttataataaacactggtggatcaaacnnnnnnnnnnnnnnnnnnnnnnnnnnccaaagtgacattgattttttactcaccccaattaaataaatgnnnnnnnnnnnnnnnnnnnnnnctaaacatactaattaattttttaatagaagtctggtgggcccgcgcgtcttgaaaaaatattctcagcttcataacttaaaaattaaattctttatagataaatagagactgtttttgttctactccagacccttcattccagatgtgaataccaacgctaatgattatgctaccttagacacggtacaaataccgcggccattcacagtaagcagtggggaggcgagactttatatttaataacaagagacttgtgattaggtaaacaggtgagtagacgtgatgccggattccgttattaaacctctattaattatactaattattcaatattattaatacccactattaccataatgtacnnnnnnnnnnnnnnnnnnnnnnnnnnnnnnnactccnnnnnnnnnnnnnatnnnnnnnnnnnnnnnnnnnnnnnnnnnnnngnnnnnnnnnnnnnnnnnnnnnntacaactctttaatcccnnnnnnnnnnnnnnnnnnnnnnnnnnnnctaaaagtttcttctttgaaagccctgccctt

SEQ ID NO: 19924 - DNA, 729 bp, Diabrotica virgifera
  misc_feature (9)..(37): n is a, c, g, or t
  misc_feature (46)..(87): n is a, c, g, or t
  misc_feature (279)..(335): n is a, c, g, or t
  misc_feature (341)..(406): n is a, c, g, or t
  misc_feature (414)..(443): n is a, c, g, or t
  misc_feature (450)..(511): n is a, c, g, or t
  misc_feature (520)..(537): n is a, c, g, or t
  misc_feature (604)..(627): n is a, c, g, or t
  misc_feature (629)..(642): n is a, c, g, or t
  misc_feature (679)..(711): n is a, c, g, or t
aaaaatttnnnnnnnnnnnnnnnnnnnnnnnnnnnnngggcccctnnnnnnnnnnnnnnnnnnnnnnnnnnnnnnnnnnnnnnnnnngggccccccccggtttaaacccaaaccagggaaaattttaaaagccaaacaaacttaaaaaaatagcggcccccccaattaaaaactttaacccaaccccgggggcccaacctttattaccgatttgaaccccccaaaaaaattacccgggtacccccaagggaatttattcttaaaaccaaaaaaatgggnnnnnnnnnnnnnnnnnnnnnnnnnnnnnnnnnnnnnnnnnnnnnnnnnnnnnnnnncccccnnnnnnnnnnnnnnnnnnnnnnnnnnnnnnnnnnnnnnnnnnnnnnnnnnnnnnnnnnnnnnnnnnccctatannnnnnnnnnnnnnnnnnnnnnnnnnnnnnctttttnnnnnnnnnnnnnnnnnnnnnnnnnnnnnnnnnnnnnnnnnnnnnnnnnnnnnnnnnnnnnnttccccccnnnnnnnnnnnnnnnnnnggattatgctcccttaccccggccaaaaaaccgcggccattcaaattaaccagggggcaggggaaannnnnnnnnnnnnnnnnnnnnnnntnnnnnnnnnnnnnnggggaaaaaaaggttgccaaatccctttattaacccnnnnnnnnnnnnnnnnnnnnnnnnnnnnnnnnnctaatattacccccatta

SEQ ID NO: 19925 - DNA, 776 bp, Diabrotica virgifera
  misc_feature (5)..(26): n is a, c, g, or t
ggagnnnnnnnnnnnnnnnnnnnnnnttcccttggaagggactagttttggtaaattcagagagatttttcgacgctgtctcttcgtctattaggtgttcgctgagaactaaatttgtcataaatttggttttactgtggttcatttttagacctattgttgaacattcgttttctaattcttatagcatttgttgtgcttcacccagctcttccctgataagtaccatatcgtcggcaggtatataaacgcagatgattgcgcatttccccatctatttttattcctctattttcccactttagcattttaaaggcgcattcgaggaccattataaataatttaggtgagagtgtatcaccctgtctcacacctcacttgatatgtatttctctggtggtatcatgtaggtatacacgcattgtggcattctgttacaatgtttgtactaactttgtaaagcggtagtctattctactgttgttcagagcagttataatgctgtctagttccacggtggccatttctgttcctagtaacattttctctgttctttgtttcattggtcaaacttcactgccatatactcgcatatacttattgataatgtgaagaaactcttgattttataatagctcatatcaaaagactgagtaacgcattaatcaaaaaaatcttcaaaacattatcatcactttcagagtcatttgggtccatgtgtgctcatcttttagttctcattagttcatcttgtgctcttctaaatatctttttta

SEQ ID NO: 19926 - DNA, 283 bp, Diabrotica virgifera
  misc_feature (248)..(248): n is a, c, g, or t
gtgctgaatatttaaaatggttcaattaactattaagctattgggaaaaattaaacaggcaactaggaaatatcaacggctaggtttcagagacaatttaagaatctatgtacaaggtggaccaggtggaaacgggtatccaaagtgaagtaaataatgagggagaagaaataatattagccaaaggaggcactggaggccacagtaaaaatggttttttgggaaaccaaggacaagcctactcagtnaaacttgatttgaaagctattgctgatataggact

SEQ ID NO: 19927 - DNA, 132 bp, Diabrotica virgifera
  misc_feature (2)..(126): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttta

SEQ ID NO: 19928 - DNA, 814 bp, Diabrotica virgifera
  misc_feature (606)..(634): n is a, c, g, or t
  misc_feature (636)..(648): n is a, c, g, or t
  misc_feature (785)..(785): n is a, c, g, or t
aaacccctggaacaaaacctattactgcagtggtagatgaggcttctagacagatcattttttagagaatatactcatgatatattagagcgtcagaagataacaaatataattaaatcaccgtctaaagggactactcccgaaaaacctatgctggatctaatggatacaaattttgattctgagcaaaaaacattagaaaccacaaggtaattccggccatgcgataactgatacaccatgactcaggaagccctaacacgcgtggacaaaaagaagtgccagaggaaaacccagattgtctcacaggcataacgtttttacgaactggcgtactggattctatatatggtgaggaatttcaaaatttggctgtataacatggaggaagagctgtacatgctgtgtcaaaaaaggtaaattatctggtggttggggaggaacctggcccttcaaagctagactgagatagaggctttaaaatacccgaaataaatgaagatcaatttctggacttaattttaataaaatcaggtatgaaagcaaagtactatcacaaagattcgtcggattctggagtttttgaggaacatattgataatgacnnnnnnnnnnnnnnnnnnnnnnnnnnnnntnnnnnnnnnnnnntgccaagaaatgaagaaaaacattctaacaaaggaaaacgaagtgagagttcaccaaaagatatcaaaaagagttctatgaagaataaagaaaagcagacaaacggcaactcatcaaaacctgatactaaggaagtnaaaattgttacttctaaatttttcgacac

SEQ ID NO: 19929 - DNA, 1195 bp, Diabrotica virgifera
  misc_feature (790)..(902): n is a, c, g, or t
  misc_feature (938)..(1003): n is a, c, g, or t
  misc_feature (1030)..(1107): n is a, c, g, or t
  misc_feature (1116)..(1158): n is a, c, g, or t
  misc_feature (1166)..(1192): n is a, c, g, or t
ggcccggcccggaattcccgggccgcccctctcgcccgggaaactgataacagaattgtttagttcgaagatgttctcggtgtaccagcactgccatttttcccacaactgtaatatatcttgataatggcttggaggatccgacatgcgtctacaaatccatgagaccaggagtatgtgaattgggagatccttattatgatcccttctcatgtccttaaaatcaacatttcatgcatatgcagacatcggtgttgctagtatgtctaacgacatcaacatattgagatgttatggacttgactactgttacgagacagataaccaaagctacgatgaccctcatcttgtatcggcgtcggagtggtttaatatccggtatgtcctcctcgatctccttgaactacctggcatccgggacaaaactggtcctaaaccctcatgacagaagaagctacacattggtcctgtagataccattacggactagataaaatacgtgtgaagagaatccgagccggcgtcacggttaatgacttcgctgttggatggcgcgccgacgatgcacaagaggatatatattgggattgcttagtctatgagattcgataccgatgtaaccattctaacaggtgccaaacctgccctcagtactaggggtcacttctagttcgtacagccggaatattacgtgtactagcgagcatgcgacaatagcgtcgcgtcccctattgtaaaaccctgaggattttatccatcttgaccgcccattcgatattcgccatgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaaaaaaaacacaccccccctcctctcccccccnnnnnnnnnnnnnnnnnnnnnnnnnnnnnnnnnnnnnnnnnnnnnnnnnnnnnnnnnnnnnnnnnngccccggggtgtggtgttggggggggnnnnnnnnnnnnnnnnnnnnnnnnnnnnnnnnnnnnnnnnnnnnnnnnnnnnnnnnnnnnnnnnnnnnnnnnnnnnnngcaccaagnnnnnnnnnnnnnnnnnnnnnnnnnnnnnnnnnnnnnnnnnnnctaataannnnnnnnnnnnnnnnnnnnnnnnnnnggc

SEQ ID NO: 19930 - DNA, 1052 bp, Diabrotica virgifera
  misc_feature (2)..(857): n is a, c, g, or t
  misc_feature (863)..(918): n is a, c, g, or t
  misc_feature (924)..(951): n is a, c, g, or t
  misc_feature (989)..(1008): n is a, c, g, or t
  misc_feature (1024)..(1041): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgannnnnnnnnnnnnnnnnnnnnnnnnnnnnnnnnnnnnnnnnnnnnnnnnnnnnnnnctcccnnnnnnnnnnnnnnnnnnnnnnnnnnnntctaaggaaaaacccccaatttttttggggaggttccnnnnnnnnnnnnnnnnnnnngacccccaagttttgnnnnnnnnnnnnnnnnnngggggcccccc

SEQ ID NO: 19931 - DNA, 862 bp, Diabrotica virgifera
  misc_feature (614)..(635): n is a, c, g, or t
  misc_feature (737)..(737): n is a, c, g, or t
  misc_feature (746)..(746): n is a, c, g, or t
  misc_feature (799)..(830): n is a, c, g, or t
  misc_feature (856)..(860): n is a, c, g, or t
tgtgattgtgaaagaaaacattttcagataacgttaattatttatcttccactctttaatcaaagtatttcggaaaaactataatatatttgagattaaaatcggcaggaataaaagcatcggttaccttagcctttctcggttctatcggtacgacgtttgtgattttggcatcgtgctttacctcagtacaaattatggtggccatttttcgaggtactattctacattatggcaccgatacctactttagttgcaaaacgatacaacgatggctctggttctagcaatggttgtttggaagcgtccatatttgttacaatgggcatattagttagttcattcgccttaccaatagttctttcacgtgctgggaccatagctgcaggagcgtgctacttgactatagcaggaaatgttgtggtatacctgacattactaggatttttcctaactttcgatcaagatgattctgattacaacatgtggtaattcggtgtatggaaaataataatgatatcatagctcggataatttaagactgctgttaggtttcattgctgtacatagagaatcgaggattcaggaaaaaggaaaaagttgatttaagttannnnnnnnnnnnnnnnnnnnnnctgccaccatggaatcctacgtcaatgtgacagtatatttgaatatgtttgctaaacaaccaatttgttggttattttatgatactttcgaaaacagcttanatatcttanagtataaatatatatattaatacaatgtttagtattaatgatatggcttttgnnnnnnnnnnnnnnnnnnnnnnnnnnnnnnnncaaactacataaaagacataaaatannnnnaa

SEQ ID NO: 19932 - DNA, 929 bp, Diabrotica virgifera
  misc_feature (9)..(60): n is a, c, g, or t
  misc_feature (62)..(326): n is a, c, g, or t
  misc_feature (328)..(364): n is a, c, g, or t
  misc_feature (371)..(716): n is a, c, g, or t
  misc_feature (733)..(733): n is a, c, g, or t
  misc_feature (736)..(736): n is a, c, g, or t
  misc_feature (766)..(766): n is a, c, g, or t
  misc_feature (831)..(853): n is a, c, g, or t
  misc_feature (891)..(915): n is a, c, g, or t
ccacaatcnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnncgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttanttnggagagttcaaatcgataataaagatgcgnacctcgatgttggattaaagtttataattgggtgtagcagctatataaattaaagtctgttcgannnnnnnnnnnnnnnnnnnnnnnagttttaaaccgggtgaggcccaaggttggtttctatnnnnnnnnnnnnnnnnnnnnnnnnngtaccaaaaggacc

SEQ ID NO: 19933 - DNA, 288 bp, Diabrotica virgifera
  misc_feature (2)..(29): n is a, c, g, or t
gnnnnnnnnnnnnnnnnnnnnnnnnnnnngccgaggagggcctaatatattcaatgatgctagggcgtactgtgtatgatgcctacatactacagttcctagctccaacagtatggggaatgtatctatgtggtgtcttattgggtataggagcctctatgattaatactggatcagggcaataatttaactctaaactctactaagaagcccatcacccgagattccggaatattatgggcattacttcaactagaatgttagtagaaaaagaagcattttgtttaa

SEQ ID NO: 19934 - DNA, 856 bp, Diabrotica virgifera
  misc_feature (206)..(230): n is a, c, g, or t
atctgctcatttcgagtgtactttaataccagtcaacgacccagatcttaaagttgaatcggtaccacaacggacaaccaattttagataaaaacagaatcaaatctgtgtccgattttggtttcgttgttatggatatctcgtacattcaaaaccatgattcaggagaatatgtgtgcagagcttataacaaatatggtgaagannnnnnnnnnnnnnnnnnnnnnnnncacggaagaggtggagtatttacagacagtcttcaaccagaatctttggctaagattagagaattagaaagcatgcaaggtcaacatgcacaagcaccaagcactccggttactgaacctcctaaattcatcacacagattcaagacgtcacaaaacttgttgaaggacagagcgctcactttgaagcccgacttactccagttactgatccagatttggtagtcgaatggtattataatggtaaaaaactacctcatggccatagataccgcaccttccatgatttcggtattgttattcttgacattctttactgttacgaagaaaactcaggagaatacgaatgcagagcttacaataaatatggccaggactcgaccaaagccaatttgaaatgcgtatcaaagacgaatttaatcctggactcgcaactcccgcggggcatgggaaggtggtctagagaaaatacaaactctagaagatgctatgatacgaacacgagacgaaaaggaagacacaagggttggcaaagctcccgtattcactgttcctctatcaaacatcgatagcctcagagaaggtgaaaacgctcactttgaagccagactcataccaaccgacgatc

SEQ ID NO: 19935 - DNA, 893 bp, Diabrotica virgifera
  misc_feature (620)..(620): n is a, c, g, or t
  misc_feature (796)..(796): n is a, c, g, or t
ctagaagagagttcgtaaaaaatgtcaggatttgacgaaaatccttttggtgaacccaccatagacaacccttttgcagatccatctgtgcaacaagttgctagaaacacaaatgctcaacttcgagttgatgactacaacccttttgataatcaagtacaaaacccaaaaccggtaaattatggacaagcaaatagtggtccggcaattatgcaacctacacaagaaccaccagcttacaccagaagtggccaacaggcccaaaatgtcccaaagcctaccatagatacagcagaattacagagaagacaagaagaattagaaagaaaagagcaagaattagctcgcagggaagaagaaatgagaaattcgacatacaatgtacgacgtaacaattggcctcctttgcctgagcagtgttgctttcaaccatgcttttatcaagatatacaggttgatatcccactagaatttcaaaagattgtgagaaatctttactatctttggatatatcacggttctgttatgattttaaatataataggtggaataattctagaagattttaccgtcgtgggtttagggatactatactgtttgttatttactccattcggatnacttgtgttggttcagaccagcatataaagcatttcgttcggattcctcattcaatttcatggtatttttcttcatatttttctttcaatttgtaataactacaatacaaaccataggcatccctcattcgggcacaataggaattatcactgctcttgagacatttaagaatacnagcatggagtattgtccaaggaataatagctctaatatcgccataggatttggattagcagcaactgctgatttacttttgatatctaagatccatc

SEQ ID NO: 19936 - DNA, 551 bp, Diabrotica virgifera
ccacccccctccgccccggacactaatagcagaattgttagttcgtaagcatgctcttgtactacagcactgccctttattccacagcagtaaaagagtcttgcataatggctctgaagatgcgatatgctacgacaaagctatgtaaccaagagtatgtgaattgggagatcccttatcatgatcccttcttcatcctaaaaatgaacatatcatggcaagcagacatcggtgtagcaagcgtctctaacgacatcaccaccttgagatggaatggacttgacgactgtaacataactgataaacaaggtaatgatgaccctaatttagtagcagccttggacagctatcaatatatggtgcgttttctcgatctccgtcaactacctaccaaccgtgacagaactggtccttaaacatcatgacaaatgaaactacataatgcttcatgtagatcaccattacgtactgctaaaatatggtaaatagagatccaacccgacgtcatcgtgaatgacttcactgttgaatggcacgatgaattagtacat

SEQ ID NO: 19937 - DNA, 729 bp, Diabrotica virgifera
gcggggcattccccgcgcgcccctccgccgcggagggacaaatataatctatgatactcgggcgtctcgttgacgcttccgtccatccgctgtgcctagctcccattatatgtcgcatgaacctatcgtgagccatattgtgaagaagaacctgtattattaatactatttggagtcctcattgccatcgaaactctatccacaatctctataaccataaagtaccagcatatacatgcgcattgtttttgccaatgacgtgacggcataacgccgtacatatattattcataatgataatgccaaaatctgataaaactacattatgacgactatccacagagccttgaggtctgaagcataatacactgagtctacacaactacgtgcttgcctgagaccctgtctgccgagactaatttgcgcaggtaatatcagcaagaaggaatcacatgtcagcctccgctgcgccgcctgcactctcatcgacctgctgaagattttacgctgtgcatttctacttggagtggggacagaagttacagtacggcaaaacttttcagggtggacagtctatgtgattgaattcaaaagcattgcaaacctattcttgatcgaatagttgtacatatttttgtgctggcatgcattatggaaggagaagagcaaagaatgaagcataccctttactgatcgaaaaattaaccgaggcaatcatctcattagtat

SEQ ID NO: 19938 - DNA, 817 bp, Diabrotica virgifera
  misc_feature (803)..(803): n is a, c, g, or t
acacaatggatagacgtattaagctcgttttatttgcttttcgtactttacaccgtggaagctcaaaccgattattgtaaattaagttgtggtaatactttacagacggtgtgtgaaagaaaaaatgtgagctgcggagctcgctacagattgcaaaagtttcaaacaactaggattgagtgatgaagacagacgatacgtgttagaccttcacaacaaatacagaaataaagtggctctaggacaggaaaagacaggacctcaaccacaagcgtcgaatatgaaagctctgagttatagcaaggaactggaatatatagctcaatgccacacaaactcatgcaagtatggccacgacctatgtagaagaactcctgaatggggacatgtcggacaaaacatcgcattaaaaggaagataccatggagatattttgcctacacgagaatttatagattgggcgatgaatggtttttattccgaagttcgagactgggaccatcgtgggtttcttcatacgatgaccatggaaaagagataggccattatacaaatttagtgtgggctcgaacacgatatgttggctgcgggcttactttctacgtagatgagaataataatgatgtatattacctaacttgtaatttaatggagaagggggtaacattttacggattggtcagtggtacgaggtaggaccaccagctttcaaagtgtgatggtttgccaaaaaattcgaaatatccaggactatgtggacctgacaatctttagtcaactgtacacagcttaattgttttcanaattatcagttatt

SEQ ID NO: 19939 - DNA, 66 bp, Diabrotica virgifera
  misc_feature (2)..(51): n is a, c, g, or t
cnnnnnnnnnnnnnnnnnnnnnnnnnnnnnnnnnnnnnnnnnnnnnnnnnnccgtgagagaatcat

SEQ ID NO: 19940 - DNA, 924 bp, Diabrotica virgifera
  misc_feature (25)..(51): n is a, c, g, or t
  misc_feature (845)..(845): n is a, c, g, or t
  misc_feature (894)..(894): n is a, c, g, or t
tcagcgtcctgcggtacgcgttggnnnnnnnnnnnnnnnnnnnnnnnnnnnccaacactctccctctcatctatcaatagaaaaaattcgagaaaattattcatcgagccatcatctaccgaaataaaacagaactcctatcaattcctatcaaaatatcggtgctcaaataataacgaagagagtgcaagcagacatcacttttcgacaagatatttaaagattcaaatctttctatttatcaccttaaaaaaggatatcgtgtgacatctgtgtcagttataaagaaggaaatatttcagacgaaaaatataaagatcatattcaacgtaaatcaagagcaagagccgagaaagaacatcgacaaggaaaaagcacaagctcggtgaatttaatcttcttacaatggatcttgaagctcgtcaaagtgtgtccttatctgactgcaagtgccctctacttcaaaacgaagttaagttgtcacaactatacggtctacaatttggtcactcatcatgcaacatgctattggtttgacgaaactgccagtgacttgacagcaagcacatttgttaacttccttttagattacttgtcacaacactgtctcgccaacaggttacctatagtaatattttcagatggctgcacataccaaaatcggaataacattttgtctaacgcattatctgccttttctgtaaaatatcagatagttataacccaaaagttttttagaaccgggtcacatcaaaatggagtgtgactcggtccacagcgctatcgagactaaattgaagcatcgtgagattcatcttccgagcgattatgcttctgctactaangaagcaagaagtagccatttccgtatgaagtggaaattggttgactatncattttttaaaattacgcaaatgaggacac

SEQ ID NO: 19941 - DNA, 926 bp, Diabrotica virgifera
  misc_feature (11)..(588): n is a, c, g, or t
  misc_feature (590)..(925): n is a, c, g, or t
ccgtgagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 19942 - DNA, 385 bp, Diabrotica virgifera
  misc_feature (346)..(346): n is a, c, g, or t
ccccccccccccccgacttattcaacttaataatattgattatgaaagacgaatttttcttttcggatactcacccgatattgcaaatatctattttatacacaaatattctttgtacttggatcggaatgctaattcaattattattttcatttaatgacctacactcttggaacggacccgcagtccggccgaattccgggtcacccccgtcgttttttcctttgatattcaccgaaaagtacagacatcatcctgccaaaggagcaaaatgcaaagggagcacaatgggccccccctatcacgacacatgctctgatagcactacgtgtctatccatgctctngtcctggcacttatacacactcatcccacacacacaaag

SEQ ID NO: 19943 - DNA, 529 bp, Diabrotica virgifera
  misc_feature (329)..(355): n is a, c, g, or t
cactttatcaattccgaccaccctaagtgctgagcaccattatatgtcgcatcatgctctatgtagtaccattatgaagcataatttgtataaataaagctatttgaaggatggtttcgctgcaaaactcgattatcaatctgaaaacatcacgatactggaaagacatgcaactgttttaccctttgggatgacgccataatatagtacctatataattgataaggagaatgcaaaaaagcagcaacaatctaaattatgacgaccatcttcagagcgcatgaggcctaaactataatacactgaatactcaatacagaatgcctgannnnnnnnnnnnnnnnnnnnnnnnnnnaagagcagcaagatgaagcacatgaaaatctccaagcgccgactgcattctcatacacatgctgaagatatacctgcgcagtcttccttgaggtgtggacagaagatgaggacgacaaaagataacgcgggggacaaacgacatgagtgaaagaaaaagcactgcgaacctatt

SEQ ID NO: 19944 - DNA, 543 bp, Diabrotica virgifera
  misc_feature (96)..(110): n is a, c, g, or t
  misc_feature (504)..(519): n is a, c, g, or t
ggtggtacgcgtggaggcagcggggcggaatccgcgggtcgcctctcgcgtcggaggaacaaatataatcgataatacacgggtgtttcatgatcnnnnnnnnnnnnnnnttatagagagtttccattatatgtgctcgataatcctatctgtagggatattatgaaggagaaattgtattattaattctatttggagtcatgtatgtcaccgaaacgccttcggcaatcttagttccacaagtaccagcaatacatgcgattgtttttgcaaatgtgtgtgacagcataacgacgtacatatatcattgataatgataatcgcagaaatcatgagcagtctaaattatgacgactatcctcagagccttgaggactgaaggataatacagtggagtacacgcgtacgtggttgcctgagaccatgtctgccgagactcatttgcgcaggtaatagcagcaagacggatatcacatgaaagcctccatgcgccgcctgtactcnnnnnnnnnnnnnnnngattttacctcgtgcagttttcac

SEQ ID NO: 19945 - DNA, 113 bp, Diabrotica virgifera
  misc_feature (47)..(94): n is a, c, g, or t
  misc_feature (96)..(109): n is a, c, g, or t
aaaaataaataataacatcatttttatatcattattatcttttatcnnnnnnnnnnnnnnnnnnnnnnnnnnnnnnnnnnnnnnnnnnnnnnnncnnnnnnnnnnnnnnttac

SEQ ID NO: 19946 - DNA, 198 bp, Diabrotica virgifera
  misc_feature (7)..(44): n is a, c, g, or t
  misc_feature (71)..(71): n is a, c, g, or t
  misc_feature (80)..(100): n is a, c, g, or t
  misc_feature (110)..(132): n is a, c, g, or t
  misc_feature (155)..(155): n is a, c, g, or t
  misc_feature (167)..(190): n is a, c, g, or t
taacagnnnnnnnnnnnnnnnnnnnnnnnnnnnnnnnnnnnnnntgcgacctcgatgttggattaaagttnataattggnnnnnnnnnnnnnnnnnnnnngtctgtcgannnnnnnnnnnnnnnnnnnnnnnagttaaaaccgggtgagccaggntggtttctatcnnnnnnnnnnnnnnnnnnnnnnnncaaaggac

SEQ ID NO: 19947 - DNA, 686 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
tcgtannnnnnnnnnnnnnnnnnnnnnngatagaaaccaacctggctcacaccggtttaaaatcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 19948 - DNA, 936 bp, Diabrotica virgifera
  misc_feature (335)..(353): n is a, c, g, or t
  misc_feature (809)..(809): n is a, c, g, or t
  misc_feature (881)..(881): n is a, c, g, or t
  misc_feature (890)..(913): n is a, c, g, or t
cggacgcgtgggacattattttcattcgcattcataacgttcgtgtcaaaaaaggtacatcaccagctaagctaagcccaacaggctcgaatctaacaggatataacagagtgattcattaagaatcgttcattctctgagttgtagattatagactccaaaatattattttcattcgcattcataatgactaagattatttgaactttttctaatacttaaacttccactcgtgcttatagaaaaattgtccacagttccaaaacaccctataccttgaaataattcaaaatcggttactaaagaacaacaaaaacaccgatttgttattaacnnnnnnnnnnnnnnnnnnnaatagatggaaattctttcctgagaagtccttcaaatttatagttgaaaaattatccggatagcttaaaaactcaaacataatgagtaactttatcaactataccatattccctaatgttggacagcatgaaagcctcactatatattgaaacaacttactaacaagctcttttcaaggctcttctattagaataggtaccagaaaaattagatcttcagttcgaatttgtatattcacgtagaaagtataagctacgccaaaagccagctctaccaaggatactaaaagataacgatatcgaatttaaggaaagccactgtgtaacagaacaagatctccaaaaaagaggaaaataccaagctacgaactgctggatgctacctatcatcaaacgtataacacatctacattcataaaaaggaacatagaaacgcagaaatacttgtgtcttccnagaaatggaatgctgctcttttttactctttcacgcgctgtcaaacattacgaaatatttactagctattcngatatattnnnnnnnnnnnnnnnnnnnnnnnncgtacgagtactatttatatttt

SEQ ID NO: 19949 - DNA, 559 bp, Diabrotica virgifera
agtttggatatcaaatcactaacaatatgtatatgtggtgtgagtgtatgacgagcactttaagaatggctactatgtagtaggttgcaagattcctatagtggaagtactttgtagcgagatagaatttctactgcgagggctatgtggagggcgcaattcctaccgtgctctattctcaatctgagagcactaactacactgggatacatctcctcatggtgatgtccgtgtatagtaaaacatcaccacgttcatatattctttaatatactagaggaacaatactgcccatatcaccaacattacgaccacctacagagctgagaatctcaaagatatactccatgatctcccacatacatcgtaccaaaaaagactgtgcttcgatgacaaaattgcgcatatactatcattaataactgcatcatataactacactcatagtatcgtgctgtattttgcaagggatgttgcagatatagccagtgccttcttcccgggctgtgtttcgtcgatgttaatgagcgacatgacttgtccaggagacaatgaatgt

SEQ ID NO: 19950 - DNA, 654 bp, Diabrotica virgifera
  misc_feature (68)..(84): n is a, c, g, or t
  misc_feature (86)..(99): n is a, c, g, or t
ctctacgcgtccgaggttatattgatgtttaccgtttgcatgtcttcttaagttatgaattttgatgnnnnnnnnnnnnnnnnncnnnnnnnnnnnnnncatgttttcaatttgtcgacaaaaccatcctgctacagctgtagaacacgcaatatcatgttatttttttaacaaggtagaaaaatgtttggttacagcaggcgctaatgttctcaaaatatacagattagttcctgatgtagattctcgccttagatcggaaagatattctgaattttatcctccaaaatcgaagctagaatgtgtagctcaatacacactctttggaaatattatgtcaatccaaagtgtttctttgacaagttgtcaaagagatgcattacttttgggtttttcagatgcaaaactttctgtagtaaagtatgatcctgaaaatcatgacctaaggaccttaagattgcattattttgaacaataagatattacaggatggttggacacatcattatcatgatcccctattttctgtggatcccgaaaatagatgttgtgtatcggcactcttttctacaaaaatgccagaattacattttacaatgccgacttatataagattaacttgtcgtgaacgccaaaactttaataagtgaaacg

SEQ ID NO: 19951 - DNA, 483 bp, Diabrotica virgifera
tcttacgcggccgaaatgtagaatatcgggagagtggctcctttaaaaaacgatggagatgtggatgagatgaaggggaggatggtgggtgtgggagatgaagtttgttttgtctttagaaaaattggcatgattatgggggtttaaggttgtgcatgtggaatgagctgaccgttgtctgtatattgaatgtgtgtggttctggatgaggttcttttgtgatgggttgtgttctaaggttatgagctcggtggctgagaggttggtttgcgtgtatggatgtgttttgttttgtggatctgtagtcgagtgttatatcttggataggctgctttgtattgctgtgttttgcggcttctggtgataattgggtgggttgggtagctttgcgtggtgacggaggatatgtggctggtcgagagtatgttggtggtgctatggaagaattgggcttgatgtttttatggatggacgctgtgtggg

SEQ ID NO: 19952 - DNA, 699 bp, Diabrotica virgifera
  misc_feature (54)..(90): n is a, c, g, or t
  misc_feature (92)..(106): n is a, c, g, or t
  misc_feature (116)..(137): n is a, c, g, or t
  misc_feature (146)..(158): n is a, c, g, or t
  misc_feature (160)..(172): n is a, c, g, or t
  misc_feature (174)..(210): n is a, c, g, or t
  misc_feature (251)..(390): n is a, c, g, or t
  misc_feature (392)..(498): n is a, c, g, or t
  misc_feature (505)..(543): n is a, c, g, or t
  misc_feature (563)..(576): n is a, c, g, or t
  misc_feature (579)..(601): n is a, c, g, or t
  misc_feature (609)..(631): n is a, c, g, or t
  misc_feature (662)..(693): n is a, c, g, or t
acgatcaatcatctagtactaaaaaatcgtatcatcttagtaaaaatatcatcnnnnnnnnnnnnnnnnnnnnnnnnnnnnnnnnnnnnncnnnnnnnnnnnnnnncgtcttttcnnnnnnnnnnnnnnnnnnnnnncgcccaccnnnnnnnnnnnnncnnnnnnnnnnnnncnnnnnnnnnnnnnnnnnnnnnnnnnnnnnnnnnnnnncgaaagctcggaatcgaagggttggatcgaaaaaaaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggttggttnnnnnnnnnnnnnnnnnnnnnnnnnnnnnnnngaaagg

SEQ ID NO: 19953 - DNA, 612 bp, Diabrotica virgifera
tcaggtcgaagtccaaatatctaatgtctactgagtagtcagaatgtcctttaacatgggatcccacctgacggctagatgccaacgtacataactgtaccaggactaaggagttttcgtccgtttctgcggctatactgaattcttaaaattccacctaggattactattcgtagatctgcaaacgatagtttttagaattaatgaattacacatacccattatttttttatgcagatgaagtcttcacttttatataacattccgccgttaactatgctagaattggctatacgattggaagacagttatgtgagttgttattgcgaaagatctcgaacttgagctgatcaatggactgtacttcaacatttcttgatcttttcctcctacggggcgagtactgtccatcgtttcacatgaaagatgatcaatggtctctctctgtaactatgggaggaaactgaaactgaatttcgccagcatgtcacctccgctaatatatactgtgtcagtagactcctacgactcgctctggtgcgctcgcaccactgttggaacctctgctgtggtttaattataaataatgattgcaggtctcactgctgctga

SEQ ID NO: 19954 - DNA, 871 bp, Diabrotica virgifera
  misc_feature (12)..(45): n is a, c, g, or t
  misc_feature (49)..(613): n is a, c, g, or t
  misc_feature (645)..(670): n is a, c, g, or t
  misc_feature (725)..(751): n is a, c, g, or t
  misc_feature (766)..(850): n is a, c, g, or t
ttaaaagggtcnnnnnnnnnnnnnnnnnnnnnnnnnnnnnnnnnntagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttttttcaactgtttattagaaacatgtnnnnnnnnnnnnnnnnnnnnnnnnnngctgagttatgattaatttgaatggaagggtgattttgaaggtgctaagggtacnnnnnnnnnnnnnnnnnnnnnnnnnnnggaatgagagggttnnnnnnnnnnnnnnnnnnnnnnnnnnnnnnnnnnnnnnnnnnnnnnnnnnnnnnnnnnnnnnnnnnnnnnnnnnnnnnnnnnnnnggacttttaaaggttttttta

SEQ ID NO: 19955 - DNA, 912 bp, Diabrotica virgifera
  misc_feature (169)..(201): n is a, c, g, or t
  misc_feature (808)..(808): n is a, c, g, or t
  misc_feature (894)..(895): n is a, c, g, or t
gaaaattttacaaaaaaagcgtgagctgtcacgcccgagacaagtccgatccattgttgaaactccaccaaaaattcaattataccatctaaaaaaaattagtaaaaaaccccttataagtagtatagaacgtatgattactgagtgttaccaatctgtgtaagaagtnnnnnnnnnnnnnnnnnnnnnnnnnnnnnnnnngtgcttttgagtaaagttaaaagtgcctacgcgtttttctatattttcggaaaatatttgaatgatttcgcaataaattaggtgtctagcaaaaaggaaacgcacatctggaacaaacatccaaaaccaaaaccaacctgttgtgcatactattttagaaaaccaaagttttgctacataaaaactaaattgtacaaaaaactaatctccaatgaacaaaaatggcttgcagcaaatctaaaataacggtactacataatttggcctaacggtactacctaatcaaataaaaaataagtagaaaccgaaatcggcttcttaccagtatattagtaagtatcaaacgacacaacgacgtttcttaagtgcgacaatatcctgtgcttcctcaggggaggttgccatcaaactgaagaagcacgagcaagagtacgaccttctcattgtcgattacgagccttctctgatggagaactcggacgcagacgacgaaacaggttggaactgcagtgtccatcctagcgtattctttctcttaggaactctagtgctaacaacttgcgcaacgggaatgctttgcgcagccatcatgaccgacattgggagngaggtgacgtgggacaaaatgggtgtagatttttttgctaatagctcagtcagagtacagtggctgctggacagaactgttgctanngatatcacgaacgagcg

SEQ ID NO: 19956 - DNA, 116 bp, Diabrotica virgifera
  misc_feature (11)..(28): n is a, c, g, or t
  misc_feature (85)..(109): n is a, c, g, or t
ctcttctctcnnnnnnnnnnnnnnnnnnctcttatctctaacgatcagttaatctcagtatcgtgagagaatcatctttattttnnnnnnnnnnnnnnnnnnnnnnnnngtacctc

SEQ ID NO: 19957 - DNA, 385 bp, Diabrotica virgifera
  misc_feature (21)..(52): n is a, c, g, or t
ggtcccggcccggattccccnnnnnnnnnnnnnnnnnnnnnnnnnnnnnnnngtagtacgatttgttcataagagtaataaataggagctcacccgtttagacccacttgcggcgatacgcgcaatttatgaaatatgagaagaaaatgtataatgatgtctaatcccggatgtaaaggcgatcgtcgataacaccctagaaagcctttagatgtctctaaagaggtaccttcgactatggatacgaaaaattgcactactcatctgaggattatgtgattattaacaagaaatcttcatcaacctctttgccgatacttgtactattctgctgaggactctccgcatactgttacgtccacagctgtcccgatatcaccatttt

SEQ ID NO: 19958 - DNA, 653 bp, Diabrotica virgifera
  misc_feature (9)..(48): n is a, c, g, or t
  misc_feature (102)..(118): n is a, c, g, or t
  misc_feature (383)..(403): n is a, c, g, or t
  misc_feature (446)..(466): n is a, c, g, or t
  misc_feature (521)..(561): n is a, c, g, or t
gaaataacnnnnnnnnnnnnnnnnnnnnnnnnnnnnnnnnnnnnnnnncaaatgttcatattttaagatatggtattatatattcttatataatattattcnnnnnnnnnnnnnnnnnctcatcacacaacaagtgactcctcagatccgtaatgctctgttcggacgcaactgcaccacaaaatgcactgattagttattttttggtttctgtgaattccaagaatattatatggtatttgtaaagctctgatggttgcgtagacgggtatgatatatcttatttatctactatggatatacaatatctattatatgccattcattttatttgagtgtgttagatagtcaaagttccgttgctacccctaattggatcttgnnnnnnnnnnnnnnnnnnnnnaaactccttaaaaaactaataaaaaatgcgattaatctacccnnnnnnnnnnnnnnnnnnnnnggtataatattagtttcctatctgtttgaaagattaatttttttgaggtgaaaannnnnnnnnnnnnnnnnnnnnnnnnnnnnnnnnnnnnnnnnctggggggccgcaaataaaaaaatctaagttgggcgccccccggcccgaagacacccttctcttttaaaaaatataacatttaatcccctta

SEQ ID NO: 19959 - DNA, 52 bp, Diabrotica virgifera
  misc_feature (3)..(45): n is a, c, g, or t
ccnnnnnnnnnnnnnnnnnnnnnnnnnnnnnnnnnnnnnnnnnnngtacctc

SEQ ID NO: 19960 - DNA, 817 bp, Diabrotica virgifera
  misc_feature (2)..(18): n is a, c, g, or t
  misc_feature (20)..(753): n is a, c, g, or t
  misc_feature (756)..(756): n is a, c, g, or t
  misc_feature (766)..(815): n is a, c, g, or t
cnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaanatttttttannnnnnnnnnnnnnnnnnnnnnnnnnnnnnnnnnnnnnnnnnnnnnnnnngt

SEQ ID NO: 19961 - DNA, 829 bp, Diabrotica virgifera
  misc_feature (7)..(25): n is a, c, g, or t
  misc_feature (27)..(76): n is a, c, g, or t
  misc_feature (79)..(827): n is a, c, g, or t
atttatnnnnnnnnnnnnnnnnnnncnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncg

SEQ ID NO: 19962 - DNA, 1092 bp, Diabrotica virgifera
  misc_feature (2)..(51): n is a, c, g, or t
  misc_feature (54)..(820): n is a, c, g, or t
  misc_feature (822)..(891): n is a, c, g, or t
  misc_feature (893)..(983): n is a, c, g, or t
  misc_feature (1000)..(1017): n is a, c, g, or t
  misc_feature (1067)..(1088): n is a, c, g, or t
cnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggggataacccccnnnnnnnnnnnnnnnnnnaggttccaatccgataaaaaaaaaaatgtgggccccccccagttttgggnnnnnnnnnnnnnnnnnnnnnngggg

SEQ ID NO: 19963 - DNA, 645 bp, Diabrotica virgifera
ccgggggccggggcgggaatttccgggcgaccccccccgccccgcttattgggcggagtgttataaccttgcagactcataataatggttaatttatttagtgaatactacaaagaaaggtgagaagaaaagtcaactgttactcactcgctccatcaggaattatagtttgaagtgagagagattaaaagaccatgaagagaggcgatatggctgatgtactcttataatattggaaaggtaaccctatattcatggcatatatacatataacatgtatattttgttgatccgagggatctataaattcttcttacatgacattactcataatagtacgtcctcatgtgatagaattggtttggtctatcatgctctatccttctcccgacagaacaaggacataacagtgaagaacttaaatcaaaaaatcaaacacaagagtcacctttctcaagaaaccaccggatgaattgacctgcagatcatgagaaacaagatcaaaatcaacaatactctgaaaggacgtcatgagctcatcacacaacaattgattcccctgatccgttctgctctgttcggacgcgacggcaccagaaaaggcactgattagatattttttggatactgtgtattccatgaata

SEQ ID NO: 19964 - DNA, 447 bp, Diabrotica virgifera
gggacccccccacgccgcgcgcatgttgctacaggatcatctcatttattcctttcaaggaagtatcctattgctagaatgtaactcccgatccacgcgacatatttcgacatatattacaagttctcccatctctccgtgttaggggtagtagtgctcaaaactataagggtatacatccactacctgatgcatcccatatgataatagcggcaaaaccgatacggattccataggggtatcagagttcttccgtaggactagtggagtacacggatataaatatcaatgaattcctaacctcgatcaaacaatgtccacaaaaagagatatctcgtatcgcacctgccggtctggcccagacttggatagtaccggttgtgcactgtgctaggcccaagccagggaactcccgactaacaaggtctgtgttaccagatgaaacag

SEQ ID NO: 19965 - DNA, 543 bp, Diabrotica virgifera
  misc_feature (24)..(49): n is a, c, g, or t
  misc_feature (85)..(344): n is a, c, g, or t
  misc_feature (351)..(388): n is a, c, g, or t
  misc_feature (408)..(421): n is a, c, g, or t
  misc_feature (424)..(446): n is a, c, g, or t
  misc_feature (454)..(476): n is a, c, g, or t
  misc_feature (506)..(537): n is a, c, g, or t
atttgaacggccgcggtattctcnnnnnnnnnnnnnnnnnnnnnnnnnncgttttttcacgaaagccggaacgaagggtcggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 19966 - DNA, 165 bp, Diabrotica virgifera
atgatgtctactgagcagtagacgacacgtcttcaataaatagatgaagtagccgaattctttgtctctttttttcacccacatgaccgaaaaatccctacatttacgagtgctccttttttatattggaattgacggtcgtactcctttatgatgtcttctatt

SEQ ID NO: 19967 - DNA, 976 bp, Diabrotica virgifera
  misc_feature (2)..(18): n is a, c, g, or t
  misc_feature (20)..(778): n is a, c, g, or t
  misc_feature (783)..(803): n is a, c, g, or t
  misc_feature (815)..(870): n is a, c, g, or t
  misc_feature (883)..(909): n is a, c, g, or t
cnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatannnnnnnnnnnnnnnnnnnnngcttttttaagnnnnnnnnnnnnnnnnnnnnnnnnnnnnnnnnnnnnnnnnnnnnnnnnnnnnnnnnccctttttttccnnnnnnnnnnnnnnnnnnnnnnnnnnngaacccatttttttgaacttaaaaaaataaaatccccttaggggaaaacccccctattttttttttg

SEQ ID NO: 19968 - DNA, 770 bp, Diabrotica virgifera
  misc_feature (3)..(88): n is a, c, g, or t
  misc_feature (90)..(173): n is a, c, g, or t
  misc_feature (175)..(189): n is a, c, g, or t
  misc_feature (191)..(220): n is a, c, g, or t
  misc_feature (242)..(576): n is a, c, g, or t
  misc_feature (641)..(654): n is a, c, g, or t
  misc_feature (657)..(679): n is a, c, g, or t
  misc_feature (689)..(689): n is a, c, g, or t
  misc_feature (711)..(711): n is a, c, g, or t
  misc_feature (747)..(747): n is a, c, g, or t
cgnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncnnnnnnnnnnnnnnnnnnnnnnnnnnnnnncgcccaccgattaatttgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattgggagagttcaaatcgataataaagattgcgacctcgatgttggatnnnnnnnnnnnnnnggnnnnnnnnnnnnnnnnnnnnnnntgttcgactnttaaattttacatgatctgagnttaaccggtggagcccaggtggttctatccttattnattatatatttagtacgaaggac

SEQ ID NO: 19969 - DNA, 774 bp, Diabrotica virgifera
  misc_feature (15)..(46): n is a, c, g, or t
  misc_feature (54)..(702): n is a, c, g, or t
  misc_feature (704)..(772): n is a, c, g, or t
cgtgagagaatcatnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnag

SEQ ID NO: 19970 - DNA, 308 bp, Diabrotica virgifera
ccgggggaccccccccgcccgcgtttctggacgcagtaatatgaccaagtatacgttatacataataattatgatacttatcgaaaccctccaatgaagaggttggaagtaaaatgaactgtcatcattcactccataaggaattatattttgaacttagtcagtataaagtcttttatgatatgagtataggctattaagtttttgatattataaaagacatactttatgagcacgtttattcatgtaacaaatttatgtatttgaggcgaggattatatttatgctactttcttcatattcctatt

SEQ ID NO: 19971 - DNA, 763 bp, Diabrotica virgifera
  misc_feature (2)..(23): n is a, c, g, or t
  misc_feature (79)..(109): n is a, c, g, or t
  misc_feature (146)..(167): n is a, c, g, or t
  misc_feature (176)..(188): n is a, c, g, or t
  misc_feature (190)..(202): n is a, c, g, or t
  misc_feature (204)..(240): n is a, c, g, or t
  misc_feature (255)..(525): n is a, c, g, or t
  misc_feature (532)..(570): n is a, c, g, or t
  misc_feature (635)..(657): n is a, c, g, or t
  misc_feature (687)..(718): n is a, c, g, or t
  misc_feature (725)..(761): n is a, c, g, or t
cnnnnnnnnnnnnnnnnnnnnnncagtacacgacgataatctccagtattaaaaaatccgtatctcttagtaaaaatcnnnnnnnnnnnnnnnnnnnnnnnnnnnnnnncttttttcacccgtttattaaaaacatcgtcttttcnnnnnnnnnnnnnnnnnnnnnncgcccaccnnnnnnnnnnnnncnnnnnnnnnnnnncnnnnnnnnnnnnnnnnnnnnnnnnnnnnnnnnnnnnncgaaagccggaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnnntgcgacctcgatgttggattaaagtttataattggtgtagcagcttattattaagtctgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnat

SEQ ID NO: 19972 - DNA, 1056 bp, Diabrotica virgifera
  misc_feature (13)..(13): n is a, c, g, or t
  misc_feature (17)..(17): n is a, c, g, or t
  misc_feature (26)..(27): n is a, c, g, or t
  misc_feature (63)..(82): n is a, c, g, or t
  misc_feature (98)..(98): n is a, c, g, or t
  misc_feature (129)..(129): n is a, c, g, or t
  misc_feature (136)..(136): n is a, c, g, or t
  misc_feature (144)..(144): n is a, c, g, or t
  misc_feature (923)..(946): n is a, c, g, or t
  misc_feature (979)..(998): n is a, c, g, or t
ctacacaagcgtncgangggaggggnntaaaattgggatatcccccaagaaaatttaaaatgnnnnnnnnnnnnnnnnnnnnttgtagaggagaagantttgggtagtagattattctcgaaagaaganaaaaaanggagagtnaggggaggggaagggaaaggaagagaaagaacagaggaaggggagaaaatgggaaaaactggcagcgaccctaccgaacgcgcacggggaaacgccgcaaccgggggagggcaaaatgcatcgaacggacccccaaggaacccggaggacacgcataccgccgagataacaccgccaacgtcccccgtaatgtcccatcccaagccctcaacctccccttcaaagacaaagacaaccaaaccatcgcgagcggactacacaacaagacacaatcctggcgtcacttctgaagcaacctggcctcaggtgtcgccgccgaagctacctccctctgccctgtatacccacatgatctcgccagaaccaggccgcccgccgacgacggtaaaggtgccgaggaacgagaaatctcgggtacgggcaactgaaaaatccaaacccccaagcggacggcctgagaggattataacggggaacatggtgcatcaggacacaggaccaacaccaaccgcgccgctgccccccacctccacgagactgccccggagaccctgcgcccgatacaaaaaacacacctactagaaaacccattggacactgaaaaaaacgtaaccacccggtgccggtcccctctcccctcccttcgaaaatgggccctggaaccccgatcatcccacctcgcccaaaacaacacccaaatccatccacaaaaacccaacaccccgccggggcgcctccccccaagaccaaaaggaacaaggtggcctcctctcagtgannnnnnnnnnnnnnnnnnnnnnnnggggccccggggggacacacccacttcagttgnnnnnnnnnnnnnnnnnnnnctccggaaaaatatacaaacgccccacaccacaccccgccacccgcgccccaaaaagg

SEQ ID NO: 19973 - DNA, 885 bp, Diabrotica virgifera
  misc_feature (2)..(30): n is a, c, g, or t
  misc_feature (79)..(98): n is a, c, g, or t
  misc_feature (113)..(761): n is a, c, g, or t
  misc_feature (763)..(789): n is a, c, g, or t
  misc_feature (791)..(884): n is a, c, g, or t
cnnnnnnnnnnnnnnnnnnnnnnnnnnnnncttaatcgatagttaattagtatccgtgagagaatcatctttatctttnnnnnnnnnnnnnnnnnnnnctttttcgtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 19974 - DNA, 583 bp, Diabrotica virgifera
  misc_feature (216)..(260): n is a, c, g, or t
gatcattaggaggtttaagcaaactggtgctaagattcttttcggtgctgagcctttctgctggccggatccgaaactagcggatcagtatccggaagccattgaaggaaaacggttcctaaattcgggaatgtttataggatacgcgcccgaaatctacaaattattaactagggatgaaatccaggatactgactacgatcagttgtattgcannnnnnnnnnnnnnnnnnnnnnnnnnnnnnnnnnnnnnnnnnnnnatatcgtcaaattcctagtattattgcacaaccttagatacaattaggctaatgatcagggttatgcacgctagggagcactgggacatgacaaagaagagttcgaagcaaataaattgacactaacctctccgttcaagaatccccccggctgtatggtcttgtggattatcatatataggataagaaacgaaactcctctgctattctgttaaaaccacaccacacaataagtcactccgggcatccgttctagtatgatccgagcgcaactacacacgtatgtcactgaatagctcttttatggtgtctgctaaatccaa

SEQ ID NO: 19975 - DNA, 68 bp, Diabrotica virgifera; identical to SEQ ID NO: 12374
  misc_feature (2)..(17): n is a, c, g, or t
  misc_feature (19)..(67): n is a, c, g, or t

SEQ ID NO: 19976 - DNA, 462 bp, Diabrotica virgifera
  misc_feature (362)..(362): n is a, c, g, or t
gttatgagtgaacattttaaacgttttaaacattaacaacatgggttcgaaaaaagatggacaacagacttagagttttaatcgaaaatggtgttaaactgggccacaggactttatttgctattgtgggcgataaaggcagagatcaggtagttattttgcaccacatgttagccaaagcagaagttaaagctagaccttcagttctatggtgctacaaaaaagagttaggattcagcagtcacagaaaaaagagaatgaaacaagtacaacataagatacaagcaggaaagttaaatgtgaatgaagatgatccttttgaattgtttttagcttctacaaagataagattttgttattanttcagagacgcataagattcttggaaatacctttggaatgtgtgtattacaagatttcgaagcgttaaactcaaatttattagctcgaactatcgaaaca

SEQ ID NO: 19977 - DNA, 220 bp, Diabrotica virgifera
ccatattttattcagatatagtttgcatttcttcacctctgccgatcgatgatctcatgtagtattaccgagattggtcacatatcctacaacactccgttgtctgtagcccatgttgctgaagtatccagatctctcaccgtattccaagatacatgatctgagatacttctacagactatgataatctaccactccccatatcattgtgcgtggagca

SEQ ID NO: 19978 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 19979 - DNA, 108 bp, Diabrotica virgifera
attaaatctacaacactgagatgtgctaaaataatatttgaatggattattatatttgatgcatttactcaccatcgtgtacgatatcttgaccgttactgcacataa

SEQ ID NO: 19980 - DNA, 379 bp, Diabrotica virgifera
  misc_feature (207)..(226): n is a, c, g, or t
  misc_feature (257)..(287): n is a, c, g, or t
  misc_feature (297)..(326): n is a, c, g, or t
accgagttacggaaaggtcgctcattgttctgtctatctgcaacagttgaacgaattgtttggtgataagagacctgccctgtcatttaattcattaagaattttaattaaatgttaataatcttaatattttgctatcagaggtgtagaccctattgagtttaataatattattagtaagtgtttgtagaagaaaatttatttacnnnnnnnnnnnnnnnnnnnntggcgattagaaaatagttttaactttttgnnnnnnnnnnnnnnnnnnnnnnnnnnnnnnntcctctttannnnnnnnnnnnnnnnnnnnnnnnnnnnnntaacagcgttatctctgattgcagagttcttatcgataatagagagtgcgacc

SEQ ID NO: 19981 - DNA, 121 bp, Diabrotica virgifera
  misc_feature (3)..(35): n is a, c, g, or t
ccnnnnnnnnnnnnnnnnnnnnnnnnnnnnnnnnntggtgtgcttcataaattaattacacagtttttatcgaaatatagtagtcaaccatgaagttatctagaaacgttcgatcagagga

SEQ ID NO: 19982 - DNA, 145 bp, Diabrotica virgifera
  misc_feature (2)..(19): n is a, c, g, or t
cnnnnnnnnnnnnnnnnnnggactttattacatataatatattatttctgagcattatttaaaaaccacatacttacataaatatacatattttgcaagtttttaatttcaataaatttctcaagtatttttcaaagcaattttt

SEQ ID NO: 19983 - DNA, 534 bp, Diabrotica virgifera
  misc_feature (323)..(344): n is a, c, g, or t
actaaaatggtttattttttcctaaaactagttataaaattgttcgtttcaaactttaagacctacaaagagagaaaagaaggaacatgagaaacttagtagaatatcaacagtttgttagaaatttttaagtagttgtttgctaaaagttagagagcaaaactgactagtactacaacttaatctatgcaatattgatacagatatgtttatgttgaaaaattagaaatgctatgtgttataagaggagaacgcgaaaagttctaagactagcccatagagggtactgttttactacagacgttattgatgttgttagggtnnnnnnnnnnnnnnnnnnnnnngctcaacaaccttagaggccactgatcatgtctcgtgaatcacgaaaagtcgagccagtttatcatggaactcaaaaattgtgtctaatatttgccgcagaccttttattgtaatattacgtatgaatcctactaatttaatacattgcttggatgcgaccattattacttaggaaggacgtactgtaat

SEQ ID NO: 19984 - DNA, 854 bp, Diabrotica virgifera
  misc_feature (332)..(353): n is a, c, g, or t
tctctcttcttttttttttcgaaaatcaagtttatcttcttaaactcaaataattctgatgaaaatatcggatcgacgtttacagcagcatcatcggcaggaacgaatcggaatgggccctctggatcgatgaattcaatcggaaacgatgacatctggaagtcggtttaaggactgggtgtccctgtggtccgtggaagccttggtatcttgacagggtgcaccctttctcttgtcaaatttataaagtatactttgcatattaccccataaagtttgagctcattcccaagtttgtattgcaatactttaatttaaggcctactgattgnnnnnnnnnnnnnnnnnnnnnnctagtttttcgaatagtattattttcgaaaaaaatacatctaagtgtcctaactactattacgacgtatttacgaagttaataccaaaaaattggtaaaatatgatatttcttaagaataatgtctggaatcaatgttactgttaatttagtagataaagataagtaataatagtatttttgttgtaaaatttgaataaaaaacagacgataataattcacgataactaagcaaatatatcatcacagtattttggtatcatttaaaaaatagaatatcatttaaaatgtagaatgtgataaaaaactacaaaataaactcactaatattcccaataaaattatcaaatgtatcaaacaagaatcatcaaaagcatgcaaacaattcaacgtaaaaacgattcccggtatcggatcaataaattgcagctgctgaagcgtcaacaacgtggcaactgcgcgaaattttcaacaaaaccacaaccgacactaactaccatct

SEQ ID NO: 19985 - DNA, 696 bp, Diabrotica virgifera
  misc_feature (26)..(111): n is a, c, g, or t
  misc_feature (125)..(146): n is a, c, g, or t
  misc_feature (271)..(283): n is a, c, g, or t
  misc_feature (286)..(299): n is a, c, g, or t
  misc_feature (324)..(341): n is a, c, g, or t
  misc_feature (354)..(410): n is a, c, g, or t
  misc_feature (417)..(488): n is a, c, g, or t
  misc_feature (499)..(559): n is a, c, g, or t
  misc_feature (675)..(692): n is a, c, g, or t
gccgcccctccctttttttccctcgnnnnnnnnnnnnnnnnnnnnnnnnnnnnnnnnnnnnnnnnnnnnnnnnnnnnnnnnnnnnnnnnnnnnnnnnnnnnnnnnnnnnnnggtcctttcgtacnnnnnnnnnnnnnnnnnnnnnngataaaaaccaaccgggtttcacaccggttttaaactcaaattttgtaaaattttaaaagtcgaacaaatttaataatatagttgttaccccaattttaaattttaatccaacatcgggggcgcnnnnnnnnnnnnngannnnnnnnnnnnnntaaaattacgttgttttccctaagnnnnnnnnnnnnnnnnnncaaaaaatttggnnnnnnnnnnnnnnnnnnnnnnnnnnnnnnnnnnnnnnnnnnnnnnnnnnnnnnnnnccccccnnnnnnnnnnnnnnnnnnnnnnnnnnnnnnnnnnnnnnnnnnnnnnnnnnnnnnnnnnnnnnnnnnnnnnnngggtcttctcnnnnnnnnnnnnnnnnnnnnnnnnnnnnnnnnnnnnnnnnnnnnnnnnnnnnnnnnnnnnngacggtttttttttcatccaacccttttttccagttttcaataaaaaaactaagggttatgctaccttagcacggtcaaaataccggggcctttcaaattaatccgggggcaggcnnnnnnnnnnnnnnnnnncaaa

SEQ ID NO: 19986 - DNA, 717 bp, Diabrotica virgifera
  misc_feature (4)..(31): n is a, c, g, or t
  misc_feature (39)..(61): n is a, c, g, or t
gggnnnnnnnnnnnnnnnnnnnnnnnnnnnntaaaggtnnnnnnnnnnnnnnnnnnnnnnnggacttttaactctattctatgtctactacccaaatagagggtagcagcctgtgcaccaccaggagcagctcggatgatggggtatcgtccacgtagaacatatttaataagacagctgcgacaaaaactaacaacgtgagtacgagattgaggtggtaatcttgatgatttatttgagctcaacaaagtgagtacgttgttattcccgtggtagttttttcttataatctggaaaggtggatgtacagatcattcaacatgagaataagctaattaaggatgaatttattccttatcctccccaactggatagaggaattatataggtacgtttaacacgaatactagttaataaatccttatcagaaggctataggggaggctcgtcatgaaggaaaattcgagctttacaacttaattccttaattctttagagatcacatagagtcttgatgttgtttgcatccaacccttcattccagatatgaatacaaacactaatgattatgctaccttaggacgtccaaaataccgcggccattcaaactaatcagtggggaggggagaccttatatctaataaaaaaagacttgttatgagtaaacaggtgaagtgagggatcccggattcctttattaaacctctatttttttac

SEQ ID NO: 19987 - DNA, 864 bp, Diabrotica virgifera
  misc_feature (297)..(364): n is a, c, g, or t
cacagaatataaacaagttcttgtttctttattctgaaaacttgttctttattctgtggtttagatgtgttttgtttatttcttgcaaggaaaactaaatcaaaaggaagaggaactttggccagagatatcctgagagtgcttaatcattttaaagcactatagcaaacacgcttacagcttgttgagattagtacaacgttaagtgaaattcaagctaaaaagttgtgtaatcaaaataatgtaatcgatgagaatcatcctatctacagaactggtatcacacatgaaggtatnnnnnnnnnnnnnnnnnnnnnnnnnnnnnnnnnnnnnnnnnnnnnnnnnnnnnnnnnnnnnnnnnnnntttttgatgctttacctattcacaaattcatcacaacaaataagggatacagagaagtcctcatagatattgatcctagttttgttggaaatggcgatattaatgagcccaaattcagatatgtgctttctcgacatgaaactccaatgcaaaagaaactcataagaccaaatgaaaatcgggaacatgttgaaatatctccagacagtatgatggtatacgtagaaatttgtgaacgaattaaagaatcaggtggtttggcgctaatttgtgattatggtaatttgagatgcgcaacagattcatttagagcatttaagaaacactaacaagtggatcccttagaccagcctgcatccgctgacttgacagcagacgtatatttcagcgctattaaagatgctgcagacgaagtaaaaggcatcctaacctttggccctactaccccacgagagtttcttctactaactggtttggagttcagattttaaagtctgaaa

SEQ ID NO: 19988 - DNA, 93 bp, Diabrotica virgifera
gtttgaaaaagagggacaaaaccttgtaaccagtaaatatgtcggtcttgctaggacttctacttttattattggaggaatttttgacagcca

SEQ ID NO: 19989 - DNA, 441 bp, Diabrotica virgifera
aactgcttcctactgaatgtctagtgggacacgacctggaccgtcttattgaatatactaagagtgccgttcacccacggtgagacctctacccttgtctgcgtcctattcaccgctccgttcactttcttcgcttcctttgctcccaagatgctcggatctccccatcttcttctcgatcacggactccctttaggcatccaatacagatgtgttacttctcctctacctctccctcctagattcttccgttgaaatatccagtagacgcttcactctgataccacgtgttatcactcttttagggtcaagacgactattattaaatttggagtctggtcctgatatcgttacaacactctgccctatctgctgcaactgccgctgttgattatgtattatcttctcctgcgagctatatgacttttccatagggtcatt

SEQ ID NO: 19990 - DNA, 705 bp, Diabrotica virgifera
gaacattattatgtaataaaaaaatgtgcaagttccctattcaccaaggtacataacacttttttgtattgtttaacctcctcgttgctgattaaattgaactctattttattatgattctgcactacaacttaaggcttttctttttactgatctcgttatcatagtaattaacatcttagcaggtgtgttgtagttcatctatgagctagagatatttctccactagtctcggtcatatgttacaagtagtgcctcagtatactatttgttgagaagctttttcgtaatgtctacgtatcgctgtggggatttgccgcgttggcgttgattctgacggctttcttggaccatcaaccgcggaaaaaagtgtgtctgtttcagattcaaagactgtgttgtcgttgtctgggagaggagtgtgatgtgcccctgttgaagaagagtggaaagtggagacctgccaatcaggtacatatataattttgtctcaatccgtctgtacattgccttcatcatctttggtagaccaagatttctgcttgactttacgtgcgagtagtctgactttatcgaagagttttttggtgttatttgtgtctgcatgttgttaaatatctttgcaaatgttctctatatgctctttcttgtttcatctaaaatcaccctgaataactgtatatagctttcagtactggcaatgcc

SEQ ID NO: 19991 - DNA, 624 bp, Diabrotica virgifera
  misc_feature (537)..(537): n is a, c, g, or t
  misc_feature (564)..(564): n is a, c, g, or t
  misc_feature (583)..(583): n is a, c, g, or t
ggtagttgtaacccccctcttaggatcatcctggttacgcctatgttggcattccctaattacatttctttatacatagtacgtggtagtaacagtacatgctaatacattttttatcacctaaagaccagcttattgataggtcttatacatagatatttagtaccttgttatttttaatattattcaataggcaaatcaaaataagcggtacactacctgataagcatacgagtaactaaaaatattgacattgttcttccattttgctttgagtttgtgtttgtataaaaatatttatgtcttaaaagtaatttggtaagaatgagtcgttcaaatcagtattgttttcaaacagacttctgggtattgcttcaaatagcgaatttaaattcacttttcattacaaaatattaaaacatagcctaaaaagttgtggaacaataatttttagattacatagtggtaatgttccataagtctcgtatcataatatgtatcacaacaaatatactgaatggttatatcaatcattgntacagccaatgaaaaaagaatcataanggaacataaagcgcacaanagggaagaacatgtactttacaaaaagcagaaaaatgaaaa

SEQ ID NO: 19992 - DNA, 530 bp, Diabrotica virgifera
  misc_feature (161)..(187): n is a, c, g, or t
ttagggattagatcttctttctttagtcgcattcagcgctcctttagagacacttcgttggaagaaccgctctgggcaaagaagatggaaatgatctgagagaacgaaatgaggttttttttttgtgggaaggagacgaatacgggagggacgacgagggnnnnnnnnnnnnnnnnnnnnnnnnnnngttcaaaccgtagaagggcgaagagggaatggagacgcacccatgcatgttcgagaaagagagggaagaggaacaagtggcatttcggtataggagatgaagccgaggaacaagtgatggaaagagtcgattgtcaaaaaagacacaacaatggggagagcattagcgggaggtccaaccggtgcagctactcccttaatcagacagaccgaagcagattggatattgttaagggtcagcgagaaataggcagagatacagatgatggacggacgtcaccgcaccaaagaaaaacagcggtaaatgcgacttcataagtatctggctgaaagaaactatacca

SEQ ID NO: 19993 - DNA, 91 bp, Diabrotica virgifera
gcgggagcatgctacgactgaattcccctatattgccccctaaattcctttctgtggtcgtcactgtactacttcaagactgttattgccg

SEQ ID NO: 19994 - DNA, 1107 bp, Diabrotica virgifera
  misc_feature (365)..(516): n is a, c, g, or t
  misc_feature (539)..(569): n is a, c, g, or t
  misc_feature (577)..(590): n is a, c, g, or t
  misc_feature (592)..(604): n is a, c, g, or t
  misc_feature (677)..(718): n is a, c, g, or t
  misc_feature (775)..(796): n is a, c, g, or t
  misc_feature (844)..(886): n is a, c, g, or t
  misc_feature (974)..(1025): n is a, c, g, or t
  misc_feature (1041)..(1082): n is a, c, g, or t
cctaaccactatgtacataagagactagagccaaaaatacttaaaatttttgaatcgaaacagatttattttatctaaggtccagagaacacaaagtgcgatattttatttattaatgaaataaattattgcttattaaaatggagaaaattacgaaatcttttgacgatataataaatgccatggagaaagataaccggggggcacagattacttgctattcggtagctctccttggattgacagtagctttaaggaaagttagacctgtaagtaaaagtgttttaccattaggattttcaaagttgtaagatatctactataaaatgtactgtattgaattggatttaaaattttttgctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaagaaaccaattttaaaannnnnnnnnnnnnnnnnnnnnnnnnnnnnnngggggccnnnnnnnnnnnnnncnnnnnnnnnnnnnaaaaacgggggggggggaaaaaccggggggtcccccaatttaatccctttggaaaacccccccttttcccccnnnnnnnnnnnnnnnnnnnnnnnnnnnnnnnnnnnnnnnnnnaaaatttgccacccctaaagggaaaaggggcccccccctgaaggggcctttaaacgnnnnnnnnnnnnnnnnnnnnnnacccccagggggggcccctttaattttggaggggcccccaaaggcccnnnnnnnnnnnnnnnnnnnnnnnnnnnnnnnnnnnnnnnnnnngggtttgggggggttttttcccccgaaaaggattataaaaaggggggggtctcccttttttgggggtccccattttttggggtttttnnnnnnnnnnnnnnnnnnnnnnnnnnnnnnnnnnnnnnnnnnnnnnnnnnnntctccggcgggggggnnnnnnnnnnnnnnnnnnnnnnnnnnnnnnnnnnnnnnnnnntcttttggcgggggggagggccccc

SEQ ID NO: 19995 - DNA, 887 bp, Diabrotica virgifera
  misc_feature (15)..(35): n is a, c, g, or t
  misc_feature (455)..(477): n is a, c, g, or t
  misc_feature (566)..(583): n is a, c, g, or t
  misc_feature (680)..(698): n is a, c, g, or t
gagaaaactaatacnnnnnnnnnnnnnnnnnnnnngcagaatgaaagatctttacatcattaccgagggtaataagtccctgaaaacttctatgtttattttaataagttacaggggtgaaaaagaagagacaattgagtgtgatttttaatttcaaatatctcattcaaacgaatcttttgtttattctaagggactttcaaccgtcggtaataatgtagtttttcattctgagtttaaatttttcaggattcgaaaaaaattaacaacatgtccttagtgatattttccaaatcgaacattcgctatctttgtcatacaacgcactcagtcgaacagaatatgatgaaaagacagtaacaaccaggctactaaatattcttagttgtttattaaataatattgatggtgtattggatagataattgatttaagatgtgaaattaataaacagnnnnnnnnnnnnnnnnnnnnnnngaagatccaagcacagaatacaccatggtatattccaagtttttatggttaaagatgttcaaaatttatctaagcgttccatagtaacnnnnnnnnnnnnnnnnnnctttcctctttcctcgattatagtttttatcgtatagtaaataaattattgtaatcactgaatacgtagtgaaaaaataatcctatcaattaactgnnnnnnnnnnnnnnnnnnnaaatatacaagtaacggttatccaagaacattcaaaaacaatgaaatagccatccctatgttaatgatgacaatgtcattgtcaacttatgtttacatttccataatttccataatagtgagaattttactacacgaaattgggccgtgtaaaaaaaagaaaagtagggatagccgtaaaaatttgcgc

SEQ ID NO: 19996 - DNA, 613 bp, Diabrotica virgifera
  misc_feature (372)..(392): n is a, c, g, or t
aagtcttctcatcatcttcacattgacataacacttaccacactgtattgctttcactctcaactaacgccatatctttattctttatacgttatgaaatattgctcatctgttcaaaggacattaaaataaatactcaaaaataaactcatactataattatctagatttgtgcacctaaaattttttaaagatgtgtcctatatccgccttgtcctcattttctgatacctcttgtaacagagctgatgatatgtcatgcgttactacaaaagagatcctaggactctttcgagcctaattctaccaaaatacacatgtatgattctgatatactcccatacaacgaaaataaagatacccgacgcgagnnnnnnnnnnnnnnnnnnnnngatcatatatcatcacttgacgaacaacatctcatacctacctaatactctactagctgatcaagtatcaatatagcaggtcatctctcagatgaagacagattgacctcgaagaaactactaaaagaaactatcacgacactcagcagactgatgtgtgtataggatccataaaagacttatgactgagaacgagcctaccgattctcatctctacttga

SEQ ID NO: 19997 - DNA, 843 bp, Diabrotica virgifera
tttgttcgcgcagctgaaataatttaaaggacccaatgttgagtgaaaatcacaatctagccatgaacggttacctagaaagtatatccaccaacttaaaaaatagcaggaactgccttcgtcgcatagcaagacacgacgacacagaattctctaaccaaagtatccttaacgtcatggagaaattcgtaaagaccgtcaacaaaatggatgaaaccattttagtgccttgtcgtttgatggacctgaaagtcggagatgagcaagacccagcttgtcaaaattcgaaaaccaaatcatcccactctgtacaccaaattctaagttctacagacctgtttgagatctacaatatgttgaatggggtaaaggactcgctgttatggggaggagctcaagagcctccaaagaatcctccaccacctactaccgcaattgtaacatcagtaactactccaatcgtcaagggccacatccggcgaccctcttcatgtgatgtgtgacttccacaaattcgtcatctactctcagcgatactgattctgagtctggcagcaatgaaatcgattctggaatcgatgaaacgtcccaagaggaaggaaaagccgaaagaatcgctcaagattttaaaagacacttacatggactcacctctcaacgtccatctcaaaacagatccgccctggactataaggtaaacgcgcatttgaccaaatcggctggcaacggaacgcaccgctacagctcagaattatatgccatacggcgtatttatcgacaaaatcacgtaagctcaatgagtgaatttacgtatttcatacgaaatggatccgaacattatta

SEQ ID NO: 19998 - DNA, 854 bp, Diabrotica virgifera
  misc_feature (325)..(382): n is a, c, g, or t
  misc_feature (415)..(432): n is a, c, g, or t
  misc_feature (647)..(671): n is a, c, g, or t
gtcctgagtagttgcaggtgcagttaaaaactgttgtttgttccagaagggaagttgttttggttaaagggttgtccatttatggatttttgtgataatggcataattggttgcgtgtttaggtaagatgtaggttggtacaaaggtattggttgattcactaggatttgaccattattatcagtagggacatggtttggttgcaggtatggattatttgtgtaattatatggatctgtcatttttgactcaatctatatttacctaaagtcttacttttacaaaaattaacatcacaagtttttttgcaaaaaaccgctatcgnnnnnnnnnnnnnnnnnnnnnnnnnnnnnnnnnnnnnnnnnnnnnnnnnnnnnnnnnnctcatgtattattttgtgaaaatcgtaatatcnnnnnnnnnnnnnnnnnnctgaaaaaatactgaccgttattttggaacgttgcttcccacctttacattcaccaacaattacaacacaaaaaggtataatgttttaacacaaagttcgaacgtttatcaccaattagcactaaacaatgtttttagcggaacaaacaatcttgaaaactacataagtctttcttatgaaaggaaaaccttgcatgttcaagaacaatttctcnnnnnnnnnnnnnnnnnnnnnnnnncaaggtcagacaacaaatatacaatccgaaatcagaaattcgatcaagaatagagcaattaagagcagcttttttgaggatgaggaaatttctgagtaaccaaagactcaatctgcaaatccgatatcggatggtaaatgttatatccactctattcttctgtatggtgtcgaagcctggact

SEQ ID NO: 19999 - DNA, 514 bp, Diabrotica virgifera
ttgcgtccgcgccctttctttttttcgttgtggttggctttttttagttttcttgttgtggttaacggttaacctataaaatttaggcttggtttaaatgtgaacaaaaatatttctcttttgatattacgacaaaaagtttttatgaataaaatcagaatttgattattaaaattatatgcacaatgactacgcccggagcgctttagcgatggagattatgtttaaatgcctctccaaccacacctaccatatttggcggaaatgttaccccaaagtaagtcaacttcacatctttaaagtgtacactctccagaatcggtttgtaatatcgtagagttacgcatgcactacgatgtactagatgtattaatctattccaaaaggcgaaataggaggtatactaataggaactgttcctgacatacaacaatccgaagagaagagtagagttctattcggcataatataaatatgctttacaacacccaggtttaggtatatacatctctga

SEQ ID NO: 20000 - DNA, 587 bp, Diabrotica virgifera
atccgtaacaaaacaaaagtaaaagatgtctctacccaagtagcaaagcttaaatggaagttcgccggacacaccctacggcagaagaatgctaaggacacttctgacttattggaaaatatgtcacgttgcttggcaggtggcttatgcaaactaaccttacacaatagcccacaccgtttctcaccctcatagatcggtgggttcctcgatattggattagactagatgtacaaatataattcaggagcagtggattagaattctccaactttctagccctcacatctatgtactcttgtacgtggacacttgctgctgattgatcacttgatggaccaacttcatctgggctattttggaatgcatggacatggaagagaacatcacggactatcttttgcgatatatcgttgctggtggtctggccacaggctgagcatctgaagctgtgtcagcaggacacagatatgtaagaagaacaggctcatctgcttctgcatgtcgggcctataggagctatacgaaggtaaaatggagctatcgagttctcagtatctgtaaaggttgcaataacggttctgctt

SEQ ID NO: 20001 - DNA, 763 bp, Diabrotica virgifera
  misc_feature (2)..(28): n is a, c, g, or t
  misc_feature (31)..(62): n is a, c, g, or t
  misc_feature (64)..(175): n is a, c, g, or t
  misc_feature (181)..(218): n is a, c, g, or t
  misc_feature (222)..(302): n is a, c, g, or t
  misc_feature (304)..(332): n is a, c, g, or t
  misc_feature (334)..(361): n is a, c, g, or t
  misc_feature (363)..(448): n is a, c, g, or t
  misc_feature (450)..(474): n is a, c, g, or t
  misc_feature (478)..(512): n is a, c, g, or t
  misc_feature (532)..(564): n is a, c, g, or t
  misc_feature (577)..(685): n is a, c, g, or t
  misc_feature (687)..(762): n is a, c, g, or t
cnnnnnnnnnnnnnnnnnnnnnnnnnnnacnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcnnnnnnnnnnnnnnnnnnnnnnnnnnnnnnnnnnnnnntacnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnncnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnntatnnnnnnnnnnnnnnnnnnnnnnnnnnnnnnnnnnngaggacttcgccaaccttgnnnnnnnnnnnnnnnnnnnnnnnnnnnnnnnnncattacctatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnng

SEQ ID NO: 20002 - DNA, 245 bp, Diabrotica virgifera
  misc_feature (3)..(242): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngat

SEQ ID NO: 20003 - DNA, 516 bp, Diabrotica virgifera
  misc_feature (77)..(95): n is a, c, g, or t
  misc_feature (226)..(251): n is a, c, g, or t
ttcccgcgggcgccccctgcgcccgcctattttcatgtattgccggatcatagctgctctttgagtttcaccaacgnnnnnnnnnnnnnnnnnnngtttaataggaatatgagagaatatatttagtgcctgtctgacacatgttttatttttgtacgatgcgactccgcgcagtatagattaaaaccgagaacgtaattttggtcctcagaaaggccaacttgannnnnnnnnnnnnnnnnnnnnnnnnnagattattacgacttaattgctcccggagaggacttctgtcccaatgcctctgaatatttaacgaatggactacaatagtacatcaacaatatatagttaagtacgtattcgtgtatgcataagaactattaaggattgaagataatgttcaagtacagattttatctacactgactagcgtcaaacaagaccctcgattgaatagtcgcgcagagtaaaagctaatgatattgattttgagatacgaggatgatcggtcctcca

SEQ ID NO: 20004 - DNA, 979 bp, Diabrotica virgifera
  misc_feature (59)..(79): n is a, c, g, or t
  misc_feature (737)..(756): n is a, c, g, or t
  misc_feature (849)..(849): n is a, c, g, or t
  misc_feature (888)..(889): n is a, c, g, or t
  misc_feature (903)..(903): n is a, c, g, or t
  misc_feature (917)..(936): n is a, c, g, or t
caaaatatatatattccggctcaactctgctctaggcggttgaccaacagaagctttcnnnnnnnnnnnnnnnnnnnnnccaatacttcatcgagctaatgaattctgaactcattcaagaacaagttaaaattccactccacccaaatagttgccatagttgcccatcacgtataaaaattgaaagccacacctgtggctaaaactagactaagctctaacctgactaatgtgtcaaaactgctcccttttagagttgcatgtccgaacagcccaagaattataaccgcaccgactacaagcacaagccgatagattctagctatctacgaatacgtggtacgaatggactattatggatatgaagtttatggatatgtacgtataatataatatcacctaaagtacatcaagaccctcgaagcacctggtgcacagggttactgctaaggcacgtcatctagagtttcgagggttttcggtacccaattgatgcaaacagattacttgggtttttaggattgctgaatatgaatacgtcatcagaactgacctcatgagcacctggtgttcagggtcactgctgaggtacatcatcttctggagatttgagagttttcgtgactaaattgctagaaacagattactcggtggagtcttgggggttgttgaacacgaatatgacatcagaacccaccctcggggcacctagtgctcaggatcatcggaaatatcannnnnnnnnnnnnnnnnnnncatctgaaattttgaggcttgccgacacttgtttgatgcaatagattactcggggaaattttggggttgctgaacacgtatttaaaagtcatntaatttcggggggttttagtgctaaatgatcgattaaanntataattaccacantatatagaatgcgnnnnnnnnnnnnnnnnnnnngcattcaaaatccttgttttttcttaacgatgcgtagctactg

SEQ ID NO: 20005 - DNA, 881 bp, Diabrotica virgifera
  misc_feature (29)..(43): n is a, c, g, or t
aaaaacgttgtttttttttacaagaactnnnnnnnnnnnnnnngtactgtattatacttattataatactaggataaatcctaactaaactggaagaaggctcttatgaaacattgatcaaaagatatttgattgatagtgaagccaatttcagaagttattgccgttaaaaaagacccatttagtttttattaacatcagttttgcacattttaactttgtgatattatataactcatttcattatttatttgctggacgataaattataaatgttttgctttctacacaaaagcatttattctttcgatttctgataaacaacaaacagtttttggtaaaagatgtctagaataaattaactcttcactcaacaatcctcgtattgaaagctgaacatgtctttaacctacataaggatgcactcctccccctccaaacgcaacaacctctttgcaagatggaagcaaaactctggttgaccaactcagcagcaacgggctctacacaatagcctatgcagatgacatagctatcttgcaaagcggtaagtttaagaacacactatgtgagacattccaagttgctctcagacgaatagaaacatgatgtaaggaacacttactgtttataaatcctaagaagacagaaatggttatcgttaccacaagaagaaggatcacgagcttaataccttgaacgattagaatggaactctcacttagatggtagagctaaaagagcataatatagtgcgtatgagcagggtcaacgaatggtgtgacgcacctggggcctttttgcccaggtgatctccccggatctacactactgccattaggcccaaactaactaacggagactttggttggggacccaaa

SEQ ID NO: 20006 - DNA, 882 bp, Diabrotica virgifera
  misc_feature (168)..(187): n is a, c, g, or t
  misc_feature (496)..(518): n is a, c, g, or t
  misc_feature (618)..(636): n is a, c, g, or t
ccgagctgtactatctgattgtcttatcgatttgtttatattcaataaaaacctttattcttcgtaacaataacaagttttttcaacagaaataaatattgctttgaaatgtatggtgattccaagtaagtttggttgtgtgtatagtgaaatgttaggaaattgttnnnnnnnnnnnnnnnnnnnntactacttggagaaaaatgttttggaaaatgagactcatttggtaattaaatgtagcctctttcagattgttttaagaatctctttgatactacaataattgactgaaaaatggactggtggatttcgatttaaattttctgttttgttttaatttttagttattcaagaacaggccaacgaaatgtttcaattttagatgcatttcttttacagctaataaaatacttaaataaatttttatctagacagaaattacggttcgaaatgaaccagttcgattaactgagattttatttagcagcctgannnnnnnnnnnnnnnnnnnnnnntgttcattctgaaacaaggttctgaaactgttttcttgtggcatgcctaatttaagtattatgtttgtgaaggattgacccgcaattattggtgtaatgnnnnnnnnnnnnnnnnnnngctattgtttgacgtttccatttccactctgagggtcgttctcaagaaacattattctaaatattctgggaaaaattgtataaactaaatttgtttattaatttaaatgcaaccaactttatgtttcttcagaacttgacttattttgacctaaatattatccctcctccttctctatctttgttccttctaatgttggagggccacagaacgcctaatgtccttatttaaccccgttattttgac

SEQ ID NO: 20007 - DNA, 649 bp, Diabrotica virgifera
attgttatgagttgctatccttattagctcgaattatgtttactgtaagaaatatagagtcacaaagatggagtttgatttgtgatgcatgctaggggatgtgatacacatattcacaaagtccgctgcttatatgaggcatcagcgtaactatcatacaaagactttaaatatcaaagacgatgccacgattgctcctgctaatactccaatagatcctcatatagaagacttctttgccacttggggaataactcaacctagtacaatcaacgatgaaaaacagcagatttctgctcccaggtccaaggaaaaagtttcaaacagcatctggggtctcgttcacaggatcattttttgacaatgcaaatgaaggaaacaaatcaccttctattactagccttgacgacactcttgatgctgtacaaccttttagtcaaagtaagtgagatgaacaccacgttgaagagctagataatgcaatgtctgaacttggtaccactgaggaatagaccacagaaagcatatcggaccaaggaagctgcagtgattagatagaagcaactttaagtgaaaagcatggtaggtcaaaattctgttaaaagaagagagaagaaagcaaatgcctcactactcaatagattatccg

SEQ ID NO: 20008 - DNA, 76 bp, Diabrotica virgifera
  misc_feature (2)..(23): n is a, c, g, or t
  misc_feature (26)..(74): n is a, c, g, or t
annnnnnnnnnnnnnnnnnnnnntgnnnnnnnnnnnnnnnnnnnnnnnnnnnnnnnnnnnnnnnnnnnnnnnnntg

SEQ ID NO: 20009 - DNA, 887 bp, Diabrotica virgifera
  misc_feature (48)..(81): n is a, c, g, or t
gacaagtgtctaaggttcggaaggttttggtccttgacatttaggtcnnnnnnnnnnnnnnnnnnnnnnnnnnnnnnnnnnccctcaagatgcccaagaaaaaaacaggtcagagaaaaaaagctgaaaaacagaagctaaggcaaaaagaaataagaactgccaaagaaaaagttcctttagctgaccatccttgcaatatttgcatggaatgtgaaaagtgccatcgaaagcagaaaagtcgtgcattttgttatttttgtcaaaatgttcaaagattaccagtttgtgctcagtgtggcaaaatgaaatgtatgataaaaactggagattgtgtaatcaaacatcctggagtatatactactggaatgaatatggtgggtgccatatgtgatttctgcgaagcttgggtttgccatggtagaaaatgtcttcaaactcatgcttgcacctgtccattgcaggaagcaatttgtatagaatgtgaacgtggagtttgggatcatgggggaaggatctttaaatgttcattttgtactaattttctatgtgaagatgaccaatttgaacaccaagcctcttgtcaagttttggagtcagaaaattacaaatgccaatcttgcaacaaacttggacaatattcttgtcttagatgtaagacttgctattgcgaagatcatgttcgtaggaaaggatttaaatatgagaagaataaagcaataccatgtcccaaatgtggctttgaaacatcccaaactaaggatcttagcatgtccacacgtagtcacaaatttggaaggcaaggccaatcttctgcttatgatgattatgatgatgaagctggagcaggtgattatgatgatcaagattattatgattacgattat

SEQ ID NO: 20010 - DNA, 390 bp, Diabrotica virgifera
gcgaccctttcgcccgcgggcgtattggtgcgtgatattaattcaaaccttttgagctagttatggatacatctgcactaatgacattattaggaccacttttctagaaataagtgatattccacgagatcatctgctgaatatgccaccagacttgccgaatcgtagtccatgacggtcaacgccgcacctgcggctaccagtcaatctaggccgccgacaacagcgaccgccacatcatcccgaccagcaccaagtaccacaaaataatctcccctgcaccatagtactgacagcatcagctcgctacaactccttagccaagaatccctctcgcttctcagctacaaacaccctgagctaatcgactccctgacagcccacgagcat

SEQ ID NO: 20011 - DNA, 326 bp, Diabrotica virgifera
  misc_feature (14)..(102): n is a, c, g, or t
  misc_feature (122)..(187): n is a, c, g, or t
  misc_feature (200)..(298): n is a, c, g, or t
gctgaaatgaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagaagaccgctatagaannnnnnnnnnnnnnnnnnnnnnnnnnnnnnnnnnnnnnnnnnnnnnnnnnnnnnnnnnnnnnnnnntttaatttggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacggaaaaacaccgaaatttttttt

SEQ ID NO: 20012 - DNA, 952 bp, Diabrotica virgifera
ggttcgtgtagtaagttaagaatttaattaatacatcgaataggtgacaagatggctctaacgccattgcaaataattttgggaaaaacggctgccatcattggggcggttcaaggatttgcatggtggggtatggccctagcttgtgtaatcgtttactacgatggtacggagataccgaaggatgatcctacaaactttagccagctattaagtcgagaattacaactttcttatttagtaaaaaatagtgaggtagggacatctgaccagagagtaatccaggcatcggatttaattatactggcttggatgtacttatttgccagcattgtgtggatcgtaatatctattgaccaatttctagctatccattggaataaatctagacaatcaacattgatgataagttggggtacactaacaatttgtatatcagtagttgatttggtattttcatctttattattacgagacttcattaactgttcaacaagtaatttggcttgccatgtgatcattggtacaatgatgacgatagcagctagaggttacactttgtggctcttaaattgtgtacttgctatcagcacgatattgtctggagttaatataataacacgcgagaagatattaaaatcaagcatgtacggtgttgaaattcccagagctaaagctacacacagccagaccaatacccttgagcacaacccaaggcagttacatgaaaatagcaattactcaccccaacctagctcaaacggatatcgtcagcctcaaaacttggagcctccagctcattctttgggggcatatccacactcaccaagcctgaattcggtagctactacaggattttctgctcagttgcgaaatgggaataggttaaattattaaagatcatatttttgtttttatgatttatagtgcgtttggataaatttgttatata

SEQ ID NO: 20013 - DNA, 663 bp, Diabrotica virgifera
gacacatctacccacaaataaaagtttagtatcacctggaacatctcccaattattcagaaaaatgacattttcatatgaaagctataccatcaacaattgcaatcgatgaatatgaactgacccttcataattcatctataggaccaagatcatagcagaagagcgtagcaccgatatagatgcacttacaaccacatattttaggagctagacaactccctcaaactcataaacacttctttgagacccagatgatgatacgatatgatgacgacacctgacagtgaaggaacatgcactaatgatggagctactattgtgaacatgatggaagaagaacatgaaatatctatattgctaatacaaatatcacggtgccgatatgaagaaattgatgatggaaccacatgtgtagtattgttggatgatgccctgtgaaaacaagcatgatctttattagacctacgaattcatcccatactgcactgcatgacgtctatgagctaatgtggcaacacacttatgctcactttggaaaaaattgccagaacaatttaccgtatcaaatacaaagacactgaaccattaatacatgacgcaatgaccactctgagatctaagatccttaacaagtgtgcctagacacatgccataaataggt

SEQ ID NO: 20014 - DNA, 967 bp, Diabrotica virgifera
  misc_feature (726)..(752): n is a, c, g, or t
ggaagcttggaccttgaatgcggtatcaatgaaaaaactggaatcattcgagatgtgggtatatagaagaattctaaaaatatcatggacagaacacgtcacaaacaaagaggttctgagaaagatgaataaagaaatggaagtcttaaatacaattaaaaccagaaaattggaatatcccggacatattacacgtggagagagatacaacttgctccaactcattatgcagggaaagattcaaggaaaaagaagcatagggagacgcagaatatcgtggctgcgcaacctgagagaatggtacggatgtacatcaaacgaacttttcagagcagccgtctccaaggtccgaatagctatgatgattgccgacctccgtcgcggagatggcacttgaagaagaagatctggttggtggccgtcttcttattcttctacccggaatgcggaatgtttccagaaacaactaatctgtcttaattatcgtcacctatcgacctctgcatctttatttgatgtcaagttgtttaagaatggcaacatttgccactgacatccacatttctgccccctacagaatacattcacaaatacattcactaatctgatcatagttttttgagaggtagatctgtatttccaaacatttgttaagcttcatttacacttgacaaatttactggctgaaagtacttgccaccattaaacttgccatgtctaaacaannnnnnnnnnnnnnnnnnnnnnnnnnnctgttgtttacacatggcaagtttagtacgaaagttcgaaagtactttcagccagtaaacgtgccaagtgtaaattaagctttaaactcactacgactcgcgtgattcgcgggctgttcatgaatagtgtgtaaggtcttgttcgtttaaaatcaaatcgggttgcttcatattttgctgctagcgtcataagtaaaccttaaattgaagacttt

SEQ ID NO: 20015 - DNA, 857 bp, Diabrotica virgifera
gctggtcattcctcaatgcttgttatgagtcagcctcccaaacaaggtgaagaagaaaggaaagatcatttccttgtttctaacaaaggaactgttaaaattgatgctgaggttatccatgtcgtaaggatggtacatcttggaccaagccatcaaaaaactctcttgcctggcgagagtcatacttttgatctcagcggtgctcacttcagattagctgttcttaaaattacaaatcatgaagatggggaagccgttttttctgccgagggcggtaatgttctgaacggttttgagaacaacgtacagaaagttgaacatgaaacagaagttgtacataaggttgagaacttccacctcccagctgactcctcagtgctcgttatgactcaacctcccaaacaaggaaatgcagagagaaaggattatttccttgtaagcaacaatggaaaggtcaagatcgaagctgaggttactcacgttcaaagaattctacaccttgaaccacgtcatgtggtaactcttttgcctggccagggccacactttcgatctcagtggaattcactttaatatggctgtcttaaaggtgagaaattatgaggatgcggaagcagtcttttcagcagaaggtggcaacgttcttcctaatttagaaaaaaatgtacaaaaattagaacacgttgaacacaaagtccagaacgttcgtctaccagctcactcagccgcgcttgttctagctcaaccagaaaaagagaacgatgaccataggaaggattatttccgtgttaacaacaacggaaatggcaagattgatgctgagggtgtcctaaaagattttcaacaaccacaaaacca

SEQ ID NO: 20016 - DNA, 539 bp, Diabrotica virgifera
  misc_feature (3)..(31): n is a, c, g, or t
aannnnnnnnnnnnnnnnnnnnnnnnnnnnnttaacattgcatttcttaattgataacataaaccgtaaaatgttttaaatcattaaaaaatagtttaccatgatacaagcattccgttagctacttccttagctttttcttttcctacaagcttctcgactaatgccaacccaaaatcgaaagcagttccaggtcctctgctcgttattaatttatcatccacaaccactttatcttctttatactgataaccttcactgccatccaataaatcttttttaacactaggatatgaggtcaagttctttcctttagcaattccatgagctttgagcgctaatggggcagcacatattgctgcaataagcctaccgctagattcttgttccttgagtagttctccaacttccttggattctgacattgctttggtacctcctagaccacctggcagaacaattacatcaaatggtcctttactactagcatcttttatagcaatgtctgagtgaatttgcactcctctgctacattttac

SEQ ID NO: 20017 - DNA, 348 bp, Diabrotica virgifera
  misc_feature (283)..(316): n is a, c, g, or t
gtaaaactgaggaggttctacctatccagcaatggccaagtcaaagaatcacacaaatcataaccaaaatcgcaaagctcaccgtaatggaataaaaaaaccaaaacagtttcgccatgaatcaaccttaggaatggatgccaaattcttaaaaaaccaaaggttctctaagaggcacaatcttagcgccaagcaacaacttaagcgtgcaaatgaaaggaaaacagagcgcgataataaaggaaagaaataggtgtaacattacttagtaatacaattttcnnnnnnnnnnnnnnnnnnnnnnnnnnnnnnnnnnagaacaaataaaattgaaaaaagacctaaaga

SEQ ID NO: 20018 - DNA, 618 bp, Diabrotica virgifera
  misc_feature (150)..(168): n is a, c, g, or t
  misc_feature (226)..(244): n is a, c, g, or t
cttcagagtagtttatatgaaaattataatttaaatttggtggcaaaaaacaaacatatattagaaaatttagtgaatttatgatataaataaataaaagaacttatttaattcattaaactaaaaaaatgtaatgttaagttttaaaannnnnnnnnnnnnnnnnnnaagttttgtgactatcttcagtatcattcaaagagatgaatacgagggtttataaacnnnnnnnnnnnnnnnnnnncaatgggggacatttctcaagaaatatcaaaattagaattaaaagaaaacttattttctgaaataaagttttttgtcagtggagaaattgatgaaaagattattgaattattgaaggctgggggtgcagaacggctaaattatttctctgattatatcacacatttgattgtaggagaaaatccagaagaaaatgatattgtggatgcaaatgatttgtatgaaataccagctttgactccaaaatgggttttaatgtgtgtatcccttcacaagcttgtcagcataaggacctatttgtttgctgcagatggcaagctattctcagaccttttacattttgtcttttcaccaattcgagaagacagaaatttc

SEQ ID NO: 20019 - DNA, 875 bp, Diabrotica virgifera
  misc_feature (822)..(822): n is a, c, g, or t
  misc_feature (847)..(848): n is a, c, g, or t
gcttttctatagatagaagatagaagttaatgcattcctgttcattgcacttttactccacctggttcatataccttgtctagctaattgacaagtaggcagatatgagctagaacctcgggaaagattttattcggataagatacgtactcgcaaaatgggcgatcaaggagataatctttaccttggtttggatcttagcacacaacagcttaaggctgctgtagttaacgaaaaactagaaattgtagcggaacaaatcgtaatatatgactctgacttacctgaatttcgtacccaaggaggcgcgattatagataaaattaacaatgcctacatcacttctcccactttaatgtgggtaaaggcccttgatatagtgctggacaagctaacagtggcaggaatcaatttttcaaaaatagcagcaatctcaggaagtggacagcaacatggttcagtttattggcaaagaggggctagtcgaacgctagcaaatttaaatcctggtgaatttcttcatcaacagttagcccattcttttgctgtagctaacagtccgatatggatggactcaagtacgaccaaacagtgccagttactggaacaagctgtaggcggaccaatgaaattagcagaaattacaggttctcgagcttatgaaagattcacaggatctcaaatatgtaaaataaatcaaacaagaccagatgcttataaaagttcagagagaatatctctcgttagcagtttcgtgtgttctctcttcgctggaaaaattgctccatagacatatccgacggatcgggaatgaacctgatngacatcaaaacgaaaaaatgggatnngaacgtgcttgcagtatgcggatcaaa

SEQ ID NO: 20020 - DNA, 514 bp, Diabrotica virgifera
ccggttagggtaattcgctaatctgctctttgtttttttaatagaggtcgtgccataaaaaactaaaaagacgccctgtattacactgattgtaccgggcctcctaagcactcgcgaagaaaccacctatctatacgatcagattagggacgagtgcaataaaccccaacatagttcaggtaccgaatgtgcaaaaacccaattaaactccgctcctcactgcttctccgaagttgagaaactatagaacatatcctatgtattagaatatcgatataaaaaccttgtccaactagctgttcttggatgtacagaactagtatcgcgggactacaattctgttctatgcactgaatacatgatccttatagaggcactcaagtcgtagtataaaaaccagcaagtccatcaaagtatcccatagataacatagccagagacagtaatcattcagttctttcacctgaaaactacgatcgttgttcctaatgatcgcgtaaacagtcatagacta

SEQ ID NO: 20021 - DNA, 744 bp, Diabrotica virgifera
gaactttctgatcgagctgggagtcgctcataactaccttcattctattgttccaagatcaaagactgcatccacgcatcctctaaaagttcagaagttccgctttccggtgaacacaactttgcctgaaatgcctaacatgacgtgatcgtcaattaaacaataattgttgcccagagacaaataatgggaaggggcctatctcggctgatggctactcttgcagctaggatcagcactagagttgatggtttgcggtggtattactagtgctcacatgtgccatcactctacgcacttgttgtagccattaatcactggtatatattgtattcgagtagcatcggatcaaggaaaagctgtatttaccgattgtagtgtaacacttcctgaagacgagataacaagtctagatgaagtatatcccatagaccccttttattatacaggcgaaaggtgcgtttcaaaattggtcgtcacgccatggttgatagtgaggaatgctccgaaagaaagttctgaaaaaagctaatatgactcccagctgactgaatagggtactgtatcagactgaggcggaggatatggaaggagtatgcgaggactgaggagaccctaatcattatggtcccaatccacacaggtgcgagccaaacattggaccaaactgacgacaagttttacaagccaatcgtgtattgacgaaactagaacaggatatgttgtgtgtgcctctgctgccca

SEQ ID NO: 20022 - DNA, 1150 bp, Diabrotica virgifera
  misc_feature (3)..(24): n is a, c, g, or t
  misc_feature (782)..(802): n is a, c, g, or t
cannnnnnnnnnnnnnnnnnnnnncaaaacatgttattggatctagatacaaaactggtaccaacgttcagacgtatcgtagaacaggacaggtgtgctttatttaaggaaaattgtctgtaatccataaagtattgtaacaataaattgtcgataacaaagaacttgtgatagtatgtaaagggtcagcgggaaaaacgatgaatgtcaatttttggtcattttgcgattttgcgaaagagtactatcaacctgtgaatggcccaggggaaattacgatgagaatttacttgaaaacacgacacaagattggagacaagggggaaaacaatgaatatttatgtaactttgtttctcattttactgaaaatgcttccagatagacatttatcgttcttccccctgactcttcatgttgagtaagaactaagaactaatattttgtgtttattaagttatccttattcgtagaaatatcaatatttttaatctaatttggtaaatttgtattaaattttagaaaatatcgtcgtcgccgcggcaaaaagttattaagtccaaaataagagatctgagaaaaagaacattttagttttaattgttgtctaaaatttatccttataaaagtcaaggaaattaccgatgcaattttataagtctagtaatgctttgagatgtgaatacactatgttatttgaaatcaatggtatttaatggacttagtgatttctggcaagttggtaaaaggtaaaatttggtgaattagttaaacacattatgannnnnnnnnnnnnnnnnnnnnaggaactcactaaataaacatattatagaaataaaaaactaaaattcaatgagtttaaatccgcgttgttcgtctttgtttcactctgaattccctacccttaaaaataactggggtcaaaatttccttggcatgacttaatccggaaggtgggccaaaaacgaaaaacacagcttggaaattccaaaggaaaaaccctcggaattgcaaaatttcttgaaaatccttaaaatttttgctaacaaaaattggaccacacccccagggcaaactcgggtgaagggaaaagggaggggttttggggtgggagggaactttttcccacccaaaaaaaactttacctccaac

SEQ ID NO: 20023 - DNA, 842 bp, Diabrotica virgifera
acttaaataaagttgacccgtaatcaagcccaaaatcatgattttactttttcctgtgcgttatcggcatagaaagaaacttatatttttattagttgccattctcaccataattgtattaggtgttgtcgcattatctcaacaaagaagtattaaagaaatcgagcaacagccatttgaattagatgactatttaaatcagacgtattcagcacttgcgttcaatggatcatggatttcagattctgctttcatgtacaaaacattcgaaaataacattttgttttttaatatgtcatcaaagagcgttgaactatttctggacaacaaagtactggcggaatatccaactgcagaattgaggttatccccggaccggtcatatgtattactaaaatacaatgtctctgctgtatttcgacattcgataacagccgtctacacaatatacgatgtcgctcaacaaaaattttatcaccttgccaatcagcaaccattgcaattagttgagttttctccagagggacatggattagtatatgttcttgagaacaacatctactacattgatgacttttcaaagaacattgaaactcctgtagctgtgactgttgtagggattccaggtgttctttattgcggtgttcctgattgggtttatgaagaggaagtattggcctcagggtcagccttatggttttcaccagatggcgcttacttagcttatgccgtattcaatgacgaacaagtctataatttgtcctacactatttacggagaaccaggatccacctggaagtcaatatccccctgaagcagtcatcagatatccaaaatctgga

SEQ ID NO: 20024 - DNA, 879 bp, Diabrotica virgifera
  misc_feature (233)..(246): n is a, c, g, or t
  misc_feature (249)..(261): n is a, c, g, or t
gatcgagaatgaaagcgtttttgggacttggatgttgtggctttagccgtcgccacgagcccaccagctcccactagcggcgagaagaaggatgaatgccaagccatcttgtagcagaaaaatccaaacgtcacttgggaggcggattctaccaacaatccttcaacagtattccacaaacttactcatcttcatggagcagtggtccagtagcccatggatacggctacaannnnnnnnnnnnnncannnnnnnnnnnnnaggattctgcatcatcatattcctcacctttaagttactctgccggaggattatctgctggaggattatctggaggccaatactcatctggactttattctgctggattagccggaggatattcttctggtctttcttctggaaatctcctttctggtgggctttcctcaggcgctgtatcggaaggtctttcgccaggatgcggctctgaaggtatatcaggtttatgtgcttctgctgggttgggtagacgctgctatgctaagattcaaatagatacaacaatagttttagtctatattatggatggtagtactcgtctatttttaatacaaaaaatctatctacagacactttttaactatttgtttcttccagagttggtatgtatgaattgaatatggcaggctctttcgagatctgctaagatatagcagggtgtcccatttgaggtggaaggtggcacggcatatccgagcagaaagcagaaaacaacgaactcgaacgaaaacttttaccccaaccttacccaccaagcaaaaactggcccaggcaccacgaccgtaccctgttaatgttgccaacccagttacctggttcagaaagatttaacatacc

SEQ ID NO: 20025 - DNA, 958 bp, Diabrotica virgifera
  misc_feature (105)..(123): n is a, c, g, or t
  misc_feature (626)..(626): n is a, c, g, or t
  misc_feature (706)..(706): n is a, c, g, or t
  misc_feature (787)..(787): n is a, c, g, or t
  misc_feature (884)..(901): n is a, c, g, or t
acaatactaaataatattgtaatactagtattatacgttgtatattcctcgtaaggtagacaaaaatgattccgataatgaaaatcaaaattttcactattattnnnnnnnnnnnnnnnnnnnaagaaataagttgcaagtatttttaactagtactttagaaatatgggttttctagggagtttaaatatttcgaattcttgaaagtagaaaaaaaaaagatctggagccgctacagtactgttacaagtgcatgtaaagagctaaaaatgacacttactcagtgttaacagatcatcaatggtgttggaaagtcatgacggcaggtaagatgaacggagtttaaacttttcaaactgaatcaaggaacagttctttgttcagtgttggccttctatggtaattaacaataggttaaagtaccgaagacattttcttttaaatactcttatcagtcaaagtttctttttagggatttaaataggaattaacgtctttttgtcaaaaccactcttacagcgcaatattccatacatatgttttgttgctgtttttatgaacaatttttgaatccaaagtttgcaaaagtatatgattttaaaaagaaatcttgccagctgctgganagggtgggggtaacattttgggcgcccaacgtggggcaactaaaaaataaattcaactcaaatatttctactttcattanaaacataacggatgggcttacgagacctacgccctcgttaacaaggagatagtaatctagcatataaaagaatcttaacgnagtaggtatttttttggatatcgaatcataaacggaccgtctatttactccgctactacgcttactagttctcgaaagaaaaagtttttgtctgccnnnnnnnnnnnnnnnnnncattgttatttcatgctctgtaaaatgcatgtactcctttgataaaaatttgtagtt

SEQ ID NO: 20026 - DNA, 955 bp, Diabrotica virgifera
  misc_feature (22)..(41): n is a, c, g, or t
  misc_feature (58)..(79): n is a, c, g, or t
  misc_feature (412)..(426): n is a, c, g, or t
aacaacagttaacagtgtaaannnnnnnnnnnnnnnnnnnngctaaaggaaactgtgnnnnnnnnnnnnnnnnnnnnnncttttaagttattattagtaaattaaataaacaaaacttaaaccgtctagcaaaacatatctctttatattatgctttattaatcaagtggcaataagtgtcaattctcgttatatttattcaatgcatttggtttaaaaaaaatcacctagaaacaatctgtgatagtaaaagcagaatatctaaacaagagattaaaatggcaataaaaaatatttgctgccttggagctggttatgtaggagggccaacctgcagtgtgatagcttttaaatgtgcagatattaaagttactgttgctgacctcaaccctgaacgaatagcccagtggannnnnnnnnnnnnnncaatttatgagcctggtttgaacaatatagtatggcagtgcagaaataggaatttattctttaccactgacattacacaagcaatattagatgctgacttgatattcatatcagtgaacacacccacaaaattgaatggaaatgggaagggaagagctcctgacttaaaatacatcgaaggtgcagccagactaatagcagatgtagctgtaactaataaaatcgtagtagagaaaagtactgtccctgttagggcggctgaaagtatatcaagcattttaagagctaaccaaaagccggggacaactcatcaaatattatcaaatcctgaattcttggccgaaggtacggctgtaaatgatctgctcaatcctgatagagttttaattggaggagaagatactcaagctggacgagaagcaatagaggtgttatgctcagtttatgaaaactggatacccagggggaagattattaccatgaacacatggtctcctgagttatcaaaacctgctgccaacgctatgct

SEQ ID NO: 20027 - DNA, 562 bp, Diabrotica virgifera
  misc_feature (254)..(272): n is a, c, g, or t
  misc_feature (314)..(334): n is a, c, g, or t
  misc_feature (488)..(525): n is a, c, g, or t
aattattattagtttttattgtatattatataaattattgtcatcactgaatacatagttggtgaagaaataatcatattaatttacagaattaataatttaagcgattatacaagtaacagttatccaagaacattcaaaagccatctctaaattaatgacgacagtgtcattgtcaactaatgtttgcatctcaatatcatcgagcattttggtacacgtattttgccgtgtaaagaaagagaaagtagggnnnnnnnnnnnnnnnnnnngcctaggctcttaaaaataaatagacattgatttcgaatagnnnnnnnnnnnnnnnnnnnnncacttttgtataaaaaattattgaattgtttgttttttaaatcggccattttgatatgaagtgaagtgaagtaccaaaatgtattctttctggttgtagtcgtttggtgttacatgttaataatgaaatcgtgttggtacatttatatttgtcnnnnnnnnnnnnnnnnnnnnnnnnnnnnnnnnnnnnnngtattttgtactatttaaaaaataaactatttttccg

SEQ ID NO: 20028 - DNA, 906 bp, Diabrotica virgifera
  misc_feature (343)..(363): n is a, c, g, or t
  misc_feature (711)..(733): n is a, c, g, or t
tattaagaccaacaggtattgttgatcaacatcagagactgcaatcggtgtcatattatttaaaaattggcctatttgttgtattgtttatttctctctttgggaaatctagtatattccatcaattaatgactgttttggattaattatacctatgttcgcggagacagtcagggactagtccaagacaagtggataatgcgcactttgaaataacataaacaataccgttgatagataaatatgttccgtgatgtggttgagttgcgtgtaataaccttattgtccacggaaacaaataaatgaaattaaaataaatgtaaaaacaacaaactgtctgtcnnnnnnnnnnnnnnnnnnnnnggtaaaaagagcgtgaatatgtctcgaaagagggtttgctattctttgcgagtgtggggttgtgaccgaccggggtgctagctgtgactgaactgaactacaaacattaatttgtcattatgtggttgtaagaagttgacggttcgaatgcatttaaaaagtgatttattgacatgtggaatttttgtttcccatacataaactgaacaggccattaacatctggtttcgtatagacattgtgagccgaaaaatgtgagttttatatgggacgtattatttagttttgagagaaaagttagtcattaaaaaatagtaattgaagcgtgtctccacaaatatacaaggnnnnnnnnnnnnnnnnnnnnnnnataactacagtggaacctcgataactcagattaagcgggaccgctgccgatccgggttatcgaaaatccgggttagccggagaatatggtaaaaattaataaaatacgttatccttacagataaacttcgttataattgaaatacataaaatatatatgcacagtacacatct

SEQ ID NO: 20029 - DNA, 784 bp, Diabrotica virgifera
aaaaagacagtataagtgtactccactgtcagtgttaaaagaggagactaactttgacaaacgtattcccaaggagcagtggtggttgaaattacgtcccctacttcgtattttggcgaagcacgattcagcatatcaggaagaaggcatgtatctgacagtcgaggaacataatcaagccgacaacctctatggttgatcaggccaaatattcagggaatattttagttaaaattcttctcgtaaagaatttacacatgtttatgaaataagtaaaaaaatgacagaaaataagtatcaaaattgtgatttctcacaatatttgtagattctttaggatgaaagtgtattcgttgattttgaaatgtttacattgagttgttatatatcgcgctgtggtaattctttatggatgtatttattctaaatatttttaacggggcatcaaaatcagctttattttattgatatttaatgtagggatttttagatatacagattttacaggctattaatttttagacacaatgggatcatattctcttgaaaggaaatattttcaacatatattgttatcgtattaagtaccttctttattgtactaaattaaccttccagtagtatattttttggacatggatactcgtgccggtccaagagaccgctatttatttaacattgtgtttggaaaaatattttcacttttcatttggtgaacaacatgttgggcttttaggattaatcatacacacatagtaaaagaaacattttacttattactcct

SEQ ID NO: 20030 - DNA, 920 bp, Diabrotica virgifera
catctttaatatggaagtactcggacaactctgaagatgtatttgaaacagtaaacaactgaacattaaaagaataataattgttaattagtggaaacacgtgttatcgtcatgcaagctggaaattataaaaatggttcctctaacgatcgtcgtactgatgttaggaacattcataagagtaagaggagatcaatgcaaggatgtcgatcatagcaagtgcatctgttatctggaagctgcagattacgaatataagtgcccaccttcttcacaaaattatttaatccatgccaaacctgacgattatttgcagattgattgctatgacgtaaaaaaatttgatactgagcgattgcccaattatgttgccggaaatacaacggacattagaatcagatcttgtccttggccagagggcaatttccaagctctattaaaaaagtttgggattacagtagtcgatactttatattttgatgaactcttcttgccaccaaattcttcagcacatattgtttcaaaagatatctttaaaggactaactcacttaagggttttaaccctagatcacgtatcaaataagctagctgatgatttacttgcagatcttccagaattatccgaattttttttaaaaaggagtaacggaacaaaagaattacctaatttttatataccttcatcggtagagaaattacatattgtagacaaccagtttaccaaagtgcctaaaaatgtttttcagaatttaactggcttaacacaactccatttgtggagaaatgatattaccagaatcagaatggatgactttaaagtgctaaaacgactaggttctttggaactgagcatcaattccatcagtgatatagaagaagacagttttgcaaatctcaccgaacttaaaactataaatc

SEQ ID NO: 20031 - DNA, 685 bp, Diabrotica virgifera
  misc_feature (253)..(270): n is a, c, g, or t
ccaaataggattactctactctgattttaaaccaataataccaattcatatttaccgcgctgtaatgcttgtttgaattggacctaccatcacgtaactctactccactgatatgaaattttgacactaatcgacactaatgacttttgaggaaattttgacactatttgcatttcataggttaattaaaatatatcgacaatttttgtgttttctgcgttattcctttaatttttagatttttagtattccnnnnnnnnnnnnnnnnnngcttgtttttagaatactttaccgtcatattaacataatatacagtatacgccaccctactatatacatgggtaggtactagtgatgtaaccaatgacattttttgaacattctcgaatactgatactaatgcaaatattaagtattttttttaatttgtttctatttttgtaatgtttccttttataatgaaaagataattgatattaaatgcatatcattctgaatcttaacggttattacttaataccaaataatagaaaaatgaaggctgataatgcctttatacaacgctgagtctaatcttgctatggctgctcattatgtccgaagttgaacgtaccgtctccccctctatctctctactcttatcgcatcaccgctcatgctaacaattctgactctgctgaactca

SEQ ID NO: 20032 - DNA, 814 bp, Diabrotica virgifera
  misc_feature (487)..(502): n is a, c, g, or t
  misc_feature (660)..(677): n is a, c, g, or t
  misc_feature (734)..(765): n is a, c, g, or t
caaactcatagaactattacatctttcaggacttgacactaaggacatccagattataaaaaatctatattggaatcaaacagcccacataaagaatggacatatggtgagtgaaaacataaccatttctagaggggttagacagggctgtattctttcgccactgcttttcaacctgtacacggaacaaatatttctagaggcactggaagagtacaatgagggcatcaagattaatggcgtaccaataagtaattttcgatatgcagatgatactgttatactggccgataacatcgaagatttacagatgatgctaaatagagtaaatacaactggcaaccgatttggactgaagatcaatagaaagaaaactaaatttatggtgatcagtaaaaagaacattcaacatatcgacctgaatattgaagccgaatgtattgaaagagtacaccgatttaaatatctgggatatacagtaaatgannnnnnnnnnnnnnnngtagagattaagatccgaattgaaatagcaagatccaaattcataaaaatgagaaagctcttaacccggcacctgccacgtggctttgcaaggcgccatgccaccgcgggggggggtttaacagcacccccttaaaaattttgctgagatctacttgnnnnnnnnnnnnnnnnnngcgttgagtaacgcaagaatatagaaaacatgtttctttaacttattagccactaannnnnnnnnnnnnnnnnnnnnnnnnnnnnnnngatgtattaccaaatttacaaggaccaagccataataaatgaatccagg

SEQ ID NO: 20033 - DNA, 641 bp, Diabrotica virgifera
  misc_feature (57)..(57): n is a, c, g, or t
ataagaaatatgtgtgaataggagatgatgtggaagagtttacttttagaagagggnagagtttgttaggagtttattgtaataggtggtggaagaggtggatgggttgtgagtggaggtgtgttagaagataaaaagtttagagttttagttatagaagatggagttgaagagtgtgaaatgtaaaaagtagatggagtgattttgaagtattagaataaagaagtagtggaatggagttatggtaagtgagaggaaagtgtggaatgaggtgtaataaaagggaggtgaaagtgtttaagagggaagatgataggaggatgattttttattaatggaatgaggatgaaaagaggaattggatgagattttgagaagaggtggagtggggaaggaattaaaggggggagatggaaagaggaagataagttatgtaggaaattgaaagataaggaagagatgttagaatatgagtaatgagtagggtgggtagaggggaagagggagtgagaatgataataaaatgtataggaaatatgaaaagcaatagttaaaggaggtgaagaaattgatattgagtgttatagagatatagtgggtgaagatgaaagtgaaggtgataatgtggaagcggtatgaaa

SEQ ID NO: 20034 - DNA, 727 bp, Diabrotica virgifera
ccccctccctcgcgtagttctagatctcgagagtcccctctagacgatcccaactattatacgagtgtcgattgacgatacaactcttctatagggtgacatctactcatctctcacagacacattatatacaatagtccagagacctgacatcatctggggcctaactcaccttgagtacatttaaaggcatccccactaatgcacgcgttgcagaaataggtttatacgcacatccgcatcacctctcttcatgaatagaatacatgaaaggtcaagggacaagcggcagaagaaggtgacatatggaagggaggacggaaggagactcattgacccaggtgaagtcaagagttgaattagagcataacgtccgcacttatacggtctcatcccctcctctctcgccaggatgaacgcactttaccacgctctaattctttaatgacggaatccattttgaggaaaatattggaatgagacttatgtaattccccttatctcccacttcaatagtgatagatgcgctgactaatatttgtattctcccgggatgaacacgacctctctgttgttaaaataaatattaacgcatttacgtatttagatgcacacatatcatatgcagcgaaaacatttatataccccgttattgcgatattgttaattatgataatgattattttatacagtgccaacccctcaaccatcttaaaaactaccccct

SEQ ID NO: 20035 - DNA, 886 bp, Diabrotica virgifera
gttgtatcaagaaaccaagaagaatgttgttaaaagtttaaaaggacaatacggatttaaaagatatattagagatggttttaggactgaagttgaaaaccctaataataggtattatgaaaaaggagaaataaagaactttgaaaatatagaatgtgaatggccattattttatattttcatgataatagatggagtatttaaaactcttcccgaccaaatacaagagtatcaagatttattgaaagaaaggattatgctcgatcatcatggagatcctgtaatccccaaatactactatgtatgcaaagaaaacatcgactcagaaagagctatcccaaattcaacagttagaagagcgcacacagacggtggcttattcctttggaaccagtccatgtttatactgtcccagctgttaactggtggattgttacatatcaacgagttggatccaatccgaaggtatttaccttcttacaatcgccctaaaaagggtggacgatattctgcttttcagggaactgcgaccgatcttgtcgtacaaatcgtgctcatcgctgaatccatgagactacaagccatgatggccacctacggcattcagactcaaacgccacacgaagtagaacctgtacaaatttggtcttccactcaactagtgaaagtgtacgagaatttgggcgtcaactacaaactaggactgaaaggccggcctctaagacctgtcggaagtttgggcaccagtaaggtctatagaattgctggagccacagttttgtgttatcccatcatatttgaagtgtctgatttttattctctatcgggatatggcgttgctgatcgacgacataaaaacggagctccaattcgaagggaaaatatt

SEQ ID NO: 20036 - DNA, 1090 bp, Diabrotica virgifera
  misc_feature (369)..(388): n is a, c, g, or t
  misc_feature (569)..(603): n is a, c, g, or t
  misc_feature (618)..(644): n is a, c, g, or t
  misc_feature (889)..(914): n is a, c, g, or t
  misc_feature (1025)..(1046): n is a, c, g, or t
gagaataatcaatgaagcttaattaacttgattaactctttgccgtttaatcaaagaagcaaagaattactttaaaaaagcatacgaacaaaccgaattttactgaagatgtcgattttgcgaccccaaaaaagatgcacagaagattggcactcctaccttgggcttccacctaaagtccccctcttaggggaacgttgatttatcaagaatctttacgctgtagaaaaaaatgtttcaagcaagaaatgtagctgagatcattttaaacaaaaatgtttattagcatttttttgggtagaatgaatctttctctcagaaacaacgcttgaagggaccggtgcttttgaatgttagttacacccgcgnnnnnnnnnnnnnnnnnnnnggacaccgcacacattttatggaagatataatgtcactcaaataaaattcgtctcgaaaatataatcatttcgtattattgctccaactctgaacttttattaataacggcgcacatacgtcgatttaatggatttacgcggccaaaattattttacagcgtatttctactaaaactggtnnnnnnnnnnnnnnnnnnnnnnnnnnnnnnnnnnnacgcatttttcacannnnnnnnnnnnnnnnnnnnnnnnnnncaaaatatgcaggtttttacttatacctcagtcggtatctgacatatcggactcagtatttggggtcacccggtaggtaacggcattttaatcgtttcagaacaaaatgattgtggtttgatccttttctgtacaccgttcttgcttctaaaaattgttaataactggtcagaaagtaaaagaagtttattgtcctgaacgcaactatggatttcccttgccctacctgggatctcctttttggnnnnnnnnnnnnnnnnnnnnnnnnnncaccgagccattaatatggaagtggttgtatggatgtaaactttaaccctcaaaagaaaaaaatccctttccttctgctttttctctctttttctccctttcatgagagannnnnnnnnnnnnnnnnnnnnncaacaaaaccaggacccccttttattttttcaaacagaagtttt

SEQ ID NO: 20037 - DNA, 739 bp, Diabrotica virgifera
  misc_feature (9)..(736): n is a, c, g, or t
tgcagtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtg

SEQ ID NO: 20038 - DNA, 615 bp, Diabrotica virgifera
gtgacactatttgagaggaggtgtgatacgtttttaactgaaagtaccgaacagcaacaagaagatgagcctggacaagatgtagacaagaaatctggaccttggaaacgcatcgacgtcggggaagcagcggaagtggagaaagttgaatataaaccggaaccgatacttcctaatgtatctaagactggcacttatatacccccaagtttacgatcttcaggacaaacccaagttcaaagtactaggctgaatagaacaaaagctgctccagatatccataacgaagaatttttcccatctctttctggtgatcataaaaaaaatcgtagcgaaggatcattcgaagtagtgcagtccaatagatcgaccttccatagaccagcggaacaatccaagataaactctgcgcaaggtcccaaatggaacctcgcccaccggtaccatactctaagtagtaacgagagctaagggcgttaataatccatagaaaccaatggggactggggcgagagaggtgggcccgcggataaaaaattgtaactttcgattgatttacccataactttgaaaaagcccggccgggttaatttttaaagggagatttgagggggg

SEQ ID NO: 20039 - DNA, 457 bp, Diabrotica virgifera
  misc_feature (156)..(192): n is a, c, g, or t
gttttatcatataatttgcataatatatgttttaattagtataagctccaactatgacttcattcaagttgattatctttagtattagtactgtcttagctataactaatgtagttgctgatgaatcttgccagacttttgcaggaggaagtgttnnnnnnnnnnnnnnnnnnnnnnnnnnnnnnnnnnnnnaatactcaaaagcagttatctcaaaacctgctccatattgggaagctacagcagttaaaaatggagaaattgttcaactgaaatctactgatttcttggggaaatacttggtgttcttcttctatcctcttgactttacattcgtctgcccaactgaaatattagccttcagtgatagaataaagaatttagaaagatcaacacagaatttgtagcttgttcagtggactcacattttacgcatctggcatggataaacccccca

SEQ ID NO: 20040 - DNA, 240 bp, Diabrotica virgifera
  misc_feature (2)..(20): n is a, c, g, or t
  misc_feature (22)..(155): n is a, c, g, or t
  misc_feature (160)..(216): n is a, c, g, or t
  misc_feature (220)..(237): n is a, c, g, or t
cnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggnnnnnnnnnnnnnnnnnnnnnnnnnnnnnnnnnnnnnnnnnnnnnnnnnnnnnnnnnggcnnnnnnnnnnnnnnnnnnaaa

SEQ ID NO: 20041 - DNA, 600 bp, Diabrotica virgifera
gaaagtgttatgttagttccacaaacatatagaagctacaacaattcacttcaacgtttaattaggccagtgtatttaaaattatcgcaattggaagatactgtcagagaacaagaatcaatgtatactctacttactctctcccaagatcttcaagaaattctcgaaccagtagtcttattgaaaaaattacatgataccatagttattccatattcagaaaacagtaacatcatctgtgctactacacttttagcacgtcttcacaacagtttgcagcattcagttaataaattagaccaagatctgagagtaactttgtacatagaaagtttataccattattttactgtgatacattcgtggtttatgaaaaatgatctcagtgattattctgatgaatttctaataaaaaagattaatggtactgaatattttaaactaaatccagaaatctcaaccggtacggagaaagtatgcaaagaagatggaatattaaacattattagcactactgttttacagataggcaaaaatcttcatttgattcgattattggaggatttttcgctgttaaacgaaagcacagaaacaatttat

SEQ ID NO: 20042 - DNA, 221 bp, Diabrotica virgifera
  misc_feature (13)..(30): n is a, c, g, or t
  misc_feature (38)..(56): n is a, c, g, or t
ggaacaagtattnnnnnnnnnnnnnnnnnnctcccttnnnnnnnnnnnnnnnnnnngggcatatctgaaaggacctgtgaaaaatactggctttagaccagcaatttggagtacatcgcatatggtatttacaagcattacctctagacctataacccatcaggctgctttcgaaaagaaggacttacccggcccgaccagccgaccagctccgattgaca

SEQ ID NO: 20043 - DNA, 215 bp, Diabrotica virgifera
aaaaatagatatttaaaattttcccgggccccccctattctcctttttttgggggaattttttcccttccgggttttttgctcccccccaaaaagctgggggaaaagaaaaaaatgctttaaaaatcaatttggggggccccaagggggggttaccctcacaatttgggcttcccaacccggggtaaaaaacccttgggaaattttctccccccc

SEQ ID NO: 20044 - DNA, 614 bp, Diabrotica virgifera
  misc_feature (2)..(48): n is a, c, g, or t
  misc_feature (64)..(123): n is a, c, g, or t
  misc_feature (125)..(158): n is a, c, g, or t
  misc_feature (164)..(238): n is a, c, g, or t
  misc_feature (242)..(307): n is a, c, g, or t
  misc_feature (324)..(341): n is a, c, g, or t
  misc_feature (429)..(449): n is a, c, g, or t
  misc_feature (464)..(481): n is a, c, g, or t
  misc_feature (491)..(515): n is a, c, g, or t
  misc_feature (556)..(598): n is a, c, g, or t
gnnnnnnnnnnnnnnnnnnnnnnnnnnnnnnnnnnnnnnnnnnnnnnnggtggaatggaggggnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnntaaagnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnncccacatttttttgtgnnnnnnnnnnnnnnnnnncccttgaggggaaacaccggcgaaatttttatttgggagaggtccaaaccccataaaaaaagaatatggccccctccccggttgtggnnnnnnnnnnnnnnnnnnnnnggggggagaacggcnnnnnnnnnnnnnnnnnngtgcgccccnnnnnnnnnnnnnnnnnnnnnnnnnttcggggttgaaaacccgcggggggaggccgcggggggtgnnnnnnnnnnnnnnnnnnnnnnnnnnnnnnnnnnnnnnnnnnngagagggggcggccca

SEQ ID NO: 20045 - DNA, 582 bp, Diabrotica virgifera
cgtaataacgcgatgctccttgacgtctgagacgttcggtccctagtagagcagattgtcgaatgacatgactggatggcgtgcgcttttgtatgaggcagcgggcgggcctcgcctcggcctcggcagcgggcggggaatcgataaaaagcggtattataaccagtaggtatgttttcctctcagagagctagagtattattatattttctagaaaaagcagttttgatatttttgagtattctttagagataatttttgtaatagaattgggttgttttttttcgatattttaataaactgattaattattgtggcaaaaaattacattatccattgcccctgcaaaccgcttccacgccccccaatcttctctgagccctttaccgcccccctagacgcctcccgcgcccacaattggggcggtatcgcccactttgataaccaactgcctacaaattgtacagcccctcgcgaaaccacctccaacctatacacccttttcccttcccattttaattatgtaaaatgtctccgacagtactccttggaaagcattcaaacaaagccaagcgatccatc

SEQ ID NO: 20046 - DNA, 392 bp, Diabrotica virgifera
  misc_feature (8)..(94): n is a, c, g, or t
  misc_feature (98)..(121): n is a, c, g, or t
  misc_feature (133)..(199): n is a, c, g, or t
  misc_feature (201)..(292): n is a, c, g, or t
  misc_feature (335)..(354): n is a, c, g, or t
tccttagnnnnnnnnnnnnnnnnnnnnnnnnnnnnnnnnnnnnnnnnnnnnnnnnnnnnnnnnnnnnnnnnnnnnnnnnnnnnnnnnnnnnnnngccnnnnnnnnnnnnnnnnnnnnnnnnaccctaaaaagnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaagggtaaacacgcggaatttttttttggggaaagttcnnnnnnnnnnnnnnnnnnnntggcgacccctcccctggtggggatttaaaaaggtttt

SEQ ID NO: 20047 - DNA, 845 bp, Diabrotica virgifera
  misc_feature (373)..(392): n is a, c, g, or t
aggttacctagcttattatatttttccgacgattttgattttagcgttaataccaaagtatcctgaatcacaatgtcccaattgtataaataacattcaattagatggaaaagcggtcattgataccgcgcgcaaattcctgcattggttttgaaatcgccaaggaatgtgcctctataaaagcactagtccttctaccatgcacaactttgaaaaaagccatagatagcttgtttatcaattccacatgaaaattaataacgttattgtcgtgccaatgtcaattagatttatcttcattagaatcatttaacaactttacaaatgaagtaaagaaaaacttcaacgaaattcacattctcataaacaatgnnnnnnnnnnnnnnnnnnnnacaacaagagcataaactaatgaccattttgaaattcattttgtagtgaattacttaagccatttctatttaaccaatcttctactgcaacaactatctctcccctctggaaaaagtatagttgtagtcatagcttcttctttacacgatataggtgaaattattctggatgatttgaacagtgaaagaaatactagaagagcaaatctttatgccacttctaaattggcaaatatttattttgctcaagaattatgcaatagggttacagagaaaaatattaatgtttatgcttgttgtccaggatgggttttcactggattatttagacacacaattgcggtggtatcacttttttatagttgctcctgatgcttttttctttatgaagagtccccagcatggtgcccaaactccaatttttttgtgctaccgaacctgagttggagtctg

SEQ ID NO: 20048 - DNA, 54 bp, Diabrotica virgifera
gccactaccggcgaagcgttgccctatgatttctaccaggcgacggcgcaggaa

SEQ ID NO: 20049 - DNA, 536 bp, Diabrotica virgifera
  misc_feature (21)..(41): n is a, c, g, or t
  misc_feature (290)..(310): n is a, c, g, or t
  misc_feature (348)..(367): n is a, c, g, or t
  misc_feature (404)..(423): n is a, c, g, or t
ttcgggcgattgaaaagagannnnnnnnnnnnnnnnnnnnnctttaaggaagacgacgaaacaaccccccggcaaagaaaagcaatacgaaggcaaaagagagccaaaacgcgcattttttttttgaaagacaccaaccaacaacacgaggagaaccaaaggaggggcacagaagaaagaagagaaactcgcagggacgagaaaagaaacaaaacacgcagacaacaaaagtgcgacagaaaaaggacgagcacaaacgcgcacacacaaaaacacgcaagtaataacannnnnnnnnnnnnnnnnnnnncactgataaattcttaaattaaaataaacatggcaaannnnnnnnnnnnnnnnnnnnatgacacacaccacgttcaggacagacgtatattaannnnnnnnnnnnnnnnnnnnacaaaggaatccaagactttttttttttcacatgaccccgtccaaaccagcacttttgaataaaatacaaagtctcacccgcccacagaccaatcccactatcccaaaccaca

SEQ ID NO: 20050 - DNA, 359 bp, Diabrotica virgifera
ttacggcgggactagctctagatcgcgggcggccgccctccccttatacggcgcacgcacgcgtgcctgcgacaacgtagatcttcaatagagacacctcaatccaatccactgatctttgtctgacaacgacgagactggcaaagaccaggcagccgagagaagaatgtacacgcagaaaaaccccattgcaacaactccaaagacagcaaaaaaggagaaggaaaagaaaccaaaccaacagctccagcgccaggacgtagagaagacaaagaccagaacaagaggcaaccgaggacgaatcgaagggagaactcttaacgaaagacgaccactaaggaaaatctgtttttcttccc

SEQ ID NO: 20051 - DNA, 988 bp, Diabrotica virgifera
  misc_feature (346)..(392): n is a, c, g, or t
  misc_feature (430)..(449): n is a, c, g, or t
  misc_feature (570)..(570): n is a, c, g, or t
  misc_feature (611)..(611): n is a, c, g, or t
gaaaatacaaccaatgtaaaacattgaagcagacataataatatgtaattttcttaatttttataatctaaaagagacagcatacctaatcattaagaaattttattacgggaaagtattattagtttacatctaagtcatttaatacatattaactaattcacggttttcggcaataacatttcttaaccataaacttatatttcttttagacgaactgatttctttatctcaaataaattaagaaagagaaaaaatcctcagcgttgcacccgccatgtttgatatagcgttatattgtaaatttctatagaagacgatacattcaagaaacctattatagttnnnnnnnnnnnnnnnnnnnnnnnnnnnnnnnnnnnnnnnnnnnnnnntgacaacgaaacccgatttgggcttcgaaacgttaatnnnnnnnnnnnnnnnnnnnnttgtggcttatttcccataaaaaatacgtaattataaaaatgccacaaggaaatagcttcagaacaacactattatagttgatacataagtaaattggacgaggtatatacacatttttanaaaggtacttacatgtatgaagttctggaaggtcccgcagntgggtaataagtcctttcttaatattgttctggaagtatatattatatcattcctgtcccagctttaaattttgggcatatttcccagttagaaaaaataagctcccttattttcgaagtccgccctccttaatacctaaaaaaagctattaagaaacctatttatatttcctttttttacccattcggaaacccaaacaatataaaaattacatctttaaattaccccactttaactttttatttaaaaaccccaaaatatagggaccgtaaccttccaaaaatatcccggttaaattttttaaagggaccccccaataaaacccccaaccttccctcctttattgaaacatggaacatttttccccccccctctt

SEQ ID NO: 20052 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 20053 - DNA, 685 bp, Diabrotica virgifera
  misc_feature (25)..(45): n is a, c, g, or t
  misc_feature (61)..(104): n is a, c, g, or t
  misc_feature (133)..(151): n is a, c, g, or t
  misc_feature (180)..(210): n is a, c, g, or t
  misc_feature (212)..(246): n is a, c, g, or t
  misc_feature (249)..(319): n is a, c, g, or t
  misc_feature (323)..(415): n is a, c, g, or t
  misc_feature (555)..(572): n is a, c, g, or t
  misc_feature (617)..(680): n is a, c, g, or t
atcgggcacattttttttcccctgnnnnnnnnnnnnnnnnnnnnntgattaaatattaagnnnnnnnnnnnnnnnnnnnnnnnnnnnnnnnnnnnnnnnnnnnntgccgtgctaaaggaacataatcattagnnnnnnnnnnnnnnnnnnngaaggaaggttggatgaaaaaaaactggnnnnnnnnnnnnnnnnnnnnnnnnnnnnnnngnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagggaaaaacaggggaattttttttgggaggggtcaaatccaaaaaaaaaaagattgggacccccccaagggtggatataaagagtttaaaattggggggtagaaccctatatttttttaatactcggtgtcgacnnnnnnnnnnnnnnnnnncttgagtttgggggttttaaacccgcgggggggggggccgcggcnnnnnnnnnnnnnnnnnnnnnnnnnnnnnnnnnnnnnnnnnnnnnnnnnnnnnnnnnnnnnnnngggca

SEQ ID NO: 20054 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 20055 - DNA, 892 bp, Diabrotica virgifera
tgacggcgtaaaagttttgctttttaaaattcaaaataatacttataataatctttaatctttatgttttggatatgggagataagagtttctgcataaagagcataaaaagacttacaccagttcctgaagtattaataactgcaaactttgatttttctgaagctctagaatcagtttatccattactagacattatatttgattacctagactttaacgatttaacgaggtgttgtcaagtcaagaactcatggaaagaaattgcagaaaatattttaagcaaaagagcccaagccagttggtttacatgttttaaaggatcaacaaccaattgttttgagcatagcgttaatctcaattacaataatgtaggatttggaataatattgtatgattttaggagaatcaagctaaataaatttatttgtgtacatacagagtgggaggagttgtcaagaaaaacagaaatgaagcaccttctgtagcagtagctggaggtatcataagaggaacaaaaactttccaacagatccatgctgcaaaacggatatacacaaataaagatatattttcaatagttttcctgaaggacaaaagcgaggagactgacttcaatgctttttcctgtgttattgtaggagatgacttgtccaaagatgaatttgctgaaaagctagtaaagtttagacaacaagtgttgttaagaacccaaacagtagccataaggatatgttgttcaaccaaagttgatgctgaccaaagaactttaattttcaataaaatatttcccaggaatacagttttttggattccatgcccacggagagataggtgggattgtgttttgcatcctaaggcttcggggattcttgaagaacttttgccaaaa

SEQ ID NO: 20056 - DNA, 677 bp, Diabrotica virgifera
ataaaataatttttctgcataaaggaataagagacaaaacagtatgtcagtgattaattatcttattacaatgttgataagaaaccgtgttactaattgagctgggtttgttcttataattgcctcttttattcattatccatctcttgggatatgttttaaattttgaagttgcttctgtgttacgtttcatattatgaccaacatcatcttcaatccgtacgcgtccactgctgaagataggtctccctcatctctttccatctgcgtctgttttgtggggatttcatccatttgtcctgcccaattccactgtagcggcgcgattctttcgacagcgtctgttgtttttgttctaagatatatttcttcatttgggattcggtctctcaggagacacaaaacatctggcgctccatagccctctgagtcacgcaaatcttgttcagtaccttttttgtgattgttaaggtagttcagtttaccaaacgctgtccaggctaaataatccaatttcatgtcctctaaattttgaagttacttctgtgttatgtttcatattatgatcatcatcatcaatccgaacgcgtccactgctgaacgtaagtccccctcagctctttccatctgcctctgttttgtgcggcttgtatccatttgtcctgcccattccactg

SEQ ID NO: 20057 - DNA, 323 bp, Diabrotica virgifera
  misc_feature (170)..(196): n is a, c, g, or t
  misc_feature (206)..(319): n is a, c, g, or t
tagataatttccttaaggattacagggaattttattggagaagtcaatccataataagaatgggaactccaggtggattaaggtataattggtggaacagtatattataagtctgtccacttttaaatttacatggtctgagattaaaccgggggggccaggtgggttcnnnnnnnnnnnnnnnnnnnnnnnnnnngcaaaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttta

SEQ ID NO: 20058 - DNA, 566 bp, Diabrotica virgifera
  misc_feature (89)..(103): n is a, c, g, or t
gaatcatcttctaattcgtaagaaagagtttctgtatagtgaattagtttaaggaaaatggaacttgaatattcagatgtttccgccgnnnnnnnnnnnnnnntgacgcccggaaaactaaaactaacagaacaaaatattatcttcaaaaacagtaaaagcggtaaagtacaacaactaccatcttctgactttgatgtagtaaactttcacaactttgctggtacttggggtattcgtttattcctcaaaaatggcactttacatcgatttgtaggtttcaaagattctgaaaaagataaaattgcaaagttttttagtaatgcctacaaaatagaaatgttagagaaagaactaagtacaaaaggttggaatcggggtacagataaatttactggatcagttttaagttttgatgttggttccaatagttcaattgaaataccgcttaaccattgtttcaaatgcacatgatgaaaaaatgagattactatggaatttcaccagaatgatgatgctccagtgaccctcatggaaatgaggctttttcatttcctgctaatgaa

SEQ ID NO: 20059 - DNA, 443 bp, Diabrotica virgifera
gatagagctacgattatctagcctttattatatattaactaatatttgctgtttgggtctcctgtgtttccatctatggtacacatcataccttaatatctcttgcaggatccggtttgggtggtcttctagctcagcaaattttgttctggctttttcctccataatattcagtactcttatttgttttaggtttctaaataagaaccgttcggcgacatatctgggcacgattgcagcttctctgaggcagttgttgtgtgccgcttgtatcttctttttgttactttgactcgcgtgaccccatgcaagagatgcgtatgtaattattggcagagtaatgctatttataagtcttaattttgttttcatagctaatttgcttcttcttcctgtgagtcctcttattgccccctctggccgctgctgttttctggactgtt

SEQ ID NO: 20060 - DNA, 964 bp, Diabrotica virgifera
  misc_feature (107)..(134): n is a, c, g, or t
  misc_feature (550)..(550): n is a, c, g, or t
  misc_feature (676)..(676): n is a, c, g, or t
tcgtcgtatatctgtacttctaggtttgtcccataatggcttactacccttagatttttcaaagccaatatctactctttctagcatctgtacatgctttacatacnnnnnnnnnnnnnnnnnnnnnnnnnnnncccatatgttcaatatctttatagaaccagtaagtaatctgcaaataacaaagtattgttgatcagcaatcccactattttatacttgcatttcagctggtttaaaacttgttttagatacattctaaataatatcggagactgataagagccctgtttaggacttttcttaatctggaaatccttcgatagactattcccaatcacctttgttctatcatctttagggtacattttttgccacacttatgcctggttgcaccaacaaatcttaagctccagcttagcccagctcagtatagatgtcgccttaagtctcacttatgttgcaccatgattttcgattcttatctaagcacgtcttaactgagaagtttaaggttcaatccacgtggcaatctattgcggcaagctgnaaattgatctaaaacttaatggtgcaacgtgtacttttcgtaagctgagcataaggcatgtcttaagcttaagatctgttggtgcgaccaggcattattaatttatgcttatgttcgtttctcgtnagctatggtgcgggaataagctatattgccttcttcttcttggtctattcttcctcctcctcctcttcctcttcctcctccttcttcttccttccttcctcttcttcttcctcctcctccctcctccccttcctccttccccttccttcccccttccccctttcctccaaggggccgccctccaaatgggggggtggatatttttctccctaatttttttcctctcccccccgtggtcctaagagatttaaaaaaaccggccccaaacccccccccccttaaattttt

SEQ ID NO: 20061 - DNA, 383 bp, Diabrotica virgifera
atgacgtttaattcatgattgcgtctgaatatcattactatgtgctcttctgaggccacctattggatcattacttagcgaacgattccccgtcccgaccttacctgcttctctgatgaccatctcctcaaagatacactacaaccgcgtgggcagcgtttctccctgacttaccccttcgccgaccctaatctcatctggacccattccatttatcttacccctggtctctgtttctctgagaggaacttgtaccatctatatctgctcttaactactaccaatttcacttcagagcacggcatcaagatgagtacgagtttattgttatagagctatcatgagtattacttatgtctcatacatcattatagtagacatcg

SEQ ID NO: 20062 - DNA, 764 bp, Diabrotica virgifera
  misc_feature (526)..(545): n is a, c, g, or t
caccgactgccggcgattatttgcaagcgtcgatttattccgcgttgctttgataagattgttgtgaatctaccgccatcaaaagcctaaaaagcgtgaagcttttacctaattatttaactgtaactactttacacatttcgtcaaaatgggagatgaaaagaaggccagcgataccgcagacattaatcgccaagaacttggccaggataatgcatggaggaccattatacaatcaacatacaacgcaccccatgaacacaattgatgaccgcctattcgggatcgtgctcggtataagcacacgagtgatcatattatactatctgcatggcaaccccatacaacgacacgatatactcctaatatctttagagatggatgaaggcagacgcgattgaagaatatcatccacggacgggcggtttcttctatcgggtcctattcctttaaataatcacgctgtattgatcatgcattctcctatttgctagattaaactagttatctatcatcgatcagccannnnnnnnnnnnnnnnnnnnatactagcggaggataccgccaggatgcccgttcctagaggaccctgacttgcacacgcgcgtgtgggaattcttaacccctcctatatcgataccaaaatagaatatactgcccgacaggttacaccgatgggacgagagaaaagccccggcgataccctattaaatcccccctggaaaaacatcccccgttttcgctggaggagcgaactatacaag

SEQ ID NO: 20063 - DNA, 1190 bp, Diabrotica virgifera
  misc_feature (4)..(63): n is a, c, g, or t
  misc_feature (65)..(91): n is a, c, g, or t
  misc_feature (96)..(159): n is a, c, g, or t
  misc_feature (167)..(255): n is a, c, g, or t
  misc_feature (279)..(331): n is a, c, g, or t
  misc_feature (333)..(351): n is a, c, g, or t
  misc_feature (353)..(391): n is a, c, g, or t
  misc_feature (443)..(461): n is a, c, g, or t
  misc_feature (464)..(478): n is a, c, g, or t
  misc_feature (860)..(1089): n is a, c, g, or t
  misc_feature (1094)..(1106): n is a, c, g, or t
  misc_feature (1109)..(1156): n is a, c, g, or t
cggnnnnnnnnnnnnnnnnnnnnnnnnnnnnnnnnnnnnnnnnnnnnnnnnnnnnnnnnnnnncnnnnnnnnnnnnnnnnnnnnnnnnnnnctacnnnnnnnnnnnnnnnnnnnnnnnnnnnnnnnnnnnnnnnnnnnnnnnnnnnnnnnnnnnnnnnncattatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgcaatgacatgctattcgcnnnnnnnnnnnnnnnnnnnnnnnnnnnnnnnnnnnnnnnnnnnnnnnnnnnnncnnnnnnnnnnnnnnnnnnncnnnnnnnnnnnnnnnnnnnnnnnnnnnnnnnnnnnnnnncaaatacaattttattaaaacttaattcttaactaaaaattacgattcaacnnnnnnnnnnnnnnnnnnncgnnnnnnnnnnnnnnnatataccatcatcttcattcccttctaaattctccattaaaatatcaatctcacttattcaaatctcaccactgatgataatattagtactacaaaattgtacatttcctacaaatataccggtttaataacggaactcggccaccatttttctcaccctgctattacaaacattgcctttcgtattaaaccatcaaagcccgcccgcccccctgcataactgacatgcccccggcattttgacccgcgctaccggtacctaaacccttccctcatccctattgaagcccctcaccacgggcctggctcaaccaaaccctcgcccccccccttcctctaacacaaccctcccccacgttcaaacctctccacttccctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctnnnnnnnnnnnnnaannnnnnnnnnnnnnnnnnnnnnnnnnnnnnnnnnnnnnnnnnnnnnnntcccgctcccctccctcctcctacccacatgctt

SEQ ID NO: 20064 - DNA, 341 bp, Diabrotica virgifera
  misc_feature (2)..(27): n is a, c, g, or t
  misc_feature (29)..(84): n is a, c, g, or t
  misc_feature (101)..(134): n is a, c, g, or t
  misc_feature (143)..(201): n is a, c, g, or t
  misc_feature (218)..(232): n is a, c, g, or t
  misc_feature (234)..(269): n is a, c, g, or t
  misc_feature (281)..(321): n is a, c, g, or t
cnnnnnnnnnnnnnnnnnnnnnnnnnngnnnnnnnnnnnnnnnnnnnnnnnnnnnnnnnnnnnnnnnnnnnnnnnnnnnnnnnnaccttgggtatcagggnnnnnnnnnnnnnnnnnnnnnnnnnnnnnnnnnncaaatttannnnnnnnnnnnnnnnnnnnnnnnnnnnnnnnnnnnnnnnnnnnnnnnnnnnnnnnnnngatggaaaggtactcgnnnnnnnnnnnnnnncnnnnnnnnnnnnnnnnnnnnnnnnnnnnnnnnnnnnccatatatttcnnnnnnnnnnnnnnnnnnnnnnnnnnnnnnnnnnnnnnnnnggggaggacctaaaaaataa

SEQ ID NO: 20065 - DNA, 90 bp, Diabrotica virgifera
gaacaatcttacactattcccaactttccctggccgcccatcattcccttcttttacgccccttttcggccccccggtcctttctccccc

SEQ ID NO: 20066 - DNA, 432 bp, Diabrotica virgifera
tttcgcccgttccatttattttaaaatagtactatattttttctttttaggaaacaataactttatttaaagatagttaattctcattgagagagaggacttaattattgtaatcgatttttttatttattgtagctggtgtatcaagaattagtacataagaattataaatttatcatttgctattttaaaacagctagagaattacagctatcattgcaagatcaggactctaaataattgtattgtaatgacaagatataccgtgctaactagatcttattatttaatagagagtttacattgatatataacccacatatttgtcatctcagagtcttaatatcactttattagaaccatttacagggcatgcagccttacagagcaaatattcattagaacccttaatcttttgataatctttaggaa

SEQ ID NO: 20067 - DNA, 532 bp, Diabrotica virgifera
  misc_feature (26)..(48): n is a, c, g, or t
cattctaggtgatggtaaagttgagnnnnnnnnnnnnnnnnnnnnnnnctgtaatattttgtaaatttatagttctccgttagaatcgagagttgtaaatactgtacacgcttttgttatgttataattacatgtgtgacgatatatcctcgaattcaaaggaaatgtctagtaagagctccctaagtaacaatacatctgttttaaagcagttcgatctggatcaaatatggggagatctacatgctggcatccagcaagtctacaatcgagaaacgatgcataaatcacgttacatacagctctatacacacgtctataattattgcacttccgttcatcaacagaacaatggacgagcttcggcaaatgcaaatacaaagggtaaaaagaatcagatcggaggaggtgcccaactagttggattagaactttataagagactgagagactttcttaggaactatcttgtgactttactcagtgatggactacatcgtatggatgaagacgttctcaaattttataccaa

SEQ ID NO: 20068 - DNA, 768 bp, Diabrotica virgifera
  misc_feature (103)..(115): n is a, c, g, or t
  misc_feature (118)..(202): n is a, c, g, or t
  misc_feature (237)..(267): n is a, c, g, or t
  misc_feature (269)..(287): n is a, c, g, or t
  misc_feature (404)..(426): n is a, c, g, or t
  misc_feature (516)..(540): n is a, c, g, or t
tggaaacggttaagtttagaaaaaaatggtataggacttttttgttctaaattgtgtgttctatccataccttaaaggaacgcactattttccgggacacccnnnnnnnnnnnnngannnnnnnnnnnnnnnnnnnnnnnnnnnnnnnnnnnnnnnnnnnnnnnnnnnnnnnnnnnnnnnnnnnnnnnnnnnnnnnnnnnnntagaagtaaaaaaaagtaattaccacaaattgaannnnnnnnnnnnnnnnnnnnnnnnnnnnnnngnnnnnnnnnnnnnnnnnnngtacttactacttacgtcatgaaataagaaatgtatgactatgaatctgcaatcaatcacaaacaagtctggctaattggctctgccaaagccgaaaaaaaaactcatctagatacnnnnnnnnnnnnnnnnnnnnnnncgaatgaaaagtaaagataataatacgagaatacttataaacaagcccatctagatggaaaacattcgacaaaaaaaaactaaaatgggnnnnnnnnnnnnnnnnnnnnnnnnngttgaaggatatttaaatgatacaacactttacataactttaaatctttaaaaaccagaatttgcaagctgtaacaatattttaggctaaaaattagacataatgtcaagaaattcttcccaagtattttgtgcgattgtgcgaacttaaaatccgaaacaaaaacctcgaacgtctagagggtatccccggacacgttcagaatctggtttctgtaatgcgcatgcg

SEQ ID NO: 20069 - DNA, 678 bp, Diabrotica virgifera
  misc_feature (182)..(204): n is a, c, g, or t
  misc_feature (210)..(227): n is a, c, g, or t
gcaaagtccccctccctcttctgtatgaagtagtttatggatgctctctttctggaataaattattaagttatactgatttttcagtcaatgttgtttctgataattttaacttttatgtattttgtacagtttcataaaatagaacaccaataaaattgacatgctaggagccatgtaaannnnnnnnnnnnnnnnnnnnnnntattgnnnnnnnnnnnnnnnnnngtaaaacaactgaaatgaaaatgtgggagaaaacaattccatcttgtgacccacggctcaaaaattacaaaattttttcttaagctataaactggtgaagtaagctacatatagatatcgaatttatgaaaacaatgttacaaaaaatgtcatgttttgataatttggcagtaaagtaaatcatatggacggagttatgcatctctcttggaccatcactcctagtggagtattgggcgcatctgcgtttcttggccgatagtgtaagacagctggtggccagctcagcgcgtcttcttgtgtttattctctggttaatctgcgtaccagttccttccattctcctctgtttctttgcttgtttttcacttccccccaacttaagccgattctgttgtgttctctggttactgttttctttcagtattatctggtcgccccctcttccttg

SEQ ID NO: 20070 - DNA, 168 bp, Diabrotica virgifera
  misc_feature (2)..(152): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaagacccctatag

SEQ ID NO: 20071 - DNA, 338 bp, Diabrotica virgifera
  misc_feature (47)..(81): n is a, c, g, or t
ctccccttttgtccgagacgagaagagaagaagcatacatgcctttnnnnnnnnnnnnnnnnnnnnnnnnnnnnnnnnnnngactacgatccagcggatttacaacgaatgttattttcatggaggatacgaccccacacaaacacatgtatattcccacggaagcaactcatgatgggatggcactcacatgacgatgacatcaagtagtgaactgtaatgcaatggcgcacatacgacgacacggtatggagcgctcatcatgctactatgactaacgtgtaacgcatataggggacatgatgatttcctatcttaaacaccagttctgcctatgg

SEQ ID NO: 20072 - DNA, 647 bp, Diabrotica virgifera
  misc_feature (256)..(274): n is a, c, g, or t
cttgaaactttagattaaggttttctgcaaccccttgatggcgactgtagttcaacttaagttgagatataagtaaagtcaattaaatcatggcataggtggttccatttcatctcgtagcgcgacggttcgtggccgaactgtcgtcgttaccaagtgtcgccgttacgaactgtcgctcttacgaattgtccgttgccaactgtccggttgcgaactgtcgcgttacgaggtccctgtcacgggcataggtacnnnnnnnnnnnnnnnnnnngcatttagacattctactagtttaatgggtttgttaatgacagtatagagtactactaacataacaggtcgtggaagctatgcatttatgagtttacttaatagatttgtttccacgatctctgctttcttggccatacctttaaacattaatattaataaacatattatgtatttttttatattatacttgtataccttaatttattttagtgtaagtgtacttataggtggctagtgactagaaaataattatttttctcacaatgaaatgaactaacagtatttaaatcttaattactattgcgatttaagaaaaataaccacttttcttaacatagattcctatttataatgtttactttatgccgttt

SEQ ID NO: 20073 - DNA, 163 bp, Diabrotica virgifera
gtggcagtggtggagcaatattgctcaaagcaggcagccatctcactggggttgattttatttgacgaaatattgatagcccaagatgaagatagtctgcgaagactagtcctcaaatttaacataaagagacaaagaatttaatataacaatctcacctcat

SEQ ID NO: 20074 - DNA, 862 bp, Diabrotica virgifera
  misc_feature (119)..(136): n is a, c, g, or t
  misc_feature (416)..(432): n is a, c, g, or t
  misc_feature (665)..(684): n is a, c, g, or t
  misc_feature (696)..(721): n is a, c, g, or t
gttgtgcgtgcggaaggaaacgcgtccaacctgtagtgtaggtactctgaaaattttcagaaagtggtaaactcgctcaaacgaagcagttacaaccatttttaagacttttgtaagcnnnnnnnnnnnnnnnnnncggtgtattagggactatttatttttgtgctaacggctttttaaaacaaagaacagactatgctttaacatcttgcacaatgtcaaaagctctaagaagactcctctttcgaggccttagtcagaagaagacatatacagtgattaaatatacgggtataggtttagtgggtggtacagctacgttggctgcaacaccaattatatcaaattgtccagaagaaaacactgttattaataaaacaaatggagtattaaggtttttaagatctataaaaatnnnnnnnnnnnnnnnnntagactattacttttcctcgatgggattagatgaatcaggtaaaagttacaaatttatgatgagccgaattcatcagcggtctgctgagcgccttctacatggttgtctagtcaatggcggatcttatataaaactaggacaaggtttatgttcaatgggccatatacttcctgcagaatatgtagaaacgttaaggtgtctccaagataagtgtttgcagagagaagagggnnnnnnnnnnnnnnnnnnnncaaaaagatttnnnnnnnnnnnnnnnnnnnnnnnnnnaaggatttgataaagaagccctattgcttgcttgctagtattggcccaggggaccaaagcggaacgaaaagaaggggaaccgggactcttgtaagggcccagtacactcaccttcctagcacccgattccctaccgacttt

SEQ ID NO: 20075 - DNA, 534 bp, Diabrotica virgifera
  misc_feature (217)..(235): n is a, c, g, or t
caatgagatgcagtcaaaaatttgtaaagccagtgtaaaacccataatcatatatgcaccaagaacaagacccgacacagccacaacacaaaggttactggaaacggtggagataagaatattgaaaagaattaccggaaatacactgagagatcgaaaaaggagtgaagacattagaagaaaatgtaacgtacagtaataaacgagtggagacacnnnnnnnnnnnnnnnnnnnggaataaccacataagcagaatgaagagacccgtgttgtaagaatagcaagagataaaatcaccaattggtagaagtatcggacgaccgcattccatggaggtatcaatccgccaatgaacaagcagaagaagtagtgtacatatttgctttaccaaatctgggacatgcaatgagaacacagtgatatgaaacgctagattgataatgcaggtaaatataagagaaggataataggacgaaggagagtgtcatagttaaaaagattaaggggactgggttaaatacagtgcaatagca

SEQ ID NO: 20076 - DNA, 398 bp, Diabrotica virgifera
gccaagggcgcccgcctggtggcggccccggggggccgcccttaaaaggcgcacaccgcgccacggagaaagaatgagccccacaagggggaaggggccggcaaacagattttccttccaataagcgaaaaaagaaaagaagatatggatggaaggacacaaagcggctggtaaacccacgatccgtataaaaatataaataaggagacatcgtaacaactattgcaacaatcggaattactgaggagaccggagagtataagaacataaatatgacacgctgggaagtcggcggtcaacatttaatgaagccattggggagagactaccaccacacggcataccttcttattttcgaaatgaaccgcaacgatttgggggggatcagagacgctcat

SEQ ID NO: 20077 - DNA, 59 bp, Diabrotica virgifera
tttatagtaggggttgtttgagtaagtttatagtttattctataggtgttaaataggat

SEQ ID NO: 20078 - DNA, 852 bp, Diabrotica virgifera
  misc_feature (152)..(170): n is a, c, g, or t
  misc_feature (521)..(542): n is a, c, g, or t
gaacctcgatgtgcgaggtttgtgtttaatttatcctttggcgctgtagaagtttattacacggccagttttgtcaagtttagaaacaagatttgggcaagaggttcgtaagagggaagaatagaagaaagcaactaatacagtttgtagcnnnnnnnnnnnnnnnnnnngaagataacttgaaaacggagactaaactttaatgaactatcaagtttattatcattaacaccttttattctcggtaacaagtatgtaaaagcaaatattatttatggagtagaaaaaataatgtttgttccacttctgtcaagaagacagaatgaaattcaagctggttaaattaaataaaagattctcttgtctaatgaattgcattgaagatatcttcacctgattgtcacatgcctgtcgaaaatatctagctatatcagaataataaggactttcataaattacgaaaaattaacgaagcaaagaaaactgtttgaaaatcaattaagaaacattcggaaaggccnnnnnnnnnnnnnnnnnnnnnnacataaaatctaaagatatataaatattacatttatatgtacggatttaagaaaatgaaacctggtattcaatatgtaattccgaaaaatatcacatagaaataaaatttattatacataccaacataatctgatgtcttgaagtattcctatattggaagaatgttcaaaatattgctttcatgtgttgcttaaagaaaaattcggaacactgctatttcctcttttctatgaaaatttttggcccttacatcctccccgatgaaacgtaaatatggaaattaaccaaaaaccttacaaaatagcctcc

SEQ ID NO: 20079 - DNA, 308 bp, Diabrotica virgifera
  misc_feature (24)..(24): n is a, c, g, or t
  misc_feature (82)..(109): n is a, c, g, or t
ttttaaaccggtggagatagagantggaggtaaatcggaacccttataaattttattgtaagattaattttgaatagtaggnnnnnnnnnnnnnnnnnnnnnnnnnnnngggtatttctcttaatatattaactatcggtgagagtggacataaaaatttggggaaacctactattaatggacttgtaatatataaatgcggtggcaaggtgaagtgatagatggaaaagttcgaaaaaaacgcccttacaagcgtttgggctatctgaataggtgtgtgggatcccgacatgtaatggcgtaattag

SEQ ID NO: 20080 - DNA, 530 bp, Diabrotica virgifera
  misc_feature (9)..(42): n is a, c, g, or t
  misc_feature (44)..(344): n is a, c, g, or t
  misc_feature (346)..(387): n is a, c, g, or t
  misc_feature (393)..(462): n is a, c, g, or t
ttcgtccgnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnnnnnnnnattttttctgaattataaagaataacatttacccttaaggggattaacacgcgtaaattttttaattt

SEQ ID NO: 20081 - DNA, 987 bp, Diabrotica virgifera
  misc_feature (747)..(762): n is a, c, g, or t
  misc_feature (764)..(786): n is a, c, g, or t
  misc_feature (923)..(951): n is a, c, g, or t
cgcgtaggttatggcaatgttaccaaggactagacacaaaaagttagttttagggtttaaagtgttaagtttggtttccgtttcggttgtttatttactaataagtgtattttcgagtgaacagcggtcagatacttacgatgttctagacaatccatcaagacgacacctgttgcaggtcaacaacgtgaccgatcatcccaacgaaaattgcacttctcctgcaattaacgaatttccctcagatggttttaccagggaacaacgaagacatggagccatcgttctgcatatactgctgtcttgttatttgtttgtgttgctggcgacagtatgcgacatctattttgtacccgctgtcaaaaaattctgtagtaatttgaagatgaaagaggatattgctggggcaaccatcatggcggtggccaactccagtgctgaactatttattaattgtgttggtacatttgtaaccgaaggagatttgggaattggtacaattgtcggatcagcagtatttaacatattagctataccagcgagttgcggtctttttgcaaatatggcaatggatattgaatggtggcccataacccgtgatagtacaatgtatggttttgcagaaattgctttaattggaattttaaaaaatgggacagttcttattaatgaagctattgttttaatggggtggattctctaaatattttattgatggggttcaaacagccacctttataagatagnnnnnnnnnnnnnnnngnnnnnnnnnnnnnnnnnnnnnnngggaagaaaggggaaaaacccctcctcttttttaccggaaaaaggggaaaatttcgggaatttgccaaaatcctttaaaaagaaaaaacctttggggactggaaaaattttgggatctacaaaatttttgtattggnnnnnnnnnnnnnnnnnnnnnnnnnnnnntttttgggggttattttcttggcccttttttttttt

SEQ ID NO: 20082 - DNA, 295 bp, Diabrotica virgifera
ttcttccgtctcttactaattttttgctccgtgaaggagaataaaaacaaaaactaggaaaggaaaatttccttcctgccgttttatgttcaacctaggcccatagaaaatagaggattgttttggagatccctacctgactgaaaagcatttccatttcctcatccatccgatccggtcctttcggggcggcattggccaccagattgtccgcgaagtgcctgaatggaacgtacttgctgataggaaagttgggcggcggaacgactgacttcgttttaccctgataataccc

SEQ ID NO: 20083 - DNA, 940 bp, Diabrotica virgifera
aaacaatttagaaatgtaagtaacttaaataagcatatgaaaattcacagtggtgaaaaacctcataaaagtgaaattagtagtaaccagtgtactaaactaagtaattttattagttcgctctggtgaaacaccatattttaccgatatttactgtaaaaacttataattataatgaaacgagcggttcgtatttatatacgactttatttatttatacaaatttacgttacaaattctcgtttataattaattataagtaactactcctaagaattcacatccttgtgatattgaatacaaacataccagccatgttcttgaacgttccagaaaaaccgaaccgcccatccctaataatccgtagccttgaccagcgagcattcacgagaaattctttcctcgcttgttcgctgcgtcattcttccagatgtctccgtacgtgactggcttttgagacggaacctgttgtttgcggtcgataattcgtcacaatataaatgtgaaatagtagtaagctgtttactctaaaaagtaatttaaaggttcatatgagaattcacattagtgaaagaccttatgaatgtgaaatttgtagtaagcagtttgctcaaggtttaaaggatcatatgagagttcactctggtgaaacatcatattgtaccgatattgactgtaaaaacttacaattataatgaaacgaacagttcgtatttatatacgactttatttatttatacaaatttactttacaaattctcgtttataattataactactcctaaaaattcacatccttatatattgaatacaaaaataccagcccatgttccttaaacgttccagaaaaacggaaccgccccatccctcgtaatccgtaacccttacccacccgaaaattcaccagaaaatccttttcctccctttgttcgcctgggcc

SEQ ID NO: 20084 - DNA, 553 bp, Diabrotica virgifera
  misc_feature (250)..(469): n is a, c, g, or t
cggacgcgtggggctctttcttgattcggtgggtggtggtgcatggccgttcttagttggtggagcgatttgtctggttaattccgataacgaacgagactctagcctgctaactaggcgtatttcgacatcccaaaggcccgtcggtggagtttcctgctcttgctgcacgcggtttttactgtcggcgtacacacaattcttcttagagggacaggcggcttctagccgcacgagattgagcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactaccgattgaatgatttagtgaggtcttcggactgagcgcgggggcgtttcggcgtccgcgatgtttcggaaagaagacca

SEQ ID NO: 20085 - DNA, 909 bp, Diabrotica virgifera
cagtgacggtgggtgactaataaaataactggtacataaaaaattccagtgcacaaacagtacactattgcaggtaatttgggtggattgtttaccttctagcttctgggattttccagatttttttcgaattgtgcaatcaagtaaataaaacgagccgcgtaacctcaaaaaattccacttttataaaaacttcagtccacaatgagccaatttgcctcggcgatgcccagtaggcaattcctttgggatgtctttcaaagggttgatagggatagaagtggattcattaatgccgacgaacttgggtccgccctttccaatggaacctggagtccctttaatccagaaactgtcagactgatgattggtatgttcgatagaaacaatagaggccaggtcagttttgaggatttcggagctctttggaagtatgtcacagactggcaaaactgcttcagatctttcgatagggataactcaggcaacatagataaagaagaattgaaaacggcacttgtgtcattcggttatagactctctgatagtttaattaatattcttctcaggaagctcgacagacacggtcacgggacaatactgtttgatgattttattcaatgctgcattgtattatatacactcaccatccctccttccgccagaacgacactgatcaagacggctacatcaccatccactaccagcaggtcttaactaatggtaatccagtcccaaaaggtctaaataccccttttcaatcagtttttttatccaaaggttacccaaaaaagacaaatgatccatgaaaaccacataaatgacgccccccaacgcgaacccccacacccacttttttcgattatttcaaatcccttttcccaaataactcctacaccactttaagga

SEQ ID NO: 20086 - DNA, 683 bp, Diabrotica virgifera
  misc_feature (348)..(361): n is a, c, g, or t
  misc_feature (363)..(375): n is a, c, g, or t
  misc_feature (400)..(466): n is a, c, g, or t
cggacgcgtgggcgcttgaatacaaaacatcactagattaaaccaaagctaaaaatggcagcaaagttggccttcttctttacgttcttcctcgtagctgtatatgttgcacaagctgctgaaatccctaagactcaaacaactgcagcgcaagatattgatagtaccttagacaatttgaaagctggctttgaagaattcgtcgacaaagttaagaataatgacattgttaagaaagctacacaagggatcaaagatcttggagacaccattcagcagaaaggaaaagaagcgtatgacaagataacatctgaaacgaaaacaagataaaccgtttcaaacaaatannnnnnnnnnnnnncnnnnnnnnnnnnngtttaaattaaatgtttatttatannnnnnnnnnnnnnnnnnnnnnnnnnnnnnnnnnnnnnnnnnnnnnnnnnnnnnnnnnnnnnnnnnnaaaaggaatccgaaggtgacgcaagggagcatgccgacggtaaaagcccttcacaatcgggtccccctaaactcctagtaatgcggccgccttttacacccgcagggaaagcgaaaaccctggaagttaccccaagtttagtcccccttaacaacccctccccccttctcccccacctcggtggacatatttgcacaaggccccggaccatttcccc

SEQ ID NO: 20087 - DNA, 87 bp, Diabrotica virgifera
  misc_feature (2)..(74): n is a, c, g, or t
cnnnnnnnnnnnnnnnnnnnnnnnnnnnnnnnnnnnnnnnnnnnnnnnnnnnnnnnnnnnnnnnnnnnnnnnnngacccaatttttt

SEQ ID NO: 20088 - DNA, 333 bp, Diabrotica virgifera
  misc_feature (61)..(94): n is a, c, g, or t
  misc_feature (122)..(186): n is a, c, g, or t
  misc_feature (211)..(225): n is a, c, g, or t
  misc_feature (228)..(240): n is a, c, g, or t
cccccccttcggcttttatttattctaaaataataagatattttttacctcttagtacagnnnnnnnnnnnnnnnnnnnnnnnnnnnnnnnnnnggagagaatattgtatttttataacatnnnnnnnnnnnnnnnnnnnnnnnnnnnnnnnnnnnnnnnnnnnnnnnnnnnnnnnnnnnnnnnnnccctatttaaaacagctacaatatnnnnnnnnnnnnnnnagnnnnnnnnnnnnncctaacttcttcgtaatgacatgttattcgaatttccatatatctagtttttgaagaaatagagtaatttcatttattacacttatacttata

SEQ ID NO: 20089 - DNA, 149 bp, Diabrotica virgifera
  misc_feature (2)..(16): n is a, c, g, or t
cnnnnnnnnnnnnnnngtgacataaaacaggttaaagaaaaatatcatcccaattctctaggctacccaattaccttatcttacactgtgaaaaacctacaacctacccacattaatccccttgcctcacatccccctatcgccaactg

SEQ ID NO: 20090 - DNA, 783 bp, Diabrotica virgifera
gcacagacgaggggacgtccggtttaacaaaatagcagagatcccttcacaaacgttcagcgaaaacaacaaattggttactttacttcttaattcaaatcggcttacatcactgcaagaaggcgttttcgatggacttgacaatttacaacatctgtatctttactataataagattagatttatccatccgaacgccttccaaggactcacaaaattggaaagattgtatttgcaccataatcaactagaggagatatatcccggaactttttcaaatcttccttcacttaaaagattaaacctctaccacaaccgtttgaagcatctcccagaagaaggtttccaacatttaccaagtctggaaagacttcgtttggatcataatgccttggtttgcaattgcgatatgttatggttgtcgcacatgtttgcttctaattccgtggaaggttcggcacattgcaaatatcccatagaaatgcaaggaatgcctttaaaggaagcagacgcggaacaccgacactgtgagtctggtttgataaaggaaggaccacgagatatcaaaatatcctggggccaaaatgccgtcttcacctgtaaagtctacgatccatcaatatcaatcttttggatgagagacgaacaggaattgcctccggatcaccaaaaatatattatcatggataacggaacacttcttatccaaaacgccaatgaaaacgacgatggatactatgagtgcattgcgaaaacccccgaaaaaggaagaaacatctgccc

SEQ ID NO: 20091 - DNA, 647 bp, Diabrotica virgifera
attttacactacattttcgctcgctcgatacggtgtgtttctgaaaggagggaaatcagtgggaaaagtgttcgctttttttgaattagcaggtgttttgggataggacatcgggtcagttcactcgggattttacagtgagcggcagcaaacaggacaagaagatgacgagtgtcggggatattttggattataagaaaaaagatgatgaagattattattccatattgggctgtgattcgaattcttcggtggaacaaataaatgctgagtttaaaatacgagctcttcaatatcaccctgataaaaatgccggaaataaagaagcagaacaaaagtttcaattactaaatgaagcaaaagaagtattgactgatgctcaaaagaggttaaattatgataaatggaagaacagtggtatagccatcagctacaagcaatggttgggaatgaaggaacccgtacaccagtccatgcactggagtaacctgaaaaccaaagatcgcatgctagaatcagggggcaatttccggcccttctagccctaggagctgggggggacttccccccggttcctcgtaaaacttcttgaggggggtggcaaatccccatttcggggcggccgagcaaggagggttcggccctgg

SEQ ID NO: 20092 - DNA, 233 bp, Diabrotica virgifera
  misc_feature (2)..(43): n is a, c, g, or t
  misc_feature (45)..(131): n is a, c, g, or t
  misc_feature (149)..(227): n is a, c, g, or t
gnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaagaaccccatagnnnnnnnnnnnnnnnnnnnnnnnnnnnnnnnnnnnnnnnnnnnnnnnnnnnnnnnnnnnnnnnnnnnnnnnnnnnnnnngggggg

SEQ ID NO: 20093 - DNA, 81 bp, Diabrotica virgifera
  misc_feature (2)..(36): n is a, c, g, or t
cnnnnnnnnnnnnnnnnnnnnnnnnnnnnnnnnnnntaacagcgtaattttatttgaagagttcaaatccgataataaaaa

SEQ ID NO: 20094 - DNA, 185 bp, Diabrotica virgifera
agaaaaaagaagtcgaaaaaatcaggtggggggccccaagggggttacattccaaccgggatctcccaaacgggaaaaaacccttggaaagttttccccccccaaaaaccttttccccaaggagagaacccttttttaaagttcctctctttggggggccgccctattatcccccccattatgac

SEQ ID NO: 20095 - DNA, 676 bp, Diabrotica virgifera
  misc_feature (23)..(47): n is a, c, g, or t
  misc_feature (197)..(215): n is a, c, g, or t
  misc_feature (305)..(322): n is a, c, g, or t
  misc_feature (484)..(508): n is a, c, g, or t
gttgtaaatattaagcgataacnnnnnnnnnnnnnnnnnnnnnnnnnccggtgaaagttgcattagtgatccgctaggagcaacaccagcgaagctcagagcgtataagctacaagctataattactgtaagctgtaattattgtagtttatagcaacaatattattacagcgatattgttaaacaataaggctatnnnnnnnnnnnnnnnnnnngtgtgttgtacgcacgtaagaagttatacttctattatatgatttcaaagaaatcaatatactttaaacagtttctctactactttcccnnnnnnnnnnnnnnnnnnaataccaaaaattttaatcaataccagaataaaaccacacacaaacaccttgaaaaatgccccctatgatttcctgacaataattgttgccaaaaattttaattaaataccgtattttttccgacaaaaatcatataaaaattaactctccatcctaaatcnnnnnnnnnnnnnnnnnnnnnnnnnccgtcctacaagaaccaagcttacccccgccccgctggcactgccatacctcttcataccggggcctcaatctccacccctggccggcagtttttcaacccccaactgggataaacacctgggagttaccccaattaatctcacctgcactacatcccccttttcccc

SEQ ID NO: 20096 - DNA, 1198 bp, Diabrotica virgifera
  misc_feature (49)..(63): n is a, c, g, or t
  misc_feature (173)..(186): n is a, c, g, or t
  misc_feature (188)..(204): n is a, c, g, or t
  misc_feature (207)..(225): n is a, c, g, or t
  misc_feature (572)..(591): n is a, c, g, or t
  misc_feature (674)..(699): n is a, c, g, or t
  misc_feature (866)..(883): n is a, c, g, or t
  misc_feature (908)..(927): n is a, c, g, or t
  misc_feature (997)..(1024): n is a, c, g, or t
  misc_feature (1033)..(1047): n is a, c, g, or t
  misc_feature (1049)..(1069): n is a, c, g, or t
  misc_feature (1173)..(1196): n is a, c, g, or t
ggtggggatacacgaaactatgccagagcccgaagcggcgaaatatgannnnnnnnnnnnnnnatgattgaataataattttttcaatagctacttcgcttaccttcaggggcggtttctccattggttcacttgtgcagtgaacacccaataaaagttcattaaaatacagnnnnnnnnnnnnnncnnnnnnnnnnnnnnnnntcnnnnnnnnnnnnnnnnnnnctcatagaatcattaaaatataactttatttattaatcatatttatttgctctacgccgctggatgcacttggtaagttcagatgactttgctcgggtgcagaattcaaattgaaccagccactagtaacctaccgctataagttagaaagagaaatcttaaaatcggtgaaaaagcatttcgcctatctaaaacagtaaggatttgtgcagtgcacctagagaccagtgaagcgttttggcacgtttcggttcacagtttggaattgtctgttgtgggttctagctaaatacggttaaatcttaaatacaatattaatagttttatgatggagccttattcagtgnnnnnnnnnnnnnnnnnnnncaaataggtttgaaaaatcgacttcttataaaaaaataatggtctacctccggccggagataaacttgggacaagaacgtgcnnnnnnnnnnnnnnnnnnnnnnnnnncgttgcttttaagttgaacaatataaaaaaacttcgtgggttgggcgggctggggaaaactaaatcctttgttttgttttcatgtttagaatttttcaaaaaagaaactattttttccgagggggaaaaaacggggggttcggggatttttcttccttttatttccnnnnnnnnnnnnnnnnnncaccggatcctttctccaaatttannnnnnnnnnnnnnnnnnnngggcaacttctccccaaaatttgggaaaatttggatggtttagcccaattaattaaatttctggggaatnnnnnnnnnnnnnnnnnnnnnnnnnnnncgcaccaannnnnnnnnnnnnnngnnnnnnnnnnnnnnnnnnnnntggcgaattgggggaaaaaattttgggggcgggctttccaaaaaggggctttttggggggagaaaatgggaagagaaccactccaaaaaaaccacaaaatcacnnnnnnnnnnnnnnnnnnnnnnnncc

SEQ ID NO: 20097 - DNA, 591 bp, Diabrotica virgifera
  misc_feature (18)..(37): n is a, c, g, or t
atgggaattgggaagttnnnnnnnnnnnnnnnnnnnngtgcaagttcaattttttcaaatgtgatttgatttgattgatgtaaaattgcatagtggaatagatgcaaatttgatattctaatattgcacttaatacattgcatttttgagatcaaagttcaaggttacaaatcctgataagtaatggttttttaacattttgacctgtgccactcgaaaaatatctgtccttttgaccacatcactaaccctactgattactaaatatttttcactttccggtctacaatgagtacagtaggacaggttattaaatgcaaagcagcagttgcgtggggtcccaaagaagatcttaagatagaaaccattgaagtagatccaccaaaggctcacgaagtaagattaaaagttgtgtatactgccgtctgccacacagatgcgtacactctaagcggacaagatccagaaggccttttcccagttgttttgggacatgaaggatctgggattgttgagagtgtaggggaaggtggaacaaacgttaaaaccaggggaccctgtaattccctttgcatgtccctcaatggggag

SEQ ID NO: 20098 - DNA, 224 bp, Diabrotica virgifera
ggcgagattccgggcctaatgggttaaaaaaaggagctggattttaccaaaaattttaacgcggaaattttaaccaaaaataattaaccccttatcaatttaaggggggccttttttcgggggaaatggggcgcgggaacccccattttgtgttattttttcctcataactttcacaatattggattcccgcctttggagaacaaaaaccccggttaaaggctt

SEQ ID NO: 20099 - DNA, 209 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (172)..(196): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgactttttaaaatttttacatgatcctgagtttaaaccccggggtgagccaggctggtttctatnnnnnnnnnnnnnnnnnnnnnnnnngtacgaaagggac

SEQ ID NO: 20100 - DNA, 154 bp, Diabrotica virgifera
gttgaaaaatagtttggggggaccgaggggggtaaaattcaaacggggattctcccacgccggaaaacgtccccttgataatttttcccccccgcaaaaaagtttttctcaacaagagaaaaactttcataaaattcttcgtttgtgggggcgc

SEQ ID NO: 20101 - DNA, 393 bp, Diabrotica virgifera
  misc_feature (232)..(268): n is a, c, g, or t
agagaggttaccgtcatgtcagatggatcgtatccatatacaggtaggtttatacagatgcaggaaggtaacatccgctatagacgtacaacttaccaattaacacctgaccaccagcacttcgtggaatggaacgaaagaacaactagaaacgcgaaagtatatacatttgcaggcttccatttactggcgggagaccttacttgacagccggacatgttacggaaagaannnnnnnnnnnnnnnnnnnnnnnnnnnnnnnnnnnnnagaccagaagggtgatttgatcgcatggatatacttcaagttgttgcacaatggagacgagtttaccatcttctaatcaaaacatggcgcaagagcgaaataaaaactaacggttctccgatttt

SEQ ID NO: 20102 - DNA, 349 bp, Diabrotica virgifera
  misc_feature (7)..(48): n is a, c, g, or t
  misc_feature (50)..(93): n is a, c, g, or t
  misc_feature (108)..(131): n is a, c, g, or t
  misc_feature (137)..(157): n is a, c, g, or t
  misc_feature (172)..(224): n is a, c, g, or t
  misc_feature (246)..(260): n is a, c, g, or t
  misc_feature (262)..(274): n is a, c, g, or t
  misc_feature (288)..(305): n is a, c, g, or t
ttttcgnnnnnnnnnnnnnnnnnnnnnnnnnnnnnnnnnnnnnnnnnngnnnnnnnnnnnnnnnnnnnnnnnnnnnnnnnnnnnnnnnnnnnnaggttatggaattgnnnnnnnnnnnnnnnnnnnnnnnncaggannnnnnnnnnnnnnnnnnnnnctagattgaatatcnnnnnnnnnnnnnnnnnnnnnnnnnnnnnnnnnnnnnnnnnnnnnnnnnnnnngtgaagaatatataagaggcgnnnnnnnnnnnnnnngnnnnnnnnnnnnngttcgaatatctgnnnnnnnnnnnnnnnnnncaattattagtgctaatttaatttcacccttattaggttgagat

SEQ ID NO: 20103 - DNA, 687 bp, Diabrotica virgifera
caaaaaacctcaaaaagaccagcctacaatgtacttatttgactgccagatgtttatatgaagccaatgaattagctgaaggtctcaaaggtataaacaatatagaaaacattaatttgtgttcccaaaaacattttttctccgctattttccaattctcagtcattattgtttgagaatacaccaaaaaatcaagcctattcatcattcttattattaaaagggaaaattttggagggaatggacaacataggcccagatgctgattgttataaacaagcccttaatatcgatgtccattgttttgaagcatttgattcattaataaaatatcaaatgctcacttcacttgaagaggaaagagctattaaagtcatttaccaatatctgaacaatgatctccataagctgcagaaatcttgtatatattatatcaatcaaaattagagaaataatcatattccgacgtcactccgacccatgggaagtaatatcctttatgggagtactccagctccacaggatgagtctacagatctcttggacgctactccagctataccattctggcatttgaaagtacgccaacctataaaagtaactcccaatgctattagaaataatgataaggaatctaaacaaaatatcgaaccagacacaataaaaagagatgatgaccacctgcca

SEQ ID NO: 20104 - DNA, 165 bp, Diabrotica virgifera
  misc_feature (2)..(22): n is a, c, g, or t
annnnnnnnnnnnnnnnnnnnncatgacgaaactgtataaacactattaactagactactttctcgtacgttacgaagagtaattatgaagagatatatttatctgttggttgaatgacaaaatgatcatggtttatgttgcgttaagagaggcgggggatagcg

SEQ ID NO: 20105 - DNA, 953 bp, Diabrotica virgifera
  misc_feature (4)..(32): n is a, c, g, or t
  misc_feature (51)..(101): n is a, c, g, or t
  misc_feature (110)..(148): n is a, c, g, or t
  misc_feature (157)..(175): n is a, c, g, or t
  misc_feature (180)..(203): n is a, c, g, or t
  misc_feature (220)..(240): n is a, c, g, or t
  misc_feature (266)..(399): n is a, c, g, or t
  misc_feature (434)..(455): n is a, c, g, or t
  misc_feature (477)..(507): n is a, c, g, or t
  misc_feature (512)..(529): n is a, c, g, or t
  misc_feature (544)..(598): n is a, c, g, or t
  misc_feature (611)..(772): n is a, c, g, or t
  misc_feature (790)..(812): n is a, c, g, or t
  misc_feature (817)..(862): n is a, c, g, or t
  misc_feature (865)..(897): n is a, c, g, or t
  misc_feature (904)..(924): n is a, c, g, or t
cccnnnnnnnnnnnnnnnnnnnnnnnnnnnnnccctttttctccctccccnnnnnnnnnnnnnnnnnnnnnnnnnnnnnnnnnnnnnnnnnnnnnnnnnnnggtcccctnnnnnnnnnnnnnnnnnnnnnnnnnnnnnnnnnnnnnnnccccccacnnnnnnnnnnnnnnnnnnncctcnnnnnnnnnnnnnnnnnnnnnnnnaagacacccccccccannnnnnnnnnnnnnnnnnnnncccccacaaaaacccgggggggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccgcgccgaaaagaaaaaacaccccccaccnnnnnnnnnnnnnnnnnnnnnnctttctctcatcaccccgcgcnnnnnnnnnnnnnnnnnnnnnnnnnnnnnnncaacnnnnnnnnnnnnnnnnnnggagggaagacccannnnnnnnnnnnnnnnnnnnnnnnnnnnnnnnnnnnnnnnnnnnnnnnnnnnnnngggggggtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactccccccccccagannnnnnnnnnnnnnnnnnnnnnnaaagnnnnnnnnnnnnnnnnnnnnnnnnnnnnnnnnnnnnnnnnnnnnnnttnnnnnnnnnnnnnnnnnnnnnnnnnnnnnnnnnacccccnnnnnnnnnnnnnnnnnnnnntggggcgggggggcgcccccccccccccc

SEQ ID NO: 20106 - DNA, 115 bp, Diabrotica virgifera
  misc_feature (2)..(94): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccattttttttgattaaaaa

SEQ ID NO: 20107 - DNA, 507 bp, Diabrotica virgifera
  misc_feature (32)..(59): n is a, c, g, or t
  misc_feature (265)..(283): n is a, c, g, or t
aatttctaaccattatttggagtaaattatcnnnnnnnnnnnnnnnnnnnnnnnnnnnngcataataaagtgcttgttttcaaatatgtgattactaagtaatcaatggcgactgcagatctatcagatcatgaaaatcaatataatgttagagagattgatcatgaagaaattgaacagttagagattgtaggggaaggcagttttggagtagtatataaaggaatatggaataatgcatatgtggctgtgaaaaacattactnnnnnnnnnnnnnnnnnnncatttttagtagaagttaggcagttatctagagtttatcatgaaaacatagtgagattatatggagcttgtaccaaaggcatgcacttttgtctagtaatggaatatgccgaaggtggatcattgtttaatgttctacataggtcagatctgtgttacacttttgctcacgccatatcctgggcgtaccagtgctcctagggtgcacaatacctcactgccatt

SEQ ID NO: 20108 - DNA, 809 bp, Diabrotica virgifera
  misc_feature (591)..(610): n is a, c, g, or t
caatgttgtgcttgtctagtcttttatgtttgttgtttttaacaaattcggcattatcgtacactgaacaagacattgattactacgagacgctgctaaacaaagcaataaaggattcgaaaacctaccaacctgacactagtgcagttaaataccaagctttacgatcaagtccaccagaagattgtggagtagagtatgatttcattattgtcggagcaggatctactggaactctattagcaaaccgtctatctgaaatttctggatggagaatcttgctcctggaagctggtgactatggaagtaatattaccgacgttactgggatcagttacaaagctttaatgatgagcgattataactggggattttacagtattccacaaaaaaattcttgtttagatatttctagaagcaaatgaacaaatgggctatataaaccgagatgtaaatggtagaggacaagttggggtcagcagttggcaggcaaatacctacaaaggaagacgacaagatggaggaagtgcttttattataccatttcaatatagacgcaatttaagagttttaacacaaagctatgtcacnnnnnnnnnnnnnnnnnnnngaacagctacaggagtaatatatctgcgtaacgggggtactatacaaagccagagctaaaagagaggttatagtaagtggtggagcaatcaacagtcctccgattcttatgctatcaggaattggacccagaaaaactttgcagggacataaaaataccggtagttaaacgatttgggaagttgggaagcaactatttg

SEQ ID NO: 20109 - DNA, 489 bp, Diabrotica virgifera
cggtcatcaaccagcatcgtggaaataattgttttattttggtagttttggtactagtagtggaatcacattgaaaacaagcataaatggctgaaaatgatttttcagacaatactaaaacactgtcagagtcagagatacaaaatcttaaattacaagattcgcgaataatcagtgaatataaagctaaccaactagaactagaagctaagaagcattgggatctattttataaaagaaatgagaacaggttttttaaagatcggcattggactactagagagtttgaagatttgttaaatgatcaagaatctgataaattgatattgtttgagatagggtgcggcgttgggaatttcctatttcccggtgattgaggaaaggtctaaactttaaattcccagtttgggatctcccaccggaagaggctctgagtaatcgaaaacgggacctccagcgcttacatttctacctttattataaaggttt

SEQ ID NO: 20110 - DNA, 562 bp, Diabrotica virgifera
gattagaccaaatgataaacatttaaaagctgtaacaaacctactcgaaataaacgaagaagaaatggaacagtggctgtgtacaaaaaaattgatctcaatgcaagatatctttctgaaaccaatgtctgtccaggacgcaatagcatccagggatgctctagcaaaacatatctattccgaactcttcaattgggtagtactgatgatcaatcgaactttggaatcagaaatacccagacataggtttgttggtgttctggatatttacggttttgaaacttttgaaatcaactcttttgagcagttttgtataaactacgcaaacgagaagctacagcagcagttcaatttgcatgtgtttaaactggaacaagaggaatatatcagagaagggatagagtggaagatgattgagttttatgataatcagccgtgtatagacctaattgaagctaaattgggaatattggatttactggatgaagaatggaagaaggctaaaggttccgacgcttcatggactgaaaaactatacaccaaatggtcaaagaccctcatt

SEQ ID NO: 20111 - DNA, 251 bp, Diabrotica virgifera
tgtccccccccaaaaccgcggggggaaaagaaaaaaaaggctgaaagaaaaggtgggggggccccaggggggggttacactccaaatgggatctccaccacgggggaaaatacctttggaaagttttccccccccaaaaaaaaggcttttcccaaggagagggaaccctttttaaaaggtttgcctctttgggggggcgcgggtttatttccccttattgtgggcccggcgaaaaaaaaaaaactcctcgg

SEQ ID NO: 20112 - DNA, 878 bp, Diabrotica virgifera
agacaacagatccggatccaactttaacacttacaattgaaaaatggaattaccaaacaccaagtataatatttcctgaaaacgatcaaacatacattgtcctatcggatcaacaacctggtcaaccattggcactgtttaacaacactggaacttcaaatactttgcccgattttagtgcaacagatggtgaaacgaaggactgttctaagtgggatgtgaaattttcttatacgcagactaattatgaagaagataaaattttcgtgatagaccatatacagccgtgcgtttctcaactacaagtcagcaaaaatttcaactcggatctagtacgaagtaaaaagtataagctaactattacagccagtgttaaggatggagcagaacaggaaggtgaagcaggttactcgacatcagcaaatataagtatagttttcctcaacaacgacgctcagccgatctttcaaaatagtgactggagtgtatcatttgttgaattcaatacaacacaacctgcgaaacctttggaagaacaggctgagtatgagaacacgaaaggaggacttcctatctattaccatttctattccgaaaaccagaccctttccaaatattttgaggttgatgagacgtccggtgatttatcggttataggaaatcttacctatgattatgatcaagatatatcgtttcacatagttgcttcgaatgactcacaagtcagaatgttggatccacgatccagtctaaatgttactgttaattttcttccacgtaaccgcagagctcctcagtggaaaagtaccaaatctttggagccagtatgcctacattcgtaactggggacctcatagtcacccgctcaagctcatgac

SEQ ID NO: 20113 - DNA, 110 bp, Diabrotica virgifera
cgcgcccccaggtgttgagacaaatgtctatgtaaatgataggttgatctctggaaaaaatcggagaaaccttattgaatgatagcagaattgaattaggtgagaacagg

SEQ ID NO: 20114 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 20115 - DNA, 712 bp, Diabrotica virgifera
  misc_feature (14)..(39): n is a, c, g, or t
  misc_feature (51)..(90): n is a, c, g, or t
  misc_feature (258)..(286): n is a, c, g, or t
aaataaattcgacnnnnnnnnnnnnnnnnnnnnnnnnnncgatggcaagannnnnnnnnnnnnnnnnnnnnnnnnnnnnnnnnnnnnnnntaggcccaagattatgagcaaattccagaagattaagaactttggtccatctgcttcagtcgtatctttcgcctacttccaagcttttaaattccctgattctatgaacgttcacttccagtgtgtcattcaggtatgtagatataactgtccagaaccaaaatgtgnnnnnnnnnnnnnnnnnnnnnnnnnnnnnggagctcctccactatccaatgctcttggaagtggcgacttcggaggccatgctggtttgagcagtgaatatggaccacctccttctggagaatatggtttacctgcagccttcccagatccaagacatccatccggacctactggtgcttactctgaacaaaatgcagatgttgttccagcacctcaagctcaaacgtcctcatcatctaccttctaatcctcctaatctctcatctccagccccacaagtatcagctcaaacgggaactgagatccacttgcctccccccaccacctccaggtcaccatgggatatattaaccctggccaaaagggaaaagtaaatatttggaaaagaaatttgaaggcaattttggccaactctagggaggcccaaccgaaaaccttataaaaaaaccctccc

SEQ ID NO: 20116 - DNA, 279 bp, Diabrotica virgifera
  misc_feature (256)..(273): n is a, c, g, or t
gaaacaaggcgttctccttctaatctagtggagtcactgaaggttttcacctccgatttcgttgaaccttcatcgattttcatgaaagttggtgtgtaattagaggatacctttgtaccttgagatgatcctctaaccactcaccagtgttcttgcaaatctgatgtagtggtcgacgactatcggaggtcgtagtcgcatatccacactcgagatgactgcctacaggatgtcttgaacgaactatcctgctacnnnnnnnnnnnnnnnnnnacaaca

SEQ ID NO: 20117 - DNA, 195 bp, Diabrotica virgifera
  misc_feature (13)..(40): n is a, c, g, or t
  misc_feature (60)..(73): n is a, c, g, or t
  misc_feature (76)..(98): n is a, c, g, or t
  misc_feature (106)..(128): n is a, c, g, or t
  misc_feature (158)..(189): n is a, c, g, or t
gcgtaattttatnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 20118 - DNA, 107 bp, Diabrotica virgifera
acggctgggggaaaagaaaaaagagagctgaaaaaatcacttttggggggcaccagggggggttaactcccaactggaattcccaacacgggggtaaaaaatccttt

SEQ ID NO: 20119 - DNA, 508 bp, Diabrotica virgifera
  misc_feature (84)..(103): n is a, c, g, or t
ctcacattgtaacttccatgtagaattatacaccaaaaatgatagtaataacgagttggtatatttattttatggacaaatgcnnnnnnnnnnnnnnnnnnnnaaattgttaattgttaatttatagcaatttgtgattacgaatagagtacacctaaattatattaatgggttttaagatttttttctcatttatttcagcaaaaacttaatttatttgaggcccctagaacacaagtggcgtaagtgacaattttagaaaattaggttttaaatacaaaaatagactcccaaacacatagaaaatatggtggcttcaaactttctacataaactaacaataaaatgatcaaaaatgacatgtcattgaaaacatgcaaagtagtatagtttaagtaaccaatacagtgaaacattagtcctgttagttcctctttaaatatagctcggaggtcgctttttttcgcactgctttaatatttattcctacttacctataccattaaac

SEQ ID NO: 20120 - DNA, 537 bp, Diabrotica virgifera
agaaagtagtttatggttgaattcgtcaaaagttgtactgtacagcatgaatttgtggttgtgtatttgttgctattatttgtttagtgttgctcacgcggctgttgaagaaggtgagccctgttacacagctaggaatgaatatggaatttgtcaaagtatatacgaatgtaaatacatgctcaatttgcttaaaacaagaagcaataatcaggaaacgcgccaatatctgcaacgttcaacatgtaaatttggagctgtagtatatgtttgttgcccaacagacaatatagaaccagaaccagaaccagaacctacacaaccagcaaccgatacaaaaatcattggtgccgttttaaataacgagaaatgtggtgttagtaatgtaacaaactttagagttgtaggtggaattccagccaaattacatgaggtaccattcattgttaatttgggttatagaaatagcagggacccttcaaagccaagatggttgtgtggcggaacactcattacagaaagacatattctcacagc

SEQ ID NO: 20121 - DNA, 422 bp, Diabrotica virgifera
tttgcgtccgggcgtataaatctgtgaaatcgtgaataacaattttaagaagcatatagtaaagattcagaaaaagagtcagtctccaaaatagcgtagacgtctacatcgaaattgtcctcgcgtaataaccgagcataaacggtaatatctgtggcggtaacagccgaaagatgactttagatagaggtacccatgaacctagaaaaatgaggacctgcctaaaacccagatggacgcatcctacatcccatatctataccgctggcaggacatctcgtatatgtgcctcgaccaaagagggagatgtaacttccccggagctttttgtagacgatgacgacgacccgaggggaagggcccttgctcccaatcgaacgactacgtacttgctgcgaaacggctcgagcttgagcagcctc

SEQ ID NO: 20122 - DNA, 682 bp, Diabrotica virgifera
gggaaaaagaccaagaaaaaaactgaagaagaacctgagtatgtgtgaacagatatctctgatatatttatcttggctgggacaactgatcagaatatttctatgcgtgaagaggattcttgaaattgtgtgacttcatatatcactattgattttcacgtacagtgcattggatggtgtaaaatgatgggccatcctctctgccctgccgttttaataaacgaggagagatatcttcgctaaaagaccttcacaaaaatccaatatagtactttacccagtactatttttaggggattataccagtgggcggatactggactcctatatttgtccatatgaagaatagcactctcacatactgcaaaggttcagaaaatcaattattttcaaaagcgataatggcagccgacgaatatgtgcgtcaacaacaaggggatcctgaatatcacgctgcaatagagctgccaacaaaccgctagacagaagagtcacctgcagctactacagaagctaggaaacgacataatggtgagtctcctgtagtagacatgaataatggagattcatcctccttcaatcatataggagtctcagtggacagacttcttgagtagctgagaagagtggagaatcatctgcaagaaaatcagagaaaaatctcaatggtgtatcaaacaag

SEQ ID NO: 20123 - DNA, 632 bp, Diabrotica virgifera
ctcaaaacctacaaaggaccaacctacaatgtacttctttgactgccatatgctgatatcaagccaatgaattagctgaaactctcacagttataaacaatacagaaaacattaattttgttcccaaaaacattttttcgccgctattttccaattctcagtcataattgcttgagaatacaccaaaaaatcaagtctattcatcattcttattattaaaagggaaaattttgtagggaatggacaacagagggccagctgctgattgttatgaacaaatccttaatatcgatgtccattgttttgaaccatttgattcattagtaaaatatccaatgctcacttcacttggagaggaagagctatttcagtgtttagtaatatgtgaacaatgttctccataagctgcaaaaatcttgtatatattatatcaatcaaaattaaagaaatatcctattccgacgtcactccgacccatgggaaccaaaatactctacggtagcactccagctccacccgccaagcctccccatcccttgaacggaactcctaggatcatttctgaaattgtaactacaccatcgataaaagtatctccccctgctttccacaaatagtgatacgaatctaaa

SEQ ID NO: 20124 - DNA, 393 bp, Diabrotica virgifera
  misc_feature (112)..(163): n is a, c, g, or t
  misc_feature (335)..(357): n is a, c, g, or t
ccttcctcaatacgtcatccaaagccggccacaactcgctccgatgcccaaactccgtggtgatggacagctgattgatatcgtaaaaactaggaacttctcaagagcagannnnnnnnnnnnnnnnnnnnnnnnnnnnnnnnnnnnnnnnnnnnnnnnnnnngcaagcaaccaaatgggaaacttcctctcccgatcctctgtgagccgtgtgatcatctctggaagcttgaacagataccaccctccagtcttctgtccccactgacaaaatcgtgattggtcctcatctcctcaaaaaaccaaaagggaaatctttggaaaccgcatgaaannnnnnnnnnnnnnnnnnnnnnncccacatttgagggttaccttggtggggctcccaat

SEQ ID NO: 20125 - DNA, 769 bp, Diabrotica virgifera
  misc_feature (286)..(321): n is a, c, g, or t
  misc_feature (332)..(350): n is a, c, g, or t
  misc_feature (352)..(382): n is a, c, g, or t
  misc_feature (396)..(415): n is a, c, g, or t
  misc_feature (480)..(497): n is a, c, g, or t
  misc_feature (500)..(513): n is a, c, g, or t
  misc_feature (589)..(622): n is a, c, g, or t
  misc_feature (693)..(740): n is a, c, g, or t
ttggaaagatttaacttaaaagatgatgcatattgtgaatgtggagaactaggtacaccagaacattatagtgttacattgtgaaaatactatagaaaataaagaacatagagaaatgagaagaagattagaatgaattgaaataagagatatattacaaaatgaagaatattttgaaatattaaacaatctcacacaaataatatctaaaaaacaacaagaaatctataataatagaagaagacaaccaataatccaaccctgatgaagttgagtaagataaagnnnnnnnnnnnnnnnnnnnnnnnnnnnnnnnnnnnngatatttacannnnnnnnnnnnnnnnnnncnnnnnnnnnnnnnnnnnnnnnnnnnnnnnnncaatacttaattcnnnnnnnnnnnnnnnnnnnnctaccaactctcttctgaaaaatagagggactgtctttataacttagaaaggagttgatagtacnnnnnnnnnnnnnnnnnnggnnnnnnnnnnnnnnggttggtaaaacgtaattaataaattaattgccaaaatttcctttattgtaaaaaatagaattttaataagtgagnnnnnnnnnnnnnnnnnnnnnnnnnnnnnnnnnnctggaatcccccatcaggaaaaaaatcccctccgggattaatcactaaaaagggcaaggccctatgggatnnnnnnnnnnnnnnnnnnnnnnnnnnnnnnnnnnnnnnnnnnnnnnnnacttcccaacctatcccctctttggcaaa

SEQ ID NO: 20126 - DNA, 134 bp, Diabrotica virgifera
atttttaaaaaatttccccgggccccccctattttcccttttttttggggatttttgcccttccttggttttgcttaccccccaaaaccgggggcggaaagaagaaaacacacctgaaaatcttttttgggggg

SEQ ID NO: 20127 - DNA, 300 bp, Diabrotica virgifera
  misc_feature (29)..(52): n is a, c, g, or t
  misc_feature (137)..(154): n is a, c, g, or t
  misc_feature (206)..(237): n is a, c, g, or t
  misc_feature (263)..(288): n is a, c, g, or t
agaataaaattaccttaggggataacagnnnnnnnnnnnnnnnnnnnnnnnntcgataataaaagattggcaacctccatgtttggataaaaggttattaattggtggtagcagctattttaattaagtctggtccnnnnnnnnnnnnnnnnnnatggaacctgagttttaaaacccggagaggaaccccagggtggctttcccannnnnnnnnnnnnnnnnnnnnnnnnnnnnnnnccccctaaaggggccccatatacctnnnnnnnnnnnnnnnnnnnnnnnnnngatcttcttctt

SEQ ID NO: 20128 - DNA, 189 bp, Diabrotica virgifera
gccgaatacctactagacgaatattagtgttgagtgtgaatatcgatgagaatggaaacaagatattctctcctgatgaaagttatgacagatgaaaaaccttttattggttatgaagatgcagatagctaactgaagtgtggacagatgcttgatggtataggtactatgcagttttcttgatttgaa

SEQ ID NO: 20129 - DNA, 626 bp, Diabrotica virgifera
  misc_feature (17)..(18): n is a, c, g, or t
  misc_feature (25)..(25): n is a, c, g, or t
  misc_feature (27)..(27): n is a, c, g, or t
  misc_feature (32)..(33): n is a, c, g, or t
  misc_feature (70)..(70): n is a, c, g, or t
  misc_feature (85)..(85): n is a, c, g, or t
  misc_feature (136)..(136): n is a, c, g, or t
  misc_feature (486)..(516): n is a, c, g, or t
tcctaaaagggcgcagnngagaagnangggcnngcgacgcgggacaaccataccaagcgggcgagcaagngccgcaagaagcganccgcaagcccagccagcaccaggaaacccaagggcttttttttgaacgagnacgcaccccaacaaacgagacgacgcagcagaagacaacgacgccaggcccacaagagccacaagagcagccagagccggaagccggaaggaaaaagccgagaaccaaggagccacgcacaccggacgaacagcagcaggcccgaccacgaaaaacgcatcccagcttgccataacccgaaaacatttcaacaagttggtgccaaatcctacagccacatcttgatagagaaaccatccccctataccctaaaaaggaccagaaagggccgtggaaaaggttttcccccatttacaaaaagaactaaccccccaaaaattaaaccctggggaagggcaaaaatctcccannnnnnnnnnnnnnnnnnnnnnnnnnnnnnntacaggttaaaaggccctccaattggctcacaaggggggcccccgaaaaaaagggttaaggaaaccccccctccttcccaaaacccccggaagggaaggtttttcccaaa

SEQ ID NO: 20130 - DNA, 200 bp, Diabrotica virgifera
  misc_feature (27)..(27): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (166)..(193): n is a, c, g, or t
taacagcgtaattttattggagagttncaatcgataataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggtggtttctannnnnnnnnnnnnnnnnnnnnnnnnnnngaaaagg

SEQ ID NO: 20131 - DNA, 818 bp, Diabrotica virgifera
  misc_feature (11)..(690): n is a, c, g, or t
  misc_feature (702)..(757): n is a, c, g, or t
  misc_feature (759)..(815): n is a, c, g, or t
ctcttgcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccgcggtannnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnaag

SEQ ID NO: 20132 - DNA, 834 bp, Diabrotica virgifera
  misc_feature (478)..(497): n is a, c, g, or t
ccctttcgagtccgctcaaactaaatactgtccaacaaaccaaaacgatgaaaaactaagtcaacctactaaaacccttatagaactaagacgacagatgaaaggagatacaagttccagcaaagaagcgctaaatcaaataatataaactatcacaaagtcaataagaaaagacataagaaactacaatgtagaaaaaacaaaacaagcaatagagcaaaataagaacatgaaagttttgaagaacttaagcgtacaaaaaggaaaaatagaaatcaacaaactaagaaacagaactggaaaagaaactacaaacagagatgaaatattaacaatagtcgaagagttctacacagagttatacaaatcaagaaaaaaagatgacaatgcgcaacctccaattacagtaaaaactggggtattaaatcaaggatcggatttaatgcccgatataacaaaatcagaaatcaaagaggcnnnnnnnnnnnnnnnnnnnnatcgaaccccaggtgaagatggaatagtatcagaagcactaaaaattggaggaaatatactacttgaaaaattaaacaacttttcaatatctgccttcacaacgcccatatttccaacagactggaacaacgcttacatgattcctattacacaaagcaggagacaaggccaatttagataattacagaccgaataagcctcctcagccattttatataagttatttacgcgaataaaagttaagagaatgggaaagaaaggttaaagaacttatccaaccaagagaaccaggcaggatttccgaaaaaaattaacggaaccaaatgaccatcctac

SEQ ID NO: 20133 - DNA, 76 bp, Diabrotica virgifera
ccttttgaagaaataatagaaatatatttgaaaataataatacaaaaaactttgtcacaatacaacaaacatttca

SEQ ID NO: 20134 - DNA, 645 bp, Diabrotica virgifera
  misc_feature (11)..(451): n is a, c, g, or t
  misc_feature (453)..(586): n is a, c, g, or t
  misc_feature (589)..(603): n is a, c, g, or t
  misc_feature (608)..(643): n is a, c, g, or t
ccctgcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnncgccnnnnnnnnnnnnnnnnnnnnnnnnnnnnnnnnnnnntt

SEQ ID NO: 20135 - DNA, 349 bp, Diabrotica virgifera
  misc_feature (3)..(29): n is a, c, g, or t
  misc_feature (31)..(89): n is a, c, g, or t
  misc_feature (92)..(108): n is a, c, g, or t
  misc_feature (123)..(191): n is a, c, g, or t
  misc_feature (195)..(229): n is a, c, g, or t
  misc_feature (234)..(281): n is a, c, g, or t
agnnnnnnnnnnnnnnnnnnnnnnnnnnngnnnnnnnnnnnnnnnnnnnnnnnnnnnnnnnnnnnnnnnnnnnnnnnnnnnnnnnnnnngcnnnnnnnnnnnnnnnnnccaaaagaccctttnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnttacnnnnnnnnnnnnnnnnnnnnnnnnnnnnnnnnnnnnnnnnnnnnnnnncctcagggttaacccgctatttttttctagagggacctcaaccataacacaaactgtgcccccccccc

SEQ ID NO: 20136 - DNA, 742 bp, Diabrotica virgifera
  misc_feature (553)..(573): n is a, c, g, or t
cacccccagggtccccattttgttcagtgtttgaaaggagtcagcaaacagcggcaagatgtgtgacgacgatgtagcggcgctcgtagtcgacaacggctcaggaatgtgcaaggcgggcttcgccggagatgacgctcccagggctgtcttcccctccatcgtcggccgccccaggcatcagggtgtgatggtcggtatgggtcaaaaggactcctacgtcggcgacgaggctcagagcaagagaggtatcctcactctgaagtaccccatcgagcacggcatcatcaccaactgggacgacatggagaagatctggcaccacaccttctacaacgagctccgcgtcgctcccgaggagcaccccatcctcctcacggaggctcccctcaaccccaaagccaacagggagaagatgactcagatcatgtttgagaccttcaacacccccgccatgtacgtcgccatccaggccgtactttccctctacgcttccggtcgtaccaccggtatcgtcctcgactccggagatggtgtctcccacaccgtcccnnnnnnnnnnnnnnnnnnnnntcctcacgccatcctccgtctggacttggctggccgtgacttgactgactacctgatgaagatcctcaccgagaggggttactctttcaccaccaccgctgagagggaaatcgtccgcgacatccaggagaagctctgctacgtcgctctggacttcgagcaggaaatg

SEQ ID NO: 20137 - DNA, 787 bp, Diabrotica virgifera
  misc_feature (129)..(142): n is a, c, g, or t
  misc_feature (144)..(156): n is a, c, g, or t
  misc_feature (162)..(183): n is a, c, g, or t
  misc_feature (422)..(441): n is a, c, g, or t
gtattactatttttataataaaaagattataatttataaaatgtgatgctgtatatgatttcaaatattaatcttttctattaccatataaaaaaatattgcctttactcaaaaacattttatttatcnnnnnnnnnnnnnngnnnnnnnnnnnnngttcannnnnnnnnnnnnnnnnnnnnncaaaaacattaaatattttagttttactggtttatggctgtaaggtgtctctgaatatttttcactcttttataagatgtttcgaaaattgaaatatctctgaaagtttttaatatttaaaatcagttttcataaatttatcatcggttaatattagagatcttaagttcacagtggcacaaacaactgaaaatatcttctgcaagtggaagaagactaacatacattttacatacatnnnnnnnnnnnnnnnnnnnngttggatatatctatgtgtactcaagctttagctatcttcattgtaagaattttaagtttagcgtgatatttggtagtggtgctaagggaatcggacatcatgaaagactttggattggaatctttgtagtctttgcatatttgtgttactggcagttccccagagttggatcctgtacatccggacttgtcgtggtattgccttgtagagaggaggtttgttctggatacatttttttgtgaagcatgcccagttttggttgttcccatagagagtggtctttgttttcactttcagaaagatttttggaaaggtgttttaggatctacccagtatctttgtttc

SEQ ID NO: 20138 - DNA, 714 bp, Diabrotica virgifera
taacgtccgactgggtgtaaaagataaatcttattctatcttttcttaatcagttttagataattttagttgtatttctttgtaattttgtgttgtacaaagattaatttaacattttctctggaagtgttaatttaggaagataatatgcttcattggtgttgtgttttgaagtgtgaaatgcaaagtaattgtgataaagtcaagataaagttcacttttaaactgaactaaataaggtatctgagacaacaatggttaaatgcaatacaatgtacaggttttactagcgaaacgaaaattttcctgtcctgtctgctgtaatcattttatatctggaaaaccagccgacttaatcgataataacaatctccagattgggttccttcaataaatatgggctataaacacaatgaaataagttccccaaaatctaaaatggagtggtatcaaaggagaattaaaggaaaaaatattcatattgaaattatttataaggcactggactgtcttaaattctacaataatactagaatcagctgagagaagtggtctacaaaaaaccaggaaggaaacggaatatgtggctacgaaaggcaaaagaaaggtttacaaagcaaatgtgacacatttttttgaaatatttaggaatatcagtaaattgcattaaaagaatgtatgaaaagattttgttcaataaaaatgtttatattt

SEQ ID NO: 20139 - DNA, 104 bp, Diabrotica virgifera
  misc_feature (10)..(33): n is a, c, g, or t
  misc_feature (51)..(69): n is a, c, g, or t
ttgaggccgnnnnnnnnnnnnnnnnnnnnnnnngccttttcctttttagtnnnnnnnnnnnnnnnnnnngtttgagttagaatgtgcgggaggagatttattaa

SEQ ID NO: 20140 - DNA, 434 bp, Diabrotica virgifera
cagagagtgttgtgatacaaattgataatccatttagatctttgatcacctaaaatgtcgtaccaacaaggacaaggataccctccacaacagtatccacctggccagtatcctcctcctccacaacctggatatggtcctccaccaccacaatggcagcaacctcaaccacagtattatccacctccacagccaccaccaagagaggaagacgaatgttgtaaatggtgttgcggattaacctgtttatcgttgttatgttgttgtttgtgcagagactaaatagtatccaaaagcgttgcaggtattcattttgatgagagaatagcatcattcatataatctatttaaactatgtactaaatcatactaaatataaggagggtatcatataattttacaatgtaaaacttaaatacaatatattttacaat

SEQ ID NO: 20141 - DNA, 500 bp, Diabrotica virgifera
  misc_feature (25)..(192): n is a, c, g, or t
  misc_feature (199)..(236): n is a, c, g, or t
  misc_feature (256)..(269): n is a, c, g, or t
  misc_feature (272)..(294): n is a, c, g, or t
  misc_feature (302)..(324): n is a, c, g, or t
  misc_feature (354)..(385): n is a, c, g, or t
  misc_feature (392)..(428): n is a, c, g, or t
aaaccggtgtgagccaggttggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattatcaaaccacaaccacaaaaacgtacaaaccataaatattcttactatcattttgattacttaaatcag

SEQ ID NO: 20142 - DNA, 468 bp, Diabrotica virgifera
  misc_feature (309)..(332): n is a, c, g, or t
tttgcgtccggacttttttgatctttatttactatgataacattcttgttatatattgagcattgctgcaattctgtgtaatgtgcgctcacttacgatggtggagaaactattgattgttcgaggaaacaaatattcttttcgtaccattgtgtccaaccaaacattagttaacagattatgtgtttcttatgctctgctttagtatctcaaagaatccaataatcttattgtaaaatacctaactcatgtattctacagacacaaggactgatgtccagatattgatatatctatgaatgctaccannnnnnnnnnnnnnnnnnnnnnnnataaaattatcattgaatattgtaatgtgagcgctactgcccaacgttaagtgtgaactgcaccataacagtctattaaatatttatttgttgattgacagtaggattcaaaaaacttcccgtcttaaatgaggga

SEQ ID NO: 20143 - DNA, 180 bp, Diabrotica virgifera
  misc_feature (7)..(44): n is a, c, g, or t
  misc_feature (82)..(103): n is a, c, g, or t
taacagnnnnnnnnnnnnnnnnnnnnnnnnnnnnnnnnnnnnnntgcgacctcgatgttggattaaaagttataatttggcnnnnnnnnnnnnnnnnnnnnnntgttccaatttttaaaattattacatgatcttaatctaaaacggtgggaaccaaagtttgccttttatcctttaatt

SEQ ID NO: 20144 - DNA, 291 bp, Diabrotica virgifera
  misc_feature (21)..(39): n is a, c, g, or t
ccccccctaaagaccgcgacnnnnnnnnnnnnnnnnnnncactgtgcctttatagatggatcaaatagtatacagtgttcatacatgtgtaagtcataaaaaattacctatgataaatattttttcattaccaacttcacagttaatgcaaattattaaattcaagtctttgtgattaaaaaataaatcattctcttaatatctgggcccatcacgattttgtgagcgcccccagtaattatcggaattattgtaacggccgcctccatttttttggatatgggaaccccc

SEQ ID NO: 20145 - DNA, 717 bp, Diabrotica virgifera
  misc_feature (590)..(621): n is a, c, g, or t
cgcagaataaataacaagccagaagttctactgaatataaaaaagagaaaattttaatacttaggccacctgatgaggggacaaaagtacacattcctacaaaacataatgcaaggaaaaatccaaggacgaagaaatccaggccgtagaagaatgtcctggatgagaaatttactaacgaattgttcaaaacagcagtaaataaaattagaatcgccctaatgatatccaatctccgataggagaggcactcaaagaagaagaagatacctttaatattgctcattttaatgaactttttaagcactacaaaatgtacaaagggtgttgttaacattgtacacctggaatcgaccgtttgtctgttatttcaagttgaataccacgatttgagcattgcaccaaaaaaacaaactattttcacctaccatatatctctttggataagctacaaggatggtttgtggagtttttttaattggatgcataatttttgggatattttcaaaaaacctttcgaggaggtgttgtggtttaatgaaaaatgggcaattttcaaaccaccaataaactcagggaaatggtgaggnnnnnnnnnnnnnnnnnnnnnnnnnnnnnnnnggtttgggagctgggggtcttttagccactttcccgcgggtatttttgcgcaacaaattttcttccccccgacaaaggggggggggccaccccccc

SEQ ID NO: 20146 - DNA, 281 bp, Diabrotica virgifera
ggaaggaactgtctttgcgaggccaccatgtattctagctacttctgaaccgatgaacgatcctgcattaccaaatcttaccgaaataagcctaaagagttcctacaaacatcctttaatgttggaattgtatagccaaatggccaacgcttcgaatattaagatattggacatcattcacaaaatggcagaaacagaactggatatacacctttcaacacattacagccatctcattaagaatgaaaccctatttgatgtggttattaccgaatacatta

SEQ ID NO: 20147 - DNA, 285 bp, Diabrotica virgifera
  misc_feature (8)..(27): n is a, c, g, or t
  misc_feature (36)..(66): n is a, c, g, or t
  misc_feature (90)..(111): n is a, c, g, or t
  misc_feature (115)..(162): n is a, c, g, or t
  misc_feature (164)..(183): n is a, c, g, or t
  misc_feature (203)..(244): n is a, c, g, or t
tgtcctcnnnnnnnnnnnnnnnnnnnncctaggcgnnnnnnnnnnnnnnnnnnnnnnnnnnnnnnnacataacaaatcctactcccttgnnnnnnnnnnnnnnnnnnnnnnagtnnnnnnnnnnnnnnnnnnnnnnnnnnnnnnnnnnnnnnnnnnnnnnnngnnnnnnnnnnnnnnnnnnnntcttgccgtcaatcaatttnnnnnnnnnnnnnnnnnnnnnnnnnnnnnnnnnnnnnnnnnncaaattatcaacagaccagaactaatcctttatcgaaacat

SEQ ID NO: 20148 - DNA, 372 bp, Diabrotica virgifera
  misc_feature (329)..(348): n is a, c, g, or t
  misc_feature (350)..(367): n is a, c, g, or t
gttgctctcattggagatggtgctgttgcctcttagaggtagaggaagatggtgcaatatgcgacgctgattactatatgaacgacgactagcaagaagatgccaccaccttcgccatatttcacatctagctaggacaagatgggatcaccctacaccatcggtccaagctggtgaagtaacatagtgccatagtgattgaaccgtatcgctgacaggagcccggaagatctaaaacagcttcgtggacgcagaggtaccgtatggggtagtggaggaactgagactagacattaataagaaaaagtttaaaatatgatgatatcttnnnnnnnnnnnnnnnnnnnncnnnnnnnnnnnnnnnnnngatac

SEQ ID NO: 20149 - DNA, 130 bp, Diabrotica virgifera
  misc_feature (13)..(61): n is a, c, g, or t
  misc_feature (69)..(103): n is a, c, g, or t
gtagcataatccnnnnnnnnnnnnnnnnnnnnnnnnnnnnnnnnnnnnnnnnnnnnnnnnnccttgtcnnnnnnnnnnnnnnnnnnnnnnnnnnnnnnnnnnnctaaaaaaccttaaattttctttaaaa

SEQ ID NO: 20150 - DNA, 460 bp, Diabrotica virgifera
  misc_feature (387)..(406): n is a, c, g, or t
cctcccctatagaggaaagttgtgacccctgcgggtgccgcggccgagaattcccgcgggccccccccctttctaccgcgcactgcgtttctcatttgtgagttgtgagctgatcgccctctacgtatgtgtgaggaagcgtggtgacaattcgagagagattactatatgatcttatacgatcatgaagacgctaccaccttccacattttcaagactaactacaacaagagtgattcatccaatccaaaggtcgaagctggtgaagtagcatgtcccgagggattgaacctattcgctgacaggagcccggaatcatctaaagcatcttcatggactcagacgtaccgtatgggggaggggaggaacttagattagtgattaatnnnnnnnnnnnnnnnnnnnnattatatctttgagtgagaaatggaaaagcctaataatcgagcttctggaatga

SEQ ID NO: 20151 - DNA, 430 bp, Diabrotica virgifera
catactaggagaggagaaatgagggaaaaaggggggagagatcctttcgccacccaacgggccgccgagagcgaaccagcaaccacatccagagcggagcgcaaacaaggaacaagggctccgcacagaaacggaaaagggacagaccagcgcacgggcatacctacttcattatgtacccatttagtcgacaggtttatcggattagccgcgtctggagaaatgtttggcgtagacacttatttgcagcgcgtcttagacgctaaggcccgatatgggggatgggcatgacttgcgtgaacgtaaagacgtcatcaacctggacgatgatgctctgtgccgacttgttatgttttctgtgaaaacggagtccaaacaaaatggagggtcgctccttcgacccggatcacatctctgcaccatttgggaa

SEQ ID NO: 20152 - DNA, 761 bp, Diabrotica virgifera
  misc_feature (17)..(17): n is a, c, g, or t
  misc_feature (23)..(23): n is a, c, g, or t
  misc_feature (27)..(27): n is a, c, g, or t
  misc_feature (33)..(33): n is a, c, g, or t
  misc_feature (185)..(205): n is a, c, g, or t
  misc_feature (226)..(226): n is a, c, g, or t
  misc_feature (304)..(304): n is a, c, g, or t
  misc_feature (311)..(336): n is a, c, g, or t
  misc_feature (379)..(379): n is a, c, g, or t
  misc_feature (398)..(398): n is a, c, g, or t
  misc_feature (552)..(552): n is a, c, g, or t
  misc_feature (559)..(559): n is a, c, g, or t
  misc_feature (571)..(588): n is a, c, g, or t
  misc_feature (592)..(592): n is a, c, g, or t
  misc_feature (651)..(651): n is a, c, g, or t
  misc_feature (712)..(712): n is a, c, g, or t
ctcctagaggagggtgngatagngagnaggagnaaaagtgaattcctttgaagtggatagagttaaaggttgttgtatttattggtttagtaagtgtagaagaagtttatgaaaagagagaagctataagaagaattattagaaaagatttaggataaatgggaggtttatttttagtagaaatnnnnnnnnnnnnnnnnnnnnnttgtaagaaaaatggagtatnagatgaaggaggtgaggatatataggttatataggttaaaatgaagttgtggatgtgtggtataaaaatttttgaaanttatagnnnnnnnnnnnnnnnnnnnnnnnnnnattgtagttgtgaggaaattaaagaaagtaaatattgtttggntaagaatgaaaaatatttnttagaattagtattggatattgtaaaatggatggataaatatatgtaagatgagaaagatatatttagagattgagagattgtagggtggataaataaattgggaaggtatatagtagaagttgagtatattagatgtttaagtagtgtatatnaaaagantggagatgatgnnnnnnnnnnnnnnnnnngggnagaatgttgtagaaaattggtaatagtaatagaatgtttgggagatagtattaaaaggnattgtgtaaatagtgtagaggtgaagaagatttttagtgaatatagtaatgatattgagantacatgttaagattctgttaaagaatctagctacctttaaatccagtct

SEQ ID NO: 20153 - DNA, 638 bp, Diabrotica virgifera
  misc_feature (10)..(475): n is a, c, g, or t
  misc_feature (479)..(564): n is a, c, g, or t
cctcgaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgannnnnnnnnnnnnnnnnnnnnnnnnnnnnnnnnnnnnnnnnnnnnnnnnnnnnnnnnnnnnnnnnnnnnnnnnnnnnnnnnnnnnnaccttacggataacagctcaattttattggagagttcacagcgataataaacattgcgacctcgatgttggatt

SEQ ID NO: 20154 - DNA, 724 bp, Diabrotica virgifera
aaaacgaccttataaatgcgaaatatcggcgaagcatttttctcaaaaaagtgatttgaaaaaacatattatgagagtacatactggagaagaacttcctaagtgtgaaatttgctttaagcaatttagtcaagaaggtgatttgaaaagacatttgagagtacatactggcggaaaaaccatacaagtagcaaaatttgtttaaagcaaattggagaagcacaccatttgaagactcatttaagaacgcaaactggtgaaaaaccttataagtgtgaaagttggattactcaattttgtcaggtaagacatccctgacagcactagaggacgctctctgaatgagaaccataaaagtgtgaaattaccatgaagaggattggggaaatccaccatatagcgagtctggcgacagagctgactggagaacgaattaaaaagagactttgctgtctcatttcatggagaagcgcaagaaactatatcattctgagaagatatttatagaaaagttccgtgcaactgggtttgctgtactagagaaagatatggtgtgttatattttgcactatggactgagcggataggaatatccatccccttgaggtggtataaaaaacaatgacaaacaatgtgtagtagtttttgagagctaaaaagcagtatgagattcaatccccttagcctgaaaaccaccctcgcgccgccaaactgatccgggttt

SEQ ID NO: 20155 - DNA, 50 bp, Diabrotica virgifera
atagaggaaagctgttacgcctgtaggtatcggggcggaattttcggggc

SEQ ID NO: 20156 - DNA, 546 bp, Diabrotica virgifera
  misc_feature (6)..(43): n is a, c, g, or t
  misc_feature (84)..(146): n is a, c, g, or t
cctctnnnnnnnnnnnnnnnnnnnnnnnnnnnnnnnnnnnnnncctttcctgtagcttgagcagcaggtgaaataaacgagtgnnnnnnnnnnnnnnnnnnnnnnnnnnnnnnnnnnnnnnnnnnnnnnnnnnnnnnnnnnnnnnnagctaggtcaaagatcctgtccgtcttcgaaggtcaccgcagacgaagtagagctagtgagagaggaagaaaattaaagggaggcattaagccgctatatcaggtccgtgttgccagatgtcgcgatagggcgtagctttgacgacaaagttgaacagtctgtcgtgtcacctggccttttgatagtaaaaattgagggaagtaaatctcagatttcagttgcgtgcaaggttgactactatttcttctacccgtaagatgtgagtgatatggtcctaacagatctgggggaagcagcacaagcgtacttaagaaagaatggcaccaatgctgacatcacatgagccgcatatttggatgagtcaagtcgtcgagctacttatgatgctgtgtcccattg

SEQ ID NO: 20157 - DNA, 653 bp, Diabrotica virgifera
cccacgcgtccgagctgatgccaatgatgcaccatctgatgcacccccaaatgtacccccaacattaccaccaatatcccttccgagtgcccttacactcgaagatgaactccaaactgatgaacagactgatgacgatgatgcactccatgatgaacaaccacatgatgacccaccacatgatgatccaaagaatgatgaagccccatctcatgccccaccacatgatgatgcaaccaaagatgctgccaaacatgatgatgaataacgaaatgatgatcatgcccctgctcatgccccaccacatgatgatgcaaccaaagatgctgccaaacatcatgatgaataacgaaatgatgatcatgcccctgctgatgacccaccacatgatgatgcaaccaaagatgctgccgaacatgatgatgaataacgaaatgatgatcatgcccatgatgatgaccatgatgatgatcagacgactgatgatacatcaaatgatgatgcaccctatgatgacccctagcataaagatgatgacagaactgatgtccgcacacaagatgccacaaatgatgatgcaacctgtgatgctgcctgatgtgatgatgaatgaacctatgatgatgcctcaactgatgattctaccaatgatg

SEQ ID NO: 20158 - DNA, 863 bp, Diabrotica virgifera
  misc_feature (437)..(452): n is a, c, g, or t
  misc_feature (630)..(679): n is a, c, g, or t
tatagattcaccaaaatgaaagcggtttttattattacactattactacctgttgtattaagttacacagctaacttaaatcctctttcaaatgagtttataaactatatcaatagcaaacaaagctcatgggtggctggaagaaactttgatgaaaacctttcaacccaagagctcaaaaagttattaggcacaaagaaaaggaatttaggggacgtaaaaggatttatccatagtgaaaatattcaaattccagattctttcgatgcaagggaaaactggaaagagtgttcagatgttatcaacactattgtcgatcaatctgcttgtgcggctggttgggccctagctgcagcttctgcaatgagtgatagacgatgcatagcctcccaaggaaagcttaaagtgcctgtttctgctgaaaatatattggcttnnnnnnnnnnnnnnnntggatgcaaaataggatatatggaagatggatggtggtattggctacaaaatggaattcctacaggaggtctttatggcagcaaacagggttgtcaaccatattcgcttcaatcttgtgaacatcatacaactggtactaaagtggattgcagtactttgaaattgaatacacctgtnnnnnnnnnnnnnnnnnnnnnnnnnnnnnnnnnnnnnnnnnnnnnnnnnncttatgctgcaggtccaccagattggtacactacagttgccgatatgcaaagggaaataatgacaaacggtccagtagaaacgactttccgcttgtacactgatttctggaattataaaagtggtgtttatcataatgtcggtggagattatgctggagaccattgcgttagagttttaggctg

SEQ ID NO: 20159 - DNA, 527 bp, Diabrotica virgifera
  misc_feature (353)..(404): n is a, c, g, or t
gatctactttatgtacacacatctttatccgtacgagagatgcgcttgtaattgaagttactgcccgcgagcaataagttaacgaaacacgataccccttgtctggccctgttgtcgaatcaacactgggacctacccctgatgatattgaagtccctattgatgaaaggggacgtatagatacgcactgaaggagattccagtcgacgctctacgccctgaaatcaatgacatgagtgtggaagaagaaatgttgtaagatgagatcaatgtgatagaccttatggtcccttacgctcagatatgaaagattggtctctttggaggcggtgtcgtaggaagatctgtactgnnnnnnnnnnnnnnnnnnnnnnnnnnnnnnnnnnnnnnnnnnnnnnnnnnnntaacatgaacgaagataacataccagtgaaggataactagttatatcgggcgatgagagagtcgggagtcatctccctagaagataagatctttatgagcaatcgtgggccacgtactattga

SEQ ID NO: 20160 - DNA, 487 bp, Diabrotica virgifera
  misc_feature (14)..(14): n is a, c, g, or t
  misc_feature (17)..(17): n is a, c, g, or t
  misc_feature (22)..(22): n is a, c, g, or t
  misc_feature (26)..(26): n is a, c, g, or t
  misc_feature (30)..(30): n is a, c, g, or t
  misc_feature (60)..(61): n is a, c, g, or t
  misc_feature (73)..(73): n is a, c, g, or t
  misc_feature (81)..(82): n is a, c, g, or t
  misc_feature (84)..(84): n is a, c, g, or t
  misc_feature (119)..(119): n is a, c, g, or t
  misc_feature (134)..(135): n is a, c, g, or t
  misc_feature (141)..(142): n is a, c, g, or t
  misc_feature (161)..(161): n is a, c, g, or t
  misc_feature (179)..(179): n is a, c, g, or t
  misc_feature (183)..(185): n is a, c, g, or t
  misc_feature (217)..(217): n is a, c, g, or t
  misc_feature (238)..(238): n is a, c, g, or t
  misc_feature (263)..(263): n is a, c, g, or t
  misc_feature (294)..(294): n is a, c, g, or t
  misc_feature (302)..(302): n is a, c, g, or t
  misc_feature (305)..(305): n is a, c, g, or t
  misc_feature (364)..(364): n is a, c, g, or t
  misc_feature (406)..(406): n is a, c, g, or t
  misc_feature (423)..(423): n is a, c, g, or t
  misc_feature (453)..(453): n is a, c, g, or t
tcctcctagcgggntantattnaggnatangaagaaaatgaggtctttatgttggtgatnnagtattaagaantggtaaannanttttagtagaagttggatatggtattatgggttgnacccttgatggtatnnaaagtnnattgaaagaaatttgtganggtattgatagtatttanatgnnnaagggtattaatgtatgttatttatggagaanagtaaaatgggaattgaattnaatgaagattaagttgggatattanttaaatggaggtgatatatatggtttagttnatgaaaanagnattgttaaatataaaatgatttgtgttaatagagataagggtattgttttttatattgnatgaaaaggaaagtatattgttgatgaagtagtattggaaantgaatttgatggtgatngtataaaatatagtatgttggaagtatggnttgtaagttaagaaagggtagtaagtgaaaaatt

SEQ ID NO: 20161 - DNA, 695 bp, Diabrotica virgifera
  misc_feature (2)..(2): n is a, c, g, or t
  misc_feature (17)..(17): n is a, c, g, or t
  misc_feature (25)..(25): n is a, c, g, or t
  misc_feature (28)..(28): n is a, c, g, or t
  misc_feature (31)..(31): n is a, c, g, or t
  misc_feature (33)..(34): n is a, c, g, or t
  misc_feature (64)..(64): n is a, c, g, or t
  misc_feature (110)..(111): n is a, c, g, or t
  misc_feature (116)..(116): n is a, c, g, or t
  misc_feature (122)..(122): n is a, c, g, or t
  misc_feature (135)..(135): n is a, c, g, or t
  misc_feature (192)..(192): n is a, c, g, or t
  misc_feature (368)..(368): n is a, c, g, or t
  misc_feature (410)..(410): n is a, c, g, or t
  misc_feature (644)..(644): n is a, c, g, or t
gngcaatagaggggctnggagatantgnagntnnaggaaagaagggtctttaagaagagatatnaggggggaagaggagaaaggaaaaaatgaggaaatagggaggagannaaaangaaaanaccctttgggganagagggtgtggagaagtttatgtggtttatttagtagagggaatataaattagaggnctatttagaagagaaattatgaagtatggatatagtttgagaagttggtatgtggtaagagattttatcgatattagaaaggaattggggaaataattagaagtaaatatgggataattttataagaatattctggaattattaagaaatattgatgtaatggaattttaagaagntgtgtgttatgttgtgaaggagagtgtggtattaagtaatantatgtatggtgtggtgtttgtaaagaatatagaataaaaatgaagatatggtgttatttttgaggagtatgaggaagtaatgatataatggagatttaatattgttagaatagtattagggtatatgttattggatggatatttgaatgaattaagagtgatatttagagtatggatagagtgattggatttatattattgataagttgtagtgagtgatatgaaaataatganaattatataaagaattatatttgagagtattaagagaaaatattttgggtt

SEQ ID NO: 20162 - DNA, 852 bp, Diabrotica virgifera
  misc_feature (467)..(492): n is a, c, g, or t
ccttctacgcataggtacattttaacttatgtacatagggaaccttcggttgtggaacatgagcatagctgtcctagtctgcctgacaatatacaatgtgatgttgaccctaaaactgatgcacgctcaggagtgccccaagcagcaacagaaaattatacagaaagttgtttaccaaaagtgcaaccaagagtcgccatcaatcccggatgatgccttttcctctctggacctaaatttgggccgatgggacaaccagcacaaatataagctgtttgataattttgttttgggagaaaaatacataatcctcagcaacgtctacaaaacctgcctagcgactcagggctccctggataagctgccgtcaatcatagaagttgccaacaactggaatgggcctatatctctcgcgacatttgcagccagcgaagacgagctcaatgctttgctgttctatatctcgnnnnnnnnnnnnnnnnnnnnnnnnnncaacgataaggtaacattccatctagcattgaccaaggaccgcaaaccgaagaggtttaacctagatatagagaaacttagagaagctaaatgtgatagtccaatagaaatacttcaacacttaaccagaaacctccacaagggggctaatcaatggagaggcaagttaccgtatcctcagaatcatctgagaaacttgactcggaagaattgtcaaaccaaattcgtttttcttaccgatgtcgatataattcccgatagaaacatggctgagaggcctgatgtgtttttaatgatgaatgggtaaaaatgaaaataaatgtgttttttattttgcctagttttacaattgggtgaaaa

SEQ ID NO: 20163 - DNA, 421 bp, Diabrotica virgifera
aatctactaaacacattaagagggaacgagagaggcacctgaagaagccattgcagctccagcagatgaatttaataaactcgatagcactgtaggcctataaggttggattagcatctagactttcccatgctttttcgaggtccctacttctgaatcacaatgtataccgagccatgactgaatctggtcgaacactcggcgccgttggaaacggcactgagtcttgcgatgaagtaatggtgaagagattaatgtgatagaccttacggtctaacacgactcagatgtgaaagacgggtctcttaggaagcgttgtagattgacgatctgtacaagatgtgaaaccttgttgctcaagcgacctaaaacccaagttgatcacgcaacagaaaccccacgaacataaaatacaagtgaa

SEQ ID NO: 20164 - DNA, 860 bp, Diabrotica virgifera
  misc_feature (29)..(48): n is a, c, g, or t
  misc_feature (795)..(795): n is a, c, g, or t
cacgcctacatcttccccatacagctatnnnnnnnnnnnnnnnnnnnnatatatcgataagagatctggcctcgaatgctataatggaaattatatttaaaattagtacggaacaaaaccccttccagaacttatctcaggtgacttctgatatgtgcgagactggtagcttggggtccttttcggccagtccatcaaatctcagcccgtcttcggctagtcctgccatggggagttatccggtggttcccataactttgaatagtagaaataaaacgactcaagattcgatgacgatggctataaactttttaatggattcttacaatagggttggagttgaagaaaggaataatccaaagaagtcaagcgttcctcccatgagcgatgtacttaccgaattaagggcccagattattcaacatacaactcttttagctgcaggttgtataataccatccgaacacagactcgaatctcccttattacatccagtcctgcagcaatcaatccccagaggtttcttaaccgaattgatcacgaggacacacacaaacgacaagctcttctccaacgtcttcagtccgatactgcaaggcttgttcaaaatcatgcaacaagccagcatggtgggcgacgaacatcgagtaccaatccaaacccttttcgaattgactgatatcagatgtggaccgaggccgatatgtacgttgctcaccaaacaagcgcagttcatgcctctcgtttgcacgcctggcgccggacgtgagattatgaggtgttcctatcttgggncgttcttgaacgtgtctgtggtcgccgaagatgaacccaaggtggcggagaaatttttttttcgg

SEQ ID NO: 20165 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 20166 - DNA, 807 bp, Diabrotica virgifera
  misc_feature (4)..(53): n is a, c, g, or t
  misc_feature (55)..(138): n is a, c, g, or t
  misc_feature (144)..(161): n is a, c, g, or t
  misc_feature (173)..(225): n is a, c, g, or t
  misc_feature (227)..(299): n is a, c, g, or t
  misc_feature (310)..(382): n is a, c, g, or t
  misc_feature (391)..(486): n is a, c, g, or t
  misc_feature (529)..(546): n is a, c, g, or t
  misc_feature (552)..(573): n is a, c, g, or t
  misc_feature (695)..(737): n is a, c, g, or t
  misc_feature (772)..(799): n is a, c, g, or t
cacnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnncgcggnnnnnnnnnnnnnnnnnngaagataatccnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnccccttaaaannnnnnnnnnnnnnnnnnnnnnnnnnnnnnnnnnnnnnnnnnnnnnnnnnnnnnnnnnnnnnnnnnnnnnnnnggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgggggaaaaaccggctttttttttgggggaagtccacnnnnnnnnnnnnnnnnnngcgccnnnnnnnnnnnnnnnnnnnnnngttattattgggggggggggcgcgcgaattatttatataatgccgctcgccgcccttttaatatataataataaaggaggggggcgaaaaacccccgggtgggggggggcggggtcggtttnnnnnnnnnnnnnnnnnnnnnnnnnnnnnnnnnnnnnnnnnnnaacaagagggccacaaaacaacataataatatttnnnnnnnnnnnnnnnnnnnnnnnnnnnnctacatct

SEQ ID NO: 20167 - DNA, 616 bp, Diabrotica virgifera
  misc_feature (18)..(39): n is a, c, g, or t
  misc_feature (51)..(63): n is a, c, g, or t
  misc_feature (65)..(79): n is a, c, g, or t
  misc_feature (88)..(106): n is a, c, g, or t
  misc_feature (150)..(171): n is a, c, g, or t
  misc_feature (220)..(250): n is a, c, g, or t
  misc_feature (308)..(339): n is a, c, g, or t
  misc_feature (364)..(383): n is a, c, g, or t
  misc_feature (387)..(415): n is a, c, g, or t
  misc_feature (417)..(429): n is a, c, g, or t
  misc_feature (433)..(536): n is a, c, g, or t
gccaaaaaaaccccaagnnnnnnnnnnnnnnnnnnnnnnggggggatttcnnnnnnnnnnnnntnnnnnnnnnnnnnnnccggggggnnnnnnnnnnnnnnnnnnnatacaccccgtttagagagggggacacgggggggaatcccccannnnnnnnnnnnnnnnnnnnnnttccccccttcccatcctcaccggggcctttaaaaaggggaaaattttnnnnnnnnnnnnnnnnnnnnnnnnnnnnnnnctattttttccccccccaaaggggtcccccccggacatttaaaaaaatctcccttttnnnnnnnnnnnnnnnnnnnnnnnnnnnnnnnngggggtggggggtgggggcggggannnnnnnnnnnnnnnnnnnntttnnnnnnnnnnnnnnnnnnnnnnnnnnnnngnnnnnnnnnnnnnggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattatctttttttagggggggcccccaaaatattatttattctggggggggggcttttaataccaggggggggggggg

SEQ ID NO: 20168 - DNA, 978 bp, Diabrotica virgifera
  misc_feature (39)..(57): n is a, c, g, or t
  misc_feature (184)..(227): n is a, c, g, or t
  misc_feature (375)..(392): n is a, c, g, or t
  misc_feature (457)..(474): n is a, c, g, or t
  misc_feature (477)..(492): n is a, c, g, or t
  misc_feature (634)..(656): n is a, c, g, or t
  misc_feature (719)..(737): n is a, c, g, or t
  misc_feature (805)..(827): n is a, c, g, or t
  misc_feature (838)..(838): n is a, c, g, or t
  misc_feature (878)..(878): n is a, c, g, or t
tctgcgtccgggcacacactaggagaaaagtcctacgcnnnnnnnnnnnnnnnnnnnaaatttattcatgcaagtaatttgaaaacacatttaagagtgcacactggagaaaatccttttaagtgcgaaatttgtctaaagcaatttactgagaaaggtagtttaaaaatacatttacgagtannnnnnnnnnnnnnnnnnnnnnnnnnnnnnnnnnnnnnnnnnnngtttgttacagcaagtcatttgaaaagacatttgagagtgcatactggtgaaaaaccttttaaatgcgaaatttgtttgaagcagttgactagagcaagtcatttaaaatcacattggagggtgcacactggggaaaaacctcacacnnnnnnnnnnnnnnnnnngcagtttacagggaaaggtaatttaaaaacacatttaagagtacacacaggagaaaaaccttatnnnnnnnnnnnnnnnnnngannnnnnnnnnnnnnnnaaatctttaataacacatttgcgagtacacactggagacaaacagtctttcacttataagtgcgaaatttgtttcaagcaatttactgagaaaagtagtttaaaaacacatttgagagttcacactggagaaaaaccttatnnnnnnnnnnnnnnnnnnnnnnngtttagtgagaaaggtactttaaaaaaacattcgaaagtgcacattggagaaaaaccttaccnnnnnnnnnnnnnnnnnnnacaatttacggagaaaagtagtttaaaaacacattatttgagagtgcacactggggaaaaaccttatnnnnnnnnnnnnnnnnnnnnnnnatttagttacngatggagatttttgaaaggcatttagggatacacactggnggaaaaacctcataagtgtgaaaatttgtgttaagcaatttattcaagcaagtaattttgaaacacattatttgagaaagcacactgggagaaaaacagt

SEQ ID NO: 20169 - DNA, 313 bp, Diabrotica virgifera
  misc_feature (63)..(84): n is a, c, g, or t
tctcccgaaagatgaatatgatcgacctcctggtcgatgcgactaggaattgagagaacttgnnnnnnnnnnnnnnnnnnnnnnacgaatcctacatgtcgtggaagttgttgctcgtcgacataatactttaacccgtcaggaactgaaacaccaaccatgataaagtaacagttaggtttcacaatatattggtgaaaatcatgacagagatggacatagacgaatcaatcttcgttgatgcgatctgtgaggcaccttcgaatactcaagagcatatctgttatacttaaagactcttacatcctggatt

SEQ ID NO: 20170 - DNA, 1022 bp, Diabrotica virgifera
  misc_feature (416)..(433): n is a, c, g, or t
  misc_feature (730)..(730): n is a, c, g, or t
  misc_feature (875)..(895): n is a, c, g, or t
tgaaaagtacgttctacgaatctactaagaacacgaaatcgttacgtgggacgcacttctagtttccatcgcatccgcaaaagatgaatttaataagctcgggggtaccggaggcttagaagtttggattagtatctaaaatttcccacgctttttcgagtcccaatcttctggatcacaatgtttaccgagccatgactgaatctggtgatacactcggagtctttggaaacggactgcatcttgtgttggaggaagtgagaagagattaaatggcattgttgttactgttttagcgaattgtttttatttccgggtttttagagaatcgtctttatttccgccatataaagaggcgataaacgttcgtcgaccccaaaacttgaacttgagcttctactgataccccctgcacnnnnnnnnnnnnnnnnnngactcctctaatgaatgcaacgtatgccctaaaaaatgtaacatatcaatggactaatggtaaaagttgaacaaatacttcctagaactgcagaagaatctttcttacttactccacaaaccaattcaaaaagtactacgttaagagtgtatgaagagtatttcatataaatttccaacaaaaaatctagtcattttacccaattaggtaaatacatttttgtcatttttggcatttctctgattttggattgtcgtttcgtttcgaatagggctttttcatcgatttgtcatttgntttcgagccttctgtcatgtgtttgtataaatgtgtgtataaatattaatatacaacggattgtatgacacatgacagaaggctcgacacaaatgaactgagaatgaaaagcccctattctcactggccttaaatgaaacacagnnnnnnnnnnnnnnnnnnnnngaaagtttttgccataccaccaagaacagggtttcctcttggaaaatttttttagggtaaaaagttttaacaaataacttttaattctttggaataggggtggctggggttaaaaaaaaggtcctgg

SEQ ID NO: 20171 - DNA, 590 bp, Diabrotica virgifera
  misc_feature (98)..(117): n is a, c, g, or t
  misc_feature (544)..(544): n is a, c, g, or t
cataaaatctacataaaatatttgctgctcattcgagctgagttctttaagttgtgactaataaccacctttacaagtgtatttttcatgtttttagnnnnnnnnnnnnnnnnnnnncgtttaaataaagaaactgatttaaaatttcttacaaagtacttgcattacctgcaatttgtataacatcgcctgtttgattcaaagctttgcttataagcaaagctttgtaggctaagagataattttattatgaatggagctgaaatacagctataccaattagatactgtcaagcgatccctaaagcttttacagcgatttttccgaacaatccatccactccattggctaatttttcactttcagtaagttttctctcagcaggcaacgccagaatggtgacacagaagttctgaggagttactggttgtggtgtagtagtaacaggtaatggtgttgaactcgtgttattaggaactgttgtattggtagttggagcgagaacaatggtgttgttaacaaaggtgatatttgctaaaacttntggcagtggaaatacaaggtaatgaaacagtagctgacttcacagc

SEQ ID NO: 20172 - DNA, 169 bp, Diabrotica virgifera
tcctttgtgcgcgcgagcgtgcaagaagttcagagaactacgccttttatcgaggggattctaccgctggatgagatccgagaggcgccgagcgaaggcaaaggctttcgcgtagtatgagccctctatatctgccccgttgacgaccgtcgatagggtgcgacgatgg

SEQ ID NO: 20173 - DNA, 672 bp, Diabrotica virgifera
  misc_feature (62)..(81): n is a, c, g, or t
cacttccaacgcctcaaaagtaaatgcccccaaaatacagcctagtaaccaacacattgacnnnnnnnnnnnnnnnnnnnngaatgtgcttgctctaaataaaaataagtgaaattatttttctgagtgaacaatgtctcgttataaatcagatccgaatatatcggaatatgagtctccgaggtgttgcacaaaagttctacattacacgtggaaaactataacctgcttattttcgcacgtgtttttaatatcaatggtggtgtcatattgtgttttgggggcatttacttttgaggcgttggaagtgaaaaatgaaagagaggttaaaattggagttccgctgattcgacagaatgtcaccagacatctgtggaacttcacccaggagatgaaggctctggaccaaacaaagttcacaatcggagctactcaatatttgaaagattttgaaaagtctttgctagacaaaatgaacaaggaaggctggaacggagaagagaatctagagaaagttcaatggacgcgtaccggagcattattttattccatcatagttattacaacaatttggctatggacacatctctccggaaacgtcatggggaaaaggcgttaccatattctacgccatcttgggaatcgccattgatgcttcctcgtgtttatcca

SEQ ID NO: 20174 - DNA, 932 bp, Diabrotica virgifera
  misc_feature (439)..(458): n is a, c, g, or t
  misc_feature (505)..(524): n is a, c, g, or t
  misc_feature (849)..(849): n is a, c, g, or t
atcgtccggagcattgaacccaagcattatttttacaaaatatcattaaaacttacccatcgagatatccttgagcaagatctaacaacttggtaacaaattcttcattgcttttaaatcccagagctattctaatggagttccattttttaatgttttgggaaccgattaaggcatgttgtacttcccaaagaaatggttagcgtagtacccaaaactcatttaatgtctgaagatgaatggcgaggtattggagttcaacaaagtaaaggatgggtgcattatatgattcatttaccagaacctcatattcttcttttcaagagacctataacaacacctccgccctcccaataagaaataagtcaaattttgtacaaacccattccctatttttaagttttcggatagtttattacagtaaaataccttcatctgnnnnnnnnnnnnnnnnnnnntgaaagtactaaaagaaaattaaatagtttttgattattcttgtagnnnnnnnnnnnnnnnnnnnntgtttgagtgctgaagagtaaagatatttaaatagaataacatgaattctaaacacaaaatggtgaagtctacatatgttagtaataactatattgtttcatctcacatattgcatgaagagttcctgcctgtgtcatatttttaatataaatgtcaaaggagctgtgaaacatattgttttttatgtcttcatataatatatctacaaaatactctatggtctttacgtagggaatttgtactcagtacttcatacaattttgaaaagtaatttgattcattatttgtatagaatagaattaattatcacatataggcaaattntggtatcgaattgaaaacccctctattggttttgacaaattataggaataaacaaaaactgtacaatttgctaaaagatgtga

SEQ ID NO: 20175 - DNA, 104 bp, Diabrotica virgifera
cctcttccggtttttatcccgtgagatatttttgcagtccttttccttaaattcttcataattcaccatagaagggcagtgtattcaagatcaacaacggtaat

SEQ ID NO: 20176 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 20177 - DNA, 316 bp, Diabrotica virgifera
atcgttcgcttgatgtgtgtgtgagctactgtacataatttatagaatacgagacaatgtcattatccaccgctcgcccattagagatcgtatactatgagaattccgaggaattaaaggatccgaatatttcacttccagctgttttccgggatccaaaaagaacctatgaacccacgctacaaccccgacaggtgtcttcaatgcatcatcgaacatagagggtatgtgagatctgtgtgcgatcatcgggagtggatacaagatttgcaggacgtacagctatccgcattgcgcgaatactgctccactgtgg

SEQ ID NO: 20178 - DNA, 362 bp, Diabrotica virgifera
ctcttcccgcgcgaacagccacaaggaattacttgagattataaattttatggaggttatatctaccattgtttgatatctgataggagcgagcgaaggaaaggcttacgcgaggtagatcccattatgtctacaaccgtagacggccttcgaagggagagaagatgggagctaagacataggggaagcttacatagtaggcctgtagacctatgaccaattataaccaacaaacagggaagaacagagctgatgatactagatcgaggaaaatatgcgaagttggtggtaattttggctagacctttacatatgtgtgggtggatattatgaacagcaatgataatcaagatggaggctgg

SEQ ID NO: 20179 - DNA, 257 bp, Diabrotica virgifera
  misc_feature (130)..(147): n is a, c, g, or t
  misc_feature (182)..(201): n is a, c, g, or t
  misc_feature (206)..(243): n is a, c, g, or t
acccttagggataacagcgtaatttttattggaaagttcaaatcgataataaaagatggcgaacctccattttgggttaaaggtttaaaaatggggggaaccagttatttttatttaagttttggtccgnnnnnnnnnnnnnnnnnnccttgactctgggggtttaaacccggggggggagnnnnnnnnnnnnnnnnnnnnattcnnnnnnnnnnnnnnnnnnnnnnnnnnnnnnnnnnnnnncccaaaaaggggga

SEQ ID NO: 20180 - DNA, 846 bp, Diabrotica virgifera
  misc_feature (424)..(486): n is a, c, g, or t
  misc_feature (544)..(560): n is a, c, g, or t
  misc_feature (568)..(597): n is a, c, g, or t
gcaatataccgaaatagaaaataacatgacaggtatagaaagagttttagaatataccgacattgaatctgaagataaattgcaaggacgtacgttgaaaaattggccatcgtttggagaaataaagtacgaaaacgtctctttagtttacaactcatcggaacaaagagtattaaaaaatattagttttaccattaaaagcaaagaaaaaattggaattgttggacgtacaggcgctggaaaatcgtctattatttcagtattgttcaggctttataatattaagggtcgtattttaatcgacaatgaagatattaagaatttatgtttgaagtatttacgatccagcataggtattattccacaagatccgatattattttcaggttcgataagagcaaatatggatccatcaggaacccannnnnnnnnnnnnnnnnnnnnnnnnnnnnnnnnnnnnnnnnnnnnnnnnnnnnnnnnnnnnnnagatgatgtcattgttgagaatggttcacgttatagttctggacaacgccaattgatnnnnnnnnnnnnnnnnntggtcagnnnnnnnnnnnnnnnnnnnnnnnnnnnnnntacgtccaacatggatccagatacttgcagtctcttacaaaggacaattaaaactcatttttcacaatgtacagtgctaaccattgctcacaaattaaatactgttgttggattgtgataggataatgggttgttgatcttggtgaaattatagaagttgatacttcacaagcccttgaaacaaaacaaggtgggtttctttatccaaatggttgaacattcaggaaaaccagattaaaatatttgttt

SEQ ID NO: 20181 - DNA, 928 bp, Diabrotica virgifera
  misc_feature (875)..(919): n is a, c, g, or t
cgaagtaacgaatttgttcctttcgtttgcaccacactgtatgtattgaaaagcattggtgctaaaacacttccctgtgggaggccgttcttttgaactctccacctacttactttgccatccagcatgacaaaaaaacgtctgttttgcagtaaggaatatacaaccttacctagatggtggtcattgaaagtgtcatacactttgtggagcaatgttttgtgacttactgtgtcataggctgttgtcaaatataccaaggcagcccctgttataagtttttcttcgaagtcctcttcaatgtgttctgttagtgcgaggacttgaccggtgcaggatttgccgggtctgaatcctccttgttgtgggatttggtgcttgtcgacagaatatttaaaccctttgggaactgaaataccagacaagttccagtaagagatcgttttcaaagaaatatttatgtatataaagaaagaaatggtcatatatgtattagtccacttgatgtgacatgttatgcaacttccaatactcaagtaaatcgctgcaaaacaaaaaaactcttacaagcttgattgaaggctataattgtgtagtaaccgataacaaaatgattgtaagcagctgtttgtgcatttgtaactatgatttttttgtataattagaatatatcaatattatataaaaatcaaattagttatgtatgtttaagttcttccttttaacttctaggtatgtctgatgcaattaaaactagatattaagatttttttcgtttatttttattgatgtgatcatttgttgtgatctaatttggaaataattgtttttgttcccttatttagtatataaaattttaatcatcaattatgttnnnnnnnnnnnnnnnnnnnnnnnnnnnnnnnnnnnnnnnnnnnnngcccgctct

SEQ ID NO: 20182 - DNA, 913 bp, Diabrotica virgifera
  misc_feature (662)..(684): n is a, c, g, or t
  misc_feature (868)..(886): n is a, c, g, or t
cttcatgtcattcattcatgtgctttcgacattaacatcagcgaattcgtgatagattatcttgaaagtaaaatcgtgtcgacaacgaaatctttctaaccaaaaatttgatgccttgaattcacctatacctggttgcaccaacagatcttaggcttaaaacgtgccttaaactcagcttacgaaacatacacgtggcgccattgagccttagatgaattttcagtttgccataatgtatatataagtcacgtggattgtatcttaaacttcgtctcagttaagacgtacttagataagagacgaaaattatggtacaacataagtgagacttaaagcggccctatctataagctgagctgggctaagatagagcttaaggaggtagggagcgtaaggagcttaggcaatggaggttggctagacaattgcaaacttttctctgccctattcttattagatgttcaaaagttattccatttcggatgattctgagccttttgttggtgcaaccaggcattagtcctacacattgcgcttgcgcaacttcgatggctttggcttgaattataaacccagatattggcaagttcatgtttgccaatgtttgtttcgagccctacggctttgaagacagcttgatccacagcaaatccctcgcnnnnnnnnnnnnnnnnnnnnnnnaaggtcaccaccttcttgagtcacatgagtcttggcctactttaaaaattttcagaaaaattgtgatggtacttgaagggccatttggcaagtttttaaaaaaactataccggttttttcttaaataacataagcctttgtatacctataaaaaacatttggttactttttcttttttcaaacnnnnnnnnnnnnnnnnnnncggggctttctcaggagggcttataac

SEQ ID NO: 20183 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 20184 - DNA, 201 bp, Diabrotica virgifera
  misc_feature (7)..(44): n is a, c, g, or t
  misc_feature (64)..(77): n is a, c, g, or t
  misc_feature (80)..(95): n is a, c, g, or t
  misc_feature (116)..(116): n is a, c, g, or t
  misc_feature (152)..(152): n is a, c, g, or t
  misc_feature (164)..(195): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnattaagtctgttcgacttttnaaattttacatgatctgagtttaaaccggtgtgagnccaggttggttnnnnnnnnnnnnnnnnnnnnnnnnnnnnnnnngaaagg

SEQ ID NO: 20185 - DNA, 217 bp, Diabrotica virgifera
  misc_feature (7)..(44): n is a, c, g, or t
  misc_feature (81)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggattaaagtttataattgggnnnnnnnnnnnnnnnnnnnnnntgttcgannnnnnnnnnnnnnnnnnnnnnnagtttaaaccggcgtgagccaggttggttnnnnnnnnnnnnnnnnnnnnnnnnnnnnnnnngaaaggaccaaacatataaaatac

SEQ ID NO: 20186 - DNA, 1114 bp, Diabrotica virgifera
  misc_feature (113)..(143): n is a, c, g, or t
  misc_feature (853)..(870): n is a, c, g, or t
  misc_feature (879)..(907): n is a, c, g, or t
  misc_feature (945)..(978): n is a, c, g, or t
  misc_feature (998)..(1024): n is a, c, g, or t
  misc_feature (1045)..(1076): n is a, c, g, or t
  misc_feature (1080)..(1102): n is a, c, g, or t
aaagaaaaaggctcaaaatggctctcagcgacgcagatgtacaaaagcagatcaagcacatgatggctttcattgagcaagaagccaatgaaaaggccgaggaaattgatgcnnnnnnnnnnnnnnnnnnnnnnnnnnnnnnnggccgtctggtccaacaacagaggctcaagattatggagtactacgagaaaaaagagaagcaagtagaactccagaaaaaaatccaatcatcaaacatgttgaaccaggcaagattgaaggtattgaaagtaagggaagaccatgtacgtgccgttttggaagatgctcgcaaacgtcttggtgaggtaaccagagattcaggcaaatatacacaaatcctggaaagtctcatcctccaagggctctatcagacagaatacacaggcattcttgagaatctcattctgcaggggttgtttcagctcttcgaaaaggacatcaccattagagtacgccctcaggacagagaattggtaaaatctatcatgcctaacgtctcccaaaagtacaaggacataaccggtaaagacgtaaatctaaaaatcgacgacgagagccacctttctcaagaaaccaccggaggaatcgaactgttggccttgagaaacaagatcaaaatcaacaatactctggaagcccgtcttgagctcatctcacaacaattgattccccagatccgtaatgctctgttcggacgcaacgtcaacagaaaaatcactgattaagtattttttggatactgtgtattgcctggattttatataataatggaaaaacattgttgggtgcttaaaaagaacctcaaaaaccttttaaactactatggatnnnnnnnnnnnnnnnnnncccttcccnnnnnnnnnnnnnnnnnnnnnnnnnnnnngttggttgtaaccccaattgggatccctggccaacccnnnnnnnnnnnnnnnnnnnnnnnnnnnnnnnnnnggtccccgcgtaaaataccnnnnnnnnnnnnnnnnnnnnnnnnnnncaatattttattggtaatttnnnnnnnnnnnnnnnnnnnnnnnnnnnnnnnntgcnnnnnnnnnnnnnnnnnnnnnnnctcttttttctt

SEQ ID NO: 20187 - DNA, 273 bp, Diabrotica virgifera
  misc_feature (85)..(132): n is a, c, g, or t
gatggagagataattgtttgtggttcttgacctagcaaaatatgccatgttggtggcactgatgtcatctccttgaaaatttctnnnnnnnnnnnnnnnnnnnnnnnnnnnnnnnnnnnnnnnnnnnnnnnngatacgtatcatacacaattgaaacatcccgagtgatacagactaactagaaactgctctcgattgataacgaaaataaggacttattatacgagttttggtctcttatacctataaggaatatacacagaatgctctgaa

SEQ ID NO: 20188 - DNA, 551 bp, Diabrotica virgifera
ggaattacccaggggcgacccccgcgtccggcagctcgaaacaaatgactgtgaatgagaagccctatacagaagaattgattgtgttggtgtcctctctcttcgctctcttccatacaacatctaactgctttttacggaataatactcacagatcgcctacctcctctgaggtagatgataggtgaggtgggtgagaggtaggaaagagagttaggtgatctgggataatacttattaatattggcacgaaaagaaaaaggtttgttgtgtcaaaactggctacgattgcctcggtttttaggataacttcgatattgaaaacaaatttttaatgacgagagagaacagaatagaatgaaaaataggaagagcccagatactccacagataatggaaattaatgtaggtcaaacgctgcaaccgaaagatgggcccgctgataagacgaccgacagatctcttttctgagttcggagcttctgatcactctgagtatggagcaaatagatttgatgcatacagggataacgattcagacgaaccatcat

SEQ ID NO: 20189 - DNA, 269 bp, Diabrotica virgifera
ccctctaaaggttaagggtaattatattgcaaaagactaacatactgcgaggaaagtagtggcaaatgagctccgactctcatggggaatatgtacgaatcctagccattccagggtggaatatctcgcttgatgggagggctcactaacccgttctacggtaacagattcaccatcagcagaggatcgagctggggttttcggaggccgaggataacaagcgatacccatcacccacagagccatcctgacacgtctcctgggacaga

SEQ ID NO: 20190 - DNA, 937 bp, Diabrotica virgifera
cttgaagtgaaaggttgtaggttatttaaagtaattagtaagttactaaattaactagttgtaatgttaacaattactataagagaaggtcaagaataattcaacaataaataaatggtgattttcaaaaatagaggtataatcatgaacactaaattgtactatatcttggcctgtcttgcaaattatttcttattatgttctactgcagtatcagatgaagaatatggattgatgccagatatatttcaagttgatgattttgattcgtgtatgatgttaaaagatagagctctttactgtgaaataacatatgaattcacacccataaatccgaataatccaccggatatatggaagactataaaggaagttagttcttcagaattacattatcgacacgacctattacgcctttttgtatgtgttccaaaatcctgtccaatgacaaaaatatccaattctacaaacgaaaagttgagaaaagacttaaatgactgtatcgatgaaaggcatagaagtttgggttttaaaggaattgtaaagattaatgcttgcaaaagggtaaatcctatatatgaagttgataccggagactggctgtttgcaatcgctttcttctcctacatgggttttgtccttctatgcacaatgctggagtacaaaaataaggaagatgaaggattttataaaaacacttcaaccactggaaaaattatactttccttttcaattatgagcaactggaataagttgaaaactgttcccacaggaccaaaattcgaaagattaaggccagtgcaaggctttaagggtttatctatcaattttagtaattctttgtcacacaggccttagtcaagttgcaattccagttaccaatacaaaatttttagagaaatataacgactctccagactttctgaatgaaattcca

SEQ ID NO: 20191 - DNA, 922 bp, Diabrotica virgifera
  misc_feature (685)..(704): n is a, c, g, or t
  misc_feature (805)..(805): n is a, c, g, or t
  misc_feature (879)..(879): n is a, c, g, or t
ataggttctgttttgatggtcgttcattaaatgaagtcactgttcatgatacatatcctttgccccaaatagacagaattctttcgttacttagaggagctaaatgcattagttccattgacttaagaaaagctttttggcaaatcccgctgcatcctgactctaggaaaaagacagcctttaatgtttctggtagaggttcctttcaattcacttctgttccttttggtttgtgtaatagtgcacagattcaacaaagattagttgatgctatctttggccctgaatttgaaccctatatattctgttatttagatgacatcatagtgtgtaccccatcttttgaagaacatatccgattgttgaaaattataagagataaactgaaagaagcaaacttgaccattaacatcgataagtgtgatttttttaaatctgaattgaagtatcttggttatgtagttggtaacaattcccttaaagcagatcctgaaaaaatcttagctatggttaattatcccaggccatctaattctactgaaattaaaagatttataggtatgtgttcctggtatcgtcgtttcattagagatttttccagtttagcctcccctattaatgacctccttaaaggtcatagaaagaaaaaacaaccagtagtttggactagtgaagctgaaaaagnnnnnnnnnnnnnnnnnnnnctcctaatttctgcccctatcttagcccaacccaatttcgaacttccctttgttgtgcaatgtgatgcatctgacactggtcttggtggtgtcttgactcnaactattgatggtgaagaaaagttatagcttatgcaagtaggtcccttttccgagctgaaagaaattattcagntacagagcgagaatgtctcgcagtgatcttcgctatcgagaaa

SEQ ID NO: 20192 - DNA, 828 bp, Diabrotica virgifera
  misc_feature (361)..(375): n is a, c, g, or t
aaggagtatgctactgaagttgatgtagatttcgtcaggaaggcagttagagctattggtagatgtgccatcaaagttgaaccttcggcagaaagatgtgtggctacacttttggaccttattcaaacaaaagtcaactacgttgttcaagaagctattgttgttatcaaggatatatttagaaaatatcccaataagtatgaaagtattatcagtacactttgcgaaaatttggatactcttgatgagcccgaagctagagccagtatggtatggattattggagaatatgcagaaagaattgacaatgctgatgagctattggacagtttcctggaaggtttcggagatgaaaatgctnnnnnnnnnnnnnnnttattgacagctgtggtcaaactgtttttgaaacgcccccaacatacgcaaggcttagttcagcatgtactaagtttagctacacaggattccgataacccagatctaagagaccgtggttttatctattggaggttgttgagtactgatcctgcagcagccaaagaagtagttctcgcagacaaacctctgatttctgaagaaactgatctactagaacctacacttcttgacgaactgatctgccatatatcttccctagccagtgtttatccacaaacccccaactgccttcgtcgaaggaagaactgcagggatccgcaagtctttgccagctagaccaaggatctgtgaaaaaactttttagggctcctacaaccccccgttattccttatctagagaggcttcctccgggcctcgctctaaatggaatccttaacccctccaactcc

SEQ ID NO: 20193 - DNA, 1185 bp, Diabrotica virgifera
  misc_feature (119)..(135): n is a, c, g, or t
  misc_feature (137)..(149): n is a, c, g, or t
  misc_feature (780)..(780): n is a, c, g, or t
  misc_feature (806)..(806): n is a, c, g, or t
  misc_feature (1054)..(1074): n is a, c, g, or t
  misc_feature (1116)..(1136): n is a, c, g, or t
aataatacaaataagacgaactaaaattctaagtaaataaccatcatcattgaatttaaaaactacaagcgttttttttgcaaattgttgttaaaataacgatacaggtatttttaggnnnnnnnnnnnnnnnnncnnnnnnnnnnnnncaagatgaaactgttggttgctatctacttaattatacatatagtcactgctttgagtgacaaggaagcctggaaaacatttaaggatacatatggtaaatcttacaccttattagaagaaccgaatcgttttagaatttttcaagttaatttacagagaatccaatgtcacaataagagattcgaagctgggcaatcatcttatcagctcggtgtcacagaatttaccgatttaacatcactagagtttttgaataagtttaaaccaattcaaattaacgcatctaacaagcaaagcaatattcaacaacacactattggtgattcaccagatgaaattgactggagacaaaagggtgctgtaactgaagtaaaagatcaaggagctttaggttcatgtggagcttttagtgtaactggtgcagtagagggtgctaaccttatatcaactggcacattaatttctcttagtgaaaaaaatctagtagattgtataaaaactaattcctgtgatgcggattggataacaagagcttttgagtatatagaaaataagggaataatgtcggaagatgattatcctgcgacttctgatgatacctgcaaatataatgcttcgcaagttgctgcncaaataaaaagatttacgtatattanacaagatgacgaattagaactacagaaggccgttgcatctaatgaaccaatttctgtcattataatgtcactcctaattccagttttatgtatcaggtatatttgatgacgagaattgcttccagaacaaattaatcacaaggctcctcgtgggaggataagggaatttctaatgccccactattattggaatagttaaaaaattccggggggggccccctggggaatggaaggggtccaactaatgnnnnnnnnnnnnnnnnnnnnncagggggaaaagggtcaggagaggaagcgaaatggcaaaggnnnnnnnnnnnnnnnnnnnnngggggtattaatttttctcctaccacaactcctttttattatctaggtt

SEQ ID NO: 20194 - DNA, 729 bp, Diabrotica virgifera
catcccccggccccccctccggcccgaccgctattgacttcttgaagctataacgccttttatgcgacaccaaccgcgatatctacacctctactgaacttcgacattcacagttgctatgcacattacggtgggatcgtctatagtggacgatcggcctagctgtatgtcgaccataacctctagttacgccagtgcaggagatacgaacttgattggagatatgaaaaacaatatcacaatatagatggaagaaaatagtcttcggttgtccatacacaaaaatatctatattacccacccggtcctaaccattgtatttctcttacctcctcttccaaacagccgatccaatatttacatacatcaatatataccacacatacttgaacatgtccgtcgaaacaaaccatctagaaacttcggacaaatgatactacgagaccacaccattagtctaggttaagtctctaaaagtacgtatgagctacagaaaatgcactaaaaatacgctgaacactgatgataccgccctgccgaagaaacagtgagctaacaggagcggcgaatacagattaattaaacagatgagctacacctacaagatttctcttcgcgagtgtcgtggaagaataaggagaagatgcatgcataccacatggacctaaagtagacccacgatgggctatgccagtgctcttgacaaacgagatacactttgttccttaa

SEQ ID NO: 20195 - DNA, 971 bp, Diabrotica virgifera
  misc_feature (818)..(818): n is a, c, g, or t
atcaacaactaaatatgtgttttaatgattaaattactttttaatcatgaactgaatagttcaaaatgtaggttgctacaagcaagttattcattctacacctggccttcagcaccagttcttgcatggtttatctgggaaaatcgtgaagaattttgtggtaaaaaagttgttgaactaggagcgggtactgcccttcctggaatcgtcgctgctaagtgtggtgctgatgttatattgacagaatcagccacactaccaaaatctctatctcatactagaagaagttgccaagttaacaatctagtggttaatcaacacattaaagttattggactgacttggggattgtttttaggtaatttagatctgcttggtcctcttgattacatcattggttcagactgtttctttgaaccagcaacatttgaggatattcttgtcacagttgcatacttgctagatataaatattaacgctaaattcttctgtacttaccaagaaagaagttctgattggtctattgaacatttgctctcaaagtgggacttggagtgtattgtgcacaatataaacaatttagggaacagtataggtctcaacattcacgatttaattggagatcacagcattcacttgcttgaaatttcaagaaaatcataagtaatggctacgaatggtgttcgccaactctacagattgtatgtgagcaacattccttggaccgttggttcaaaagagttaagaacttatttcagtaagtttggacatctgcaacaagctactgttgtatttgatagaaaaacaggactgtctanaaactacggctttattacatttagtaaccgtgaaggcttagaaagcgccacaaaaaataatttacataaattggagggaaatacaataagagtacagccatcaaatcctgaaaataaaaaatggctgatgcagtagataattttagtgattta

SEQ ID NO: 20196 - DNA, 779 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (689)..(710): n is a, c, g, or t
  misc_feature (741)..(766): n is a, c, g, or t
tcgtannnnnnnnnnnnnnnnnnnnnnngatagaaaccaacctggctcacaccggtttaaactcagatcatgtaaaattttaaaagtcgaacagacttaacaatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnnactatagggtcttctcgnnnnnnnnnnnnnnnnnnnctttttaannnnnnnnnnnnnnncnnnnnnnnnnnnnnnnngannnnnnnnnnnnnnnnnnnccccttcattccagctttcattaaaaaaactaatggattatggtaccttagcacggtcaaaatacccgcggccattcaaatttaataagggggcaggcgagaatttatatttaatacaaaaaaacatggtttttataaacaggggaaaaaatgttggcgaattccttaataaacccaaatttttttactaaaaataccatttttttaaactaaaaattaccttcttacnnnnnnnnnnnnnnnnnnnnnnttactaaaggaggtaaaatattaggtttaannnnnnnnnnnnnnnnnnnnnnnnnngggggggcccttt

SEQ ID NO: 20197 - DNA, 215 bp, Diabrotica virgifera
gactgctcacattttccatcgttgagaccaggtatatttcaatttattattgtgctatgttaaccatttagaggattacggcgaatgtgcgtatcctcagtggacattggatcgaagaagcaatctacaggagagcgccccggaagattggagacctatgacgactatcgggatcggcgcaaccgattacttacgaataatattcagagtactcc

SEQ ID NO: 20198 - DNA, 736 bp, Diabrotica virgifera
  misc_feature (11)..(11): n is a, c, g, or t
  misc_feature (13)..(14): n is a, c, g, or t
  misc_feature (57)..(57): n is a, c, g, or t
  misc_feature (59)..(59): n is a, c, g, or t
  misc_feature (73)..(92): n is a, c, g, or t
  misc_feature (99)..(99): n is a, c, g, or t
  misc_feature (134)..(134): n is a, c, g, or t
  misc_feature (144)..(144): n is a, c, g, or t
  misc_feature (308)..(308): n is a, c, g, or t
  misc_feature (648)..(665): n is a, c, g, or t
  misc_feature (680)..(719): n is a, c, g, or t
ccttaagcgancnngagcgtattgtgttattttggggggtttctttaaagagggggngnaagaagagagaggnnnnnnnnnnnnnnnnnnnngggaaanagaggaaaaggaaaaagactccccagagagagaanggaaaaagangagaaagagaggggcgggggggagaaaaaggagaaagaggaaaagaaggaggaggggaggaagaggagaagaagggagaaaggagaagggaagaaggaagggaataaaaggagggggaaataaagagggaggaggggagagaagaagaaggaaagataaagaanggagaggaaaaagaggaaagtatgtttgatatggaagagtattaatttttatgtaaatatttagatgagggtgatttaataattatattggattattgttgtatattgttagtagaaagagatatataattttgagattaagattagttttaggattatgattgagatttgtgatttatggatgaatatgtagtaatattgttatattaggtgatttagttgttgtaggaagtgtttggattttaatataatttatagtatggattggatttattaaaattgtaattttgaattggaaagttagtagtatgtttaagtgataatataataggaggaaagnnnnnnnnnnnnnnnnnnggaaatagtggaggnnnnnnnnnnnnnnnnnnnnnnnnnnnnnnnnnnnnnnnnttgaagttttagttatt

SEQ ID NO: 20199 - DNA, 722 bp, Diabrotica virgifera
cccaaaacttgacaaaaatgggtatcgacatcaaccataaatacgaccgtaaggttaggagaacagaacctagaagtcaagatgtatatttacgtcttttagtaaaactgtaccgttatttagcccgtcgtacaggggccaaattcaataaaataatcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctagggccaggatcttgaaagctggaggtgaagtcatcaccttcgaccaattggcactcagggccccaactggcaataaaactgtattgctacaaggcagacgtaatgcccgtgaagctgtgaaacactttggtcctgctcctggtgtaccacacagtcatgctaagccattggtacattccaagggacgcaaatttgagagagcacgaggtcgtaggcgctcatgtggttacaagaaatagacttaaggttaggagaacagaacctagaagtcaagatgtatatttacgtcttttagtaaaactgtaccgttatttagcccgtcgtacaggggccaaattcaataaaataatcctgaaaaagatgtttatgagcaaaat

SEQ ID NO: 20200 - DNA, 612 bp, Diabrotica virgifera
  misc_feature (335)..(358): n is a, c, g, or t
  misc_feature (595)..(611): n is a, c, g, or t
caactaggatcagttttgtaggacattctttaggtaatattataattagatcagccttgacgcggccccaaatgaaatttcttcttccaagactgcatacattcttatcactctctggaccacatttaggaaccttatacaacagtagcggattagttaatatgggaatgtggtttatgcaaaagtggaaaaaatctggatcgcttctgcaactatgcctaaaagattctgtcgatccaaggcagtcgtttttatatcgtttgagtcaacgaagtacgttgcaccacttcaaaaatattcttctttgtggttctggccaagatagatacgtgccnnnnnnnnnnnnnnnnnnnnnnnngtgcaaggagtcactgaaagacacttcggatcagggaacaattttcagagaaatggtacacaacataatttctccaataattgctcagaaggaggtgaagctgatcaggtacgacattcaccacgcgctcccgaacacggccaatgctctgattggccgagcggcgcacatagcagttttggattctgagctttttattgaaaaatttatggttgttgtgggtatcaaatatttccnnnnnnnnnnnnnnnnng

SEQ ID NO: 20201 - DNA, 1158 bp, Diabrotica virgifera
  misc_feature (2)..(48): n is a, c, g, or t
  misc_feature (133)..(158): n is a, c, g, or t
  misc_feature (173)..(185): n is a, c, g, or t
  misc_feature (188)..(212): n is a, c, g, or t
  misc_feature (256)..(285): n is a, c, g, or t
  misc_feature (330)..(351): n is a, c, g, or t
  misc_feature (416)..(433): n is a, c, g, or t
  misc_feature (552)..(590): n is a, c, g, or t
  misc_feature (593)..(605): n is a, c, g, or t
  misc_feature (818)..(841): n is a, c, g, or t
  misc_feature (859)..(871): n is a, c, g, or t
  misc_feature (873)..(885): n is a, c, g, or t
  misc_feature (901)..(929): n is a, c, g, or t
  misc_feature (955)..(1007): n is a, c, g, or t
  misc_feature (1022)..(1061): n is a, c, g, or t
  misc_feature (1069)..(1120): n is a, c, g, or t
gnnnnnnnnnnnnnnnnnnnnnnnnnnnnnnnnnnnnnnnnnnnnnnngattaagagaaaataactgtaaaaatattctattatttaattgttttattacacctgaacttccataatattcaaatcatcctannnnnnnnnnnnnnnnnnnnnnnnnnccaaaataaattggnnnnnnnnnnnnnccnnnnnnnnnnnnnnnnnnnnnnnnncatattattctaaaaaataatactctagaaatattatttaaccnnnnnnnnnnnnnnnnnnnnnnnnnnnnnnctaactcataacctaatcaaactccaactataataaaaatcaaannnnnnnnnnnnnnnnnnnnnngaagacaaataaaaataggagtagaaaatactaatcaagaaaataatcttccactaaaaactacnnnnnnnnnnnnnnnnnntatacccttaagtattaaataaccagtttcagataatatatttaaagctagataattaaatctacccgttaaagaataataagttaaacgaaatctataagcaactgtcaaaccaatannnnnnnnnnnnnnnnnnnnnnnnnnnnnnnnnnnnnnnctnnnnnnnnnnnnntcaaccattaaaatctctagaataaaatccagacataaaaggaaaaccaccataaagaaagattacaaatattttaaatagttaccaggcaatgggtaaatgttttattaaaaccttcctatattaacgaatatccctgacaattattttaaattatgaataatatttacccagcacacctaaataaataaagggttttaaataaaagaattnnnnnnnnnnnnnnnnnnnnnnnnctaatttatatttccccnnnnnnnnnnnnncnnnnnnnnnnnnnccaattggcttaaagnnnnnnnnnnnnnnnnnnnnnnnnnnnnnccaattaaaattaaccccccaaaccnnnnnnnnnnnnnnnnnnnnnnnnnnnnnnnnnnnnnnnnnnnnnnnnnnnnntccctctctcctatnnnnnnnnnnnnnnnnnnnnnnnnnnnnnnnnnnnnnnnntccctggnnnnnnnnnnnnnnnnnnnnnnnnnnnnnnnnnnnnnnnnnnnnnnnnnnnnagggggaaccgcttatttgttgttgggggcggaccccc

SEQ ID NO: 20202 - DNA, 910 bp, Diabrotica virgifera
  misc_feature (2)..(33): n is a, c, g, or t
annnnnnnnnnnnnnnnnnnnnnnnnnnnnnnncaaaatactatgtatttttaacagtgctatcatattttctctttgtatataaactaacaaacactcctatgctagcaggaacaactgctatcaacatcacagatttctcactaaaaatgtcactagagatcccagtaaataagggagtcataaacctcgcaactgacataacactgttcgaagcaccagacagtgaacctcgatgcaaggcctccgtcttctcgaacatcaattccatgctggcaactctcatggccgtggctgccagggagagtggtgccaggaaaaacataaatactataaagttcggcgacaggtacatcgctatgaaacagagggctaaaactccgaaccatacacccatcttggtgtagacgtccacgttttttaagaaactatccacttttttcaggcacaaaccagatatcattcctatcgtactgaacaaagagatcatgtatccgacgtgtttctgggacatctggaatgtttctcgtagatatatggcttgatttgaaaagtacaccgttatggtcaaacctaagagaaattttaggagaaaggtatcccagtgaactttccaatcaatggatactatttcgtttacagattttttgaattcggatgtcacggtttgccatccgaatggagttgttggttgaatttggcggtgtactacctttggtattttctggcagataacaggcacagacatagttaataataaacagtagtccagtaagcatgcacacataagtgaatccatgggttaactctgatagatttcctccaacaatggtccaacaatgaatcctaatgaagcaactgaagcggattttccgaaaatgtcgttttgctcttctgaagaaaccaaatc

SEQ ID NO: 20203 - DNA, 547 bp, Diabrotica virgifera
attgaaaaagaacaacctacccaagaaccttccagtagtccgattgctgaacaaccccagagtagtccactccccccggttgaaattccttcaactgaaggtccagtcttgccaccaggtctccaaaactggtcacagaagccttaccatccaccaagtttacctgagcaccaacaacatcatacaactgccgaagttcctcacctcccagaagacagtcattatccagcacaaccgtatgatcaagattatgaagatgaagacaatgttagctatggacctggtacctgccgatatggtggaaaggtctacctttcagcacaacaaatcccgcgagacgatccttgtgatttctgcttctgcttcagaagtgacattatctgcttacaacagagctgtcctccaccaataagggggtgctaccaagaaacgattaagggcttctgttgccctcgatatgaatgtcatgtatcgatggcaacaatggtgaatatcaccaccactagtacaacaacaaccactaccgttcctccgcacttcttgtcgc

SEQ ID NO: 20204 - DNA, 394 bp, Diabrotica virgifera
ataaaaacattttattcacttttgaagactgacaatatgtttacagaactgggtaacttgccactaaatccaatgcgcacatattaatatttctctccagtccgaaagatccttgttccccccaatctggacgccatgagttctagacgatacaataagggttgtggttttcttcaccttaagcaacgatcagtatgccgcgcacctacctgctctctgctatttcctcactgttcttgatgaacacgatttgagtataatcggctgggattcatagtgaattgcagcacaatttggagtagtaattatcaacggatatggcctatccaccctaagttggggtgcacttcgttaaccccattgtatgaatactgctggattaacatgactgcgt

SEQ ID NO: 20205 - DNA, 737 bp, Diabrotica virgifera
gacgtccttgccgggcccccctccctcgtccgagcaacttcacagaatgatatacttggatgaacttgatcgagttgatgctgcggtctgaggttatcaatctgcccaacctacaacaaagacgacctgactcaaactagatcaaagtgcctctcagactgctcgacgcgaccccaaaacggacgcccacgatagacagactaaggagagctcccaaactttgttgaagataaactagttgttgttcatatgcaaagtgtggcaccaagatcatgattcactcgtcgctaaacataatactgtgtctgtgtcaccagtattagcctagaaatgccatttggtgatcaggcgatgtgtaacatggctaatgtattagtccgtcagaggtgcagctgattcttacactctggtaaagacctctcttttgttctccctttagtgtgctcccaaagacattacgaaaattaccatattatgacacgaaatatagagactttaaccatattatattatgaaagtgaacattgtgacgtacgctatcataggtatcacgactgtatacctgaccatatagaccgcatagatgcttatactgatttagccaaatacaatgtaaatgatccggctcactataccctccgagattgcgaaagacagtcgaatttcaccgactttgctactctggtggctcatctcgccccatagtcacagagtgaatcaaatctaatatttgctct

SEQ ID NO: 20206 - DNA, 794 bp, Diabrotica virgifera
  misc_feature (9)..(49): n is a, c, g, or t
  misc_feature (51)..(63): n is a, c, g, or t
  misc_feature (67)..(84): n is a, c, g, or t
  misc_feature (129)..(169): n is a, c, g, or t
  misc_feature (211)..(240): n is a, c, g, or t
  misc_feature (708)..(727): n is a, c, g, or t
cctctccgnnnnnnnnnnnnnnnnnnnnnnnnnnnnnnnnnnnnnnnnncnnnnnnnnnnnnncacnnnnnnnnnnnnnnnnnncttactattgcgacataatattccatttttataaaagaccaatcnnnnnnnnnnnnnnnnnnnnnnnnnnnnnnnnnnnnnnnnnctctctcttcattatttccgaatttattgacccttgacatgnnnnnnnnnnnnnnnnnnnnnnnnnnnnnntctctgtgtttcgcagagaccatgatccccgtttttgtaatacatctagactttctcgaccgacattacctatatgtagtaccatcatattctgacctaactagtactaccgtatgaatattatgaatccttcggaacggaggctatcaccattgaccattcctactcaatgtaccactagaactgacgcatgaatgatattcgtgtagtagttcatgagactatccactgttaatgccaactactttgattttgtaccaagtccttcatcttttttgaaccttgaagatcatccaccccccactattgcgcaataatttttcccctccctaccaccgaaaaccctaccccaaaaattttatgcttcactaccgacatgcccccacccccatatccccatgtaaaaattaacccaggatttttttaatcaagcttttcagctccgcctcacaccccccccactctctnnnnnnnnnnnnnnnnnnnnttcccctccgaaaaggggcccccccccctttccctctttttcctaaaccactcccccccctcttctc

SEQ ID NO: 20207 - DNA, 69 bp, Diabrotica virgifera
accgctgggggaaaagaaaaaaaatgcttgaaaaaaaccatttgggtggcaccgaagcggggttaacct

SEQ ID NO: 20208 - DNA, 885 bp, Diabrotica virgifera
  misc_feature (134)..(154): n is a, c, g, or t
aacctcgtggacagtctgcacaatgtatttcatgtatcatattgactcgatcataatatctgtaattgttaggttttttttgcttgtccgaagtttattttttatctggacgcttatgttcacccttcgtaatnnnnnnnnnnnnnnnnnnnnngggcttcccaatcacgatataagccacaacacgtgtcaatgataaacagtcaagaaaatccataatacgtatctgggaaatgtaaaaataaatcgtcactgaaagatataaatagttgcactgcgattcttatcaataaaacatcgcatcgcctgtttactacatttacgtcacaaataaaattatgaacctatatatttacttttatctagctatatctctattcaattattattgtctattgcagatgacgcaaaaacaaaaatgtgccccatttagaaacatacatcgatgttcgatgctcctcctatatcggaaggtgtcttctttgctcgttattctctgcgaacttacgctacttttttctgtccctagctaattatttgacttcctgccaccattttcctctattcttcaatatttccatcacatttttattccagggttttccttggttttttctgttctaggcctcttctgttttccctatcggcctcgcttcccatgtcattttaacttgtctgttgtcattcattctaaataagtgtccagtccattttaatttctcttcatgaattttttcctttaatgtttttacttttaattctcttcctatatcatcgctacgtcttttatcagctctcttagctcccacgacttttcttaaatacctcgtttccgcggctttgcatctcttttcttgtttgtcgttcaatgtccaattctctgct

SEQ ID NO: 20209 - DNA, 1146 bp, Diabrotica virgifera
  misc_feature (390)..(409): n is a, c, g, or t
  misc_feature (986)..(1012): n is a, c, g, or t
  misc_feature (1068)..(1108): n is a, c, g, or t
gtaacatctaaggtgaggtagcggataacatcttccaccggcccgaacatcatggctgaagcggagcaacaacaaacagcgccagaacaacctaaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtaggtgaaaagggtaacgaggcggccaatgtaaccggccctaatggtgacccagtaagaggttcgccttatgctgccgaccgaagaagnnnnnnnnnnnnnnnnnnnnacccgagaggaagacgtggacgtcgtggcggtagccgaggcggcggaccgccaagggaaagccaaagtgaaggcgaattaaaggatggggtacaatcaggcggtgaaggcggccaaggtggccaaggacccccacgtcgttatgcaccaagacgcggacgtggaggatattcatattacaggggaccctatcgcggaccgccaggagaattagaacaaaatggagatgctccccgtggtcgtcgacccccacgtggctttttccgtcgtaattatcgtggaggtcgcggcggcgcaagaccacgttcccaggacagccagggccaggctggagagctaaacggtcaagaaggtggaccacgtggacctcgtggaccacgctaccgcagacgtggcccagcccgtccaagagccggtaactctcagtcagagtctgcaggaggaaaccaaccaaataccaaggaaagtcaaccagtgcagaaacacactacagagagcagggctaaagcgtaatcccgctcaagtccctccctttaaaatcttaaaaaatttaacaaacgttaacggcgggaggtttnnnnnnnnnnnnnnnnnnnnnnnnnnnttttcatggggaaaaggttggaaccccctaaaaaatttttgttcaatttcctttcnnnnnnnnnnnnnnnnnnnnnnnnnnnnnnnnnnnnnnnnntttacgaggtttggccccccccaaaaattttttcccct

SEQ ID NO: 20210 - DNA, 941 bp, Diabrotica virgifera
  misc_feature (44)..(818): n is a, c, g, or t
  misc_feature (897)..(914): n is a, c, g, or t
gcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaaaacttcaaaaaccccaacttccgacaaagaaaatggatcctcctgaccacttcttggacctctacaagaattnnnnnnnnnnnnnnnnnnttgttccatttgaagatccttccacca

SEQ ID NO: 20211 - DNA, 479 bp, Diabrotica virgifera
  misc_feature (409)..(409): n is a, c, g, or t
  misc_feature (419)..(419): n is a, c, g, or t
  misc_feature (451)..(452): n is a, c, g, or t
aaacataacctaaaattttaatagacgtgcttgaaacttgaaagtgaagttttataataaacatttttaaaaccatctgaatcacatcacacagtagctttttttccgtttatcttttaaaaaataattgaaatggctgctaaaattaatattattgatccaccttcgtcggcgagttctgatagtgatctagaggaaacgcatgccgatttttcggaggtttttccggatatagaaatcgaggaagagaaaagtggagatttttatcacacgccagcatctccaataactgtaccttattgtcccagaccaccctcaacaggttcccaaaaatcaccaagatcaagaagacaaagaacaacgtctctaaatcagtcgaagaaaccgacagaatctataataaggactncacatcgcancatatatacagctggcagaccaccttggtacnnacagcgtggacaaaaaagtgaaccttt

SEQ ID NO: 20212 - DNA, 813 bp, Diabrotica virgifera
  misc_feature (554)..(574): n is a, c, g, or t
tgcaattctatattaatggagaaatctttagtcatggaggacagatcgaatatcttacggcggatgaaagtatgccgtttctgcctttgcaatgaagaagataatttattaaacatacaagaaaaacatccacaggaccctgatattaacatacccctaccttctctatcgttacaaattatggcttgtgtatctatagaagtgctccaaagtgatgggatgccccaattcatttgcaaagattgtcgaaatattactacacaagcatatatttttaaaacgaattgtaaaaaatcagacgatgctcttaaactgttcctccttacgggccaaatggcgaagccttacatgcatgatgtggttcaaattaaagttgcacctgcttcggaaaaatgtatctcctatagtacaggaagatgaggaggttgagaaaaatgaaaatagttactactactactatggggggagaaacaaagattcataatgcagtggcagaaactgaggaagcagtacatgatcgcttggttgaagaattttccagaaagcaccattgnnnnnnnnnnnnnnnnnnnnntagaaaacgtagaaactttcttgttttccctgcaacgagtgggacagaatatttccatttacaacagctattggatttacatatggaaaaaaacctaaagaaagaaacttcaaatgggaagtttggcttaacaaattctaccctatatatgacctcccgaaacaatcacttattcacaatcctggaaaaggatttgaaggggggggttggaaaaaatcgtttaaaaggggggccttttt

SEQ ID NO: 20213 - DNA, 1010 bp, Diabrotica virgifera
  misc_feature (162)..(185): n is a, c, g, or t
  misc_feature (198)..(215): n is a, c, g, or t
  misc_feature (249)..(271): n is a, c, g, or t
  misc_feature (497)..(517): n is a, c, g, or t
  misc_feature (596)..(615): n is a, c, g, or t
  misc_feature (680)..(728): n is a, c, g, or t
  misc_feature (861)..(861): n is a, c, g, or t
  misc_feature (874)..(874): n is a, c, g, or t
  misc_feature (941)..(941): n is a, c, g, or t
  misc_feature (946)..(948): n is a, c, g, or t
ctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaattaaccttcttcccctcacattttttaggattaataggaatacctcgacgatattcagattatcctgatgtatttatattatgaaatattgtatcttctattggatcactaatttcttttattggnggtattattcttnaattttttattatttgagaagctttttctttttcacgaaaaagattaagaccttttagaaatacttnctcannntgatgactacattttaaccctccagctgaacacagatattctgaatttgccatattatcatc

SEQ ID NO: 20214 - DNA, 465 bp, Diabrotica virgifera
ggaattcccggggggaccccctctgtcccgtggttgcgtatttctacacatttagttggaaactctccagtctgatgagtatagctaagctgtcgaaaaatttattactagtatgcaagtaggcggtatacgaatagctggactgatggttacaagattgctcgatgagggaactcaggtaggtgttaacactgaagatgatatccattattctgctgggaatgctgctgaaccacagataggaaacgaagcattgacttataataataatatcgaataatggtctagtgtggaatggtgtctgatgtgaccttgtatttccagtcgattgtgaaatacctatgaacagagagactggaagatctgagagccaacgacgaatgagatcggcaaaatatctaaaatgttcacaaaaatctaccaatcttgggtgtttacacgttaatgacaacttgttctatatat

SEQ ID NO: 20215 - DNA, 1010 bp, Diabrotica virgifera
  misc_feature (929)..(952): n is a, c, g, or t
  misc_feature (982)..(1002): n is a, c, g, or t
atttgtttatgtttattcatagagaattaacaaccattgtttactgtatgattgtacaactacaacacaacacaacatgtccgactccgaacccgaagaagtaaatcgatacaaaaaatttaaacactgttccgccataagtgaggatgaacgaaaactactacttcagtgcgtgagcaaatttcaattacataaatattatgaatatacacctgcaattaaagctgaaataaatgagaaatggatacagttctcggagatactcaaagataaaggctatgacagggcaactgaaaaattagggaatcaatacctatctcttaaaaaacaggcaattaggagtatatcaattttttatggtcatagacgtggcgagaaacccacaaaaatagattatctgttcgcatatttatttccgaagtattttgagaaagtcggtttggatatgaatgaattgatggcagatgctaaagtaaatgcaaaggaaatcctagaaagtttagcttctaccgaagatcaagaatgcgctactatattggaggatacagcatccttagaatattcaaacaagctaaaacctcaaatgaatttaaagagatctcattccaataaagccgaaggaccagcaaataagatgaccaaagtccacgaagatgaagctacattagagcctttaataaataacaataattctttaaaggattatataaatgcacttaaagccaaacttctggatatagaaattaagataaaggaaaaagatcatcagcttgaactcaaaaatttagaaatttcacgtttaaacgaccttcatgctaagaacttagaagaaatgaaatttggagtatagtttcaaattgtttgaaaacaaagactagcttttagatgaaaacttcagtatttttttttataatggtttttctactggnnnnnnnnnnnnnnnnnnnnnnnnggggatggattcttctggaaatattttggnnnnnnnnnnnnnnnnnnnnntggttggg

SEQ ID NO: 20216 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 20217 - DNA, 418 bp, Diabrotica virgifera
  misc_feature (36)..(81): n is a, c, g, or t
  misc_feature (85)..(103): n is a, c, g, or t
tttgtccggaagcttaaaaatatgcaagcaaatgannnnnnnnnnnnnnnnnnnnnnnnnnnnnnnnnnnnnnnnnnnnnncctnnnnnnnnnnnnnnnnnnnctgactctaaaagtgaatcagaagatggtaataagaaactagctaacgagcaaatttctgatttagagtacatgaaacaattaataaaaggtgaaactgaaagaaagccaagggagaaaatgaaaaagaaggtcaaagaacagataaagttgtttacaattaagctcagggatttaccatacaacataaaaaagaaagatataaaacagttctttaaaccaatatcctgttatagtgtgaggatccctagaaatatacatggaatagcatttgtaggttttaaaacagagaagctacttaacaaagccttattta

SEQ ID NO: 20218 - DNA, 129 bp, Diabrotica virgifera
gtttctagatatgagatgattcacttgccgaatacgcctatttagaaatttacgtttttaaatttaaacacacaaagtaaaatcatatacctgtaacagattttacataatatcagacgacaagatggg

SEQ ID NO: 20219 - DNA, 552 bp, Diabrotica virgifera
  misc_feature (17)..(35): n is a, c, g, or t
tctgtccggagacgtcnnnnnnnnnnnnnnnnnnncgattagaagaaaatacagattctaattattcaaaatgaacgttactgctttttcactgtgtttgttgctggtgacaatatttgctataaccaacgccaaagatgacaaacagaaggcaggaccttggaaagtttctcaagatgcgataaggtttagaagatcgccaagaccagattgggaagtaaatccaggagctaacggtgatggaaatggtaacaccaatgccggtatagaagtaataaataagggcaaagatcatgacttccaggctggatggagcaaagttgttcatggacccaatagagctaaaccagcatggcacgtaggtggtagcttcagattcccacgatcaccaaagccagaatgggaagtaaatcctggagctaacggtgatggaaatggtaacactaatgctggaatagaagtaagaaataacggcaaagatcatgacttccaggctggatggagcaaagttgttcatgcacccaatagagctaaaatcaacattgccctgta

SEQ ID NO: 20220 - DNA, 691 bp, Diabrotica virgifera
  misc_feature (5)..(23): n is a, c, g, or t
  misc_feature (225)..(247): n is a, c, g, or t
  misc_feature (357)..(379): n is a, c, g, or t
gtcannnnnnnnnnnnnnnnnnnaacatttttagtcaacttaataagccattttatagagctgcaaaaacttagtaacttacaaaagtagttattgttctaattttaatagtttttgaattaaacccggacaagctctagcactaatggtaaacgtcatgttctcgacactttgcttttttgacttgtgacactgtttgagcggaggtgcgacatgcgattttcnnnnnnnnnnnnnnnnnnnnnnncttttgtaaagatagggatataaaatcccgattttatatccctttcaatggatataaaatcgtgactgaacgtctattgaaatacagcggtctatagttgtcttttgacnnnnnnnnnnnnnnnnnnnnnnncagcaatacgctgccgtcccacaaactcctcttcacaccaatcgagttttgaaagaaactgttgaactttggcccgaagtacaggaggagatgacccgctcgctggcaaccatgcgtgtggactatgaccaagttcaaatcaaaacgttggaaaactccaacaatcccctgcttaataagaggcggaaaaagaacgccattacaaccaactagtgcaatttttttacgtttatttattagcattttaatatattacttctgatcttaaattagcttaagggcattttatgcattactttggacgctgcctgc

SEQ ID NO: 20221 - DNA, 132 bp, Diabrotica virgifera
  misc_feature (14)..(14): n is a, c, g, or t
  misc_feature (30)..(30): n is a, c, g, or t
  misc_feature (60)..(60): n is a, c, g, or t
  misc_feature (71)..(88): n is a, c, g, or t
  misc_feature (109)..(109): n is a, c, g, or t
gcaataaagggctngatgggaggaggaggnggggagggaccccttgaagaaagaagaaanggggggggatnnnnnnnnnnnnnnnnnngagggagaaaaaaagaagaangggaaatttctctggaagaggag

SEQ ID NO: 20222 - DNA, 506 bp, Diabrotica virgifera
  misc_feature (12)..(36): n is a, c, g, or t
  misc_feature (63)..(63): n is a, c, g, or t
  misc_feature (65)..(67): n is a, c, g, or t
  misc_feature (73)..(73): n is a, c, g, or t
  misc_feature (79)..(80): n is a, c, g, or t
  misc_feature (82)..(82): n is a, c, g, or t
  misc_feature (84)..(84): n is a, c, g, or t
  misc_feature (86)..(86): n is a, c, g, or t
  misc_feature (92)..(92): n is a, c, g, or t
  misc_feature (104)..(104): n is a, c, g, or t
  misc_feature (113)..(113): n is a, c, g, or t
  misc_feature (119)..(120): n is a, c, g, or t
  misc_feature (123)..(123): n is a, c, g, or t
  misc_feature (132)..(132): n is a, c, g, or t
  misc_feature (134)..(136): n is a, c, g, or t
  misc_feature (140)..(141): n is a, c, g, or t
  misc_feature (144)..(144): n is a, c, g, or t
  misc_feature (148)..(149): n is a, c, g, or t
  misc_feature (153)..(153): n is a, c, g, or t
  misc_feature (158)..(161): n is a, c, g, or t
  misc_feature (166)..(167): n is a, c, g, or t
  misc_feature (183)..(185): n is a, c, g, or t
  misc_feature (187)..(187): n is a, c, g, or t
  misc_feature (189)..(189): n is a, c, g, or t
  misc_feature (191)..(194): n is a, c, g, or t
  misc_feature (196)..(197): n is a, c, g, or t
  misc_feature (215)..(215): n is a, c, g, or t
  misc_feature (227)..(228): n is a, c, g, or t
  misc_feature (230)..(231): n is a, c, g, or t
  misc_feature (236)..(238): n is a, c, g, or t
  misc_feature (242)..(242): n is a, c, g, or t
  misc_feature (257)..(258): n is a, c, g, or t
  misc_feature (261)..(261): n is a, c, g, or t
  misc_feature (264)..(264): n is a, c, g, or t
  misc_feature (266)..(267): n is a, c, g, or t
  misc_feature (269)..(269): n is a, c, g, or t
  misc_feature (271)..(271): n is a, c, g, or t
  misc_feature (275)..(276): n is a, c, g, or t
  misc_feature (279)..(279): n is a, c, g, or t
  misc_feature (281)..(281): n is a, c, g, or t
  misc_feature (283)..(283): n is a, c, g, or t
  misc_feature (285)..(285): n is a, c, g, or t
  misc_feature (297)..(297): n is a, c, g, or t
  misc_feature (299)..(300): n is a, c, g, or t
  misc_feature (306)..(307): n is a, c, g, or t
  misc_feature (312)..(313): n is a, c, g, or t
  misc_feature (318)..(318): n is a, c, g, or t
  misc_feature (320)..(320): n is a, c, g, or t
  misc_feature (323)..(323): n is a, c, g, or t
  misc_feature (325)..(328): n is a, c, g, or t
  misc_feature (336)..(337): n is a, c, g, or t
  misc_feature (339)..(340): n is a, c, g, or t
  misc_feature (344)..(344): n is a, c, g, or t
  misc_feature (353)..(353): n is a, c, g, or t
  misc_feature (364)..(364): n is a, c, g, or t
  misc_feature (369)..(369): n is a, c, g, or t
  misc_feature (379)..(380): n is a, c, g, or t
  misc_feature (421)..(421): n is a, c, g, or t
tccaggggcccnnnnnnnnnnnnnnnnnnnnnnnnngaggatcctttagagcaagacaaaaangnnnggaaancagaanngngncncgaggnggagaagaagcngaaggaggnaagaannccngcgaacacnannnccannccnccanngggngagannnnggagnnaagaagagacgagaannncncncnnnncnngccgaaacacagaaaaanggcgggacaacnnannaacannnacanaggcaggcgcaacgnngangancnncncncggnngcngnananaccagagaccgngnnaacccnnacggnncaacnangcncnnnncggcgcanngnngcanagaaccganacccaggacgncgacncgccaacccnncacagggcgggccccgacaaacacgccgacagcaaaggacncgccaaggccagggaagaagccaacaccgcgcccaccaacccaaggacaccccccgaaacaccaagagaacccactgcctccaac

SEQ ID NO: 20223 - DNA, 394 bp, Diabrotica virgifera
  misc_feature (292)..(312): n is a, c, g, or t
tttgtccgaaaactttggcgttgcggtgtaatatgcatgacgagaaagcaagcgacaagcccgacttgggtctcgaggaactccagagtttaaatgtaaaagaacgcttccaagttttccaacaaactcagtcggagactcaagagatggacagaggacccactcctgtcaatgttaaaaagtcaccctccattttatcgaaactcgcaagattccaagctaagggcatggacgtcggtgtatccgacgaagcattgaatggaatacctatcgaagagtcctcttctgaagnnnnnnnnnnnnnnnnnnnnntgcccgaaggagaggatcccactctgtacagggccaaaagggtgcaaaaggaaaaaccgttccattttactaatctgaatga

SEQ ID NO: 20224 - DNA, 106 bp, Diabrotica virgifera
gcattgtttagaaaagactattaagggttattttttaacaatggtcttagtcttcactcttattaaataacataagttcgttctcgttgcgagacggtattgtgtg

SEQ ID NO: 20225 - DNA, 316 bp, Diabrotica virgifera
  misc_feature (4)..(255): n is a, c, g, or t
  misc_feature (267)..(292): n is a, c, g, or t
cccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaagctccnnnnnnnnnnnnnnnnnnnnnnnnnntctatacagctttatccaattatt

SEQ ID NO: 20226 - DNA, 860 bp, Diabrotica virgifera
  misc_feature (18)..(18): n is a, c, g, or t
  misc_feature (24)..(24): n is a, c, g, or t
  misc_feature (27)..(27): n is a, c, g, or t
  misc_feature (32)..(32): n is a, c, g, or t
  misc_feature (56)..(56): n is a, c, g, or t
  misc_feature (74)..(75): n is a, c, g, or t
  misc_feature (77)..(77): n is a, c, g, or t
  misc_feature (88)..(89): n is a, c, g, or t
  misc_feature (92)..(94): n is a, c, g, or t
  misc_feature (102)..(105): n is a, c, g, or t
  misc_feature (111)..(112): n is a, c, g, or t
  misc_feature (114)..(114): n is a, c, g, or t
  misc_feature (116)..(116): n is a, c, g, or t
  misc_feature (119)..(119): n is a, c, g, or t
  misc_feature (131)..(131): n is a, c, g, or t
  misc_feature (133)..(133): n is a, c, g, or t
  misc_feature (139)..(140): n is a, c, g, or t
  misc_feature (149)..(149): n is a, c, g, or t
  misc_feature (158)..(159): n is a, c, g, or t
  misc_feature (173)..(174): n is a, c, g, or t
  misc_feature (176)..(178): n is a, c, g, or t
  misc_feature (186)..(189): n is a, c, g, or t
  misc_feature (191)..(191): n is a, c, g, or t
  misc_feature (194)..(194): n is a, c, g, or t
  misc_feature (203)..(206): n is a, c, g, or t
  misc_feature (217)..(217): n is a, c, g, or t
  misc_feature (223)..(223): n is a, c, g, or t
  misc_feature (227)..(227): n is a, c, g, or t
  misc_feature (242)..(244): n is a, c, g, or t
  misc_feature (255)..(258): n is a, c, g, or t
  misc_feature (260)..(261): n is a, c, g, or t
  misc_feature (270)..(274): n is a, c, g, or t
  misc_feature (281)..(281): n is a, c, g, or t
  misc_feature (284)..(284): n is a, c, g, or t
  misc_feature (287)..(289): n is a, c, g, or t
  misc_feature (299)..(299): n is a, c, g, or t
  misc_feature (301)..(301): n is a, c, g, or t
  misc_feature (311)..(311): n is a, c, g, or t
  misc_feature (313)..(313): n is a, c, g, or t
  misc_feature (318)..(318): n is a, c, g, or t
  misc_feature (326)..(326): n is a, c, g, or t
  misc_feature (328)..(328): n is a, c, g, or t
  misc_feature (333)..(333): n is a, c, g, or t
  misc_feature (335)..(336): n is a, c, g, or t
  misc_feature (342)..(342): n is a, c, g, or t
  misc_feature (344)..(344): n is a, c, g, or t
  misc_feature (354)..(354): n is a, c, g, or t
  misc_feature (356)..(356): n is a, c, g, or t
  misc_feature (361)..(362): n is a, c, g, or t
  misc_feature (369)..(369): n is a, c, g, or t
  misc_feature (379)..(379): n is a, c, g, or t
  misc_feature (385)..(385): n is a, c, g, or t
  misc_feature (387)..(387): n is a, c, g, or t
  misc_feature (394)..(413): n is a, c, g, or t
  misc_feature (422)..(424): n is a, c, g, or t
  misc_feature (426)..(426): n is a, c, g, or t
  misc_feature (429)..(429): n is a, c, g, or t
  misc_feature (431)..(431): n is a, c, g, or t
  misc_feature (436)..(437): n is a, c, g, or t
  misc_feature (442)..(443): n is a, c, g, or t
  misc_feature (447)..(449): n is a, c, g, or t
  misc_feature (454)..(454): n is a, c, g, or t
  misc_feature (459)..(460): n is a, c, g, or t
  misc_feature (462)..(462): n is a, c, g, or t
  misc_feature (465)..(465): n is a, c, g, or t
  misc_feature (471)..(471): n is a, c, g, or t
  misc_feature (475)..(477): n is a, c, g, or t
  misc_feature (482)..(482): n is a, c, g, or t
  misc_feature (491)..(491): n is a, c, g, or t
  misc_feature (494)..(495): n is a, c, g, or t
  misc_feature (497)..(497): n is a, c, g, or t
  misc_feature (501)..(502): n is a, c, g, or t
  misc_feature (507)..(508): n is a, c, g, or t
  misc_feature (522)..(524): n is a, c, g, or t
  misc_feature (528)..(528): n is a, c, g, or t
  misc_feature (532)..(533): n is a, c, g, or t
  misc_feature (538)..(539): n is a, c, g, or t
  misc_feature (546)..(547): n is a, c, g, or t
  misc_feature (549)..(550): n is a, c, g, or t
  misc_feature (557)..(558): n is a, c, g, or t
  misc_feature (562)..(563): n is a, c, g, or t
  misc_feature (571)..(571): n is a, c, g, or t
  misc_feature (591)..(592): n is a, c, g, or t
  misc_feature (601)..(602): n is a, c, g, or t
  misc_feature (608)..(608): n is a, c, g, or t
  misc_feature (623)..(623): n is a, c, g, or t
  misc_feature (677)..(706): n is a, c, g, or t
catagaagtcaaaagaantggcgnaanaaggnaaggggacaacccttcaaaaggancacacagaagaaaaaccnnanaacagggaagnnagnnngaaagcgnnnncccgannancnaanacgcaaagacanangagaanncacaccggngagaaaccnnaccaaagggagaanngnnngcggcagnnnncngangcaagcagnnnnaaacaacacangagaanccanaaaggagaaaggccnnncaaaagcaaannnngnncaaaagaannnnnacgaggnagncgnnnaaagaggcanangcgacggcangngagcnagacaccnangaaanannagggangnaaagaagcanangcaannacacggnggagggcaanaaaagnangcaagcnnnnnnnnnnnnnnnnnnnnagggccgannncncanancgagnncaacnncagnnnaaccngaacnncnagngaacgncagnnnaaagncaaaaccgnccnncnaaanncacgnncaaccgaaggcagnnnaacnacgnnaagcnngaacccnncnngaacggnnaaanncggccggncaaaacaaacagaacccagnncagaagaanncacggnttacgcaagcggggnaatattgcaacttatgatgagacgcatattaagcataacgataaacgataacannnnnnnnnnnnnnnnnnnnnnnnnnnnnngttattaaaatgactggtttactattaatacttaaattttaactgaattccagaaacagccttaaaaaaaatcataacaaaatggggatgggttttaccgttctccctctattgggctttttctcaaaagttgtaaaatttaaccgaaaatgag

SEQ ID NO: 20227 - DNA, 213 bp, Diabrotica virgifera
  misc_feature (28)..(29): n is a, c, g, or t
  misc_feature (32)..(32): n is a, c, g, or t
  misc_feature (53)..(53): n is a, c, g, or t
  misc_feature (59)..(59): n is a, c, g, or t
  misc_feature (74)..(74): n is a, c, g, or t
  misc_feature (77)..(77): n is a, c, g, or t
  misc_feature (81)..(81): n is a, c, g, or t
  misc_feature (89)..(89): n is a, c, g, or t
  misc_feature (95)..(95): n is a, c, g, or t
  misc_feature (105)..(105): n is a, c, g, or t
  misc_feature (113)..(113): n is a, c, g, or t
  misc_feature (115)..(115): n is a, c, g, or t
  misc_feature (117)..(117): n is a, c, g, or t
  misc_feature (119)..(119): n is a, c, g, or t
  misc_feature (127)..(127): n is a, c, g, or t
  misc_feature (129)..(129): n is a, c, g, or t
  misc_feature (136)..(136): n is a, c, g, or t
  misc_feature (143)..(143): n is a, c, g, or t
  misc_feature (146)..(146): n is a, c, g, or t
  misc_feature (149)..(149): n is a, c, g, or t
  misc_feature (152)..(152): n is a, c, g, or t
  misc_feature (179)..(179): n is a, c, g, or t
  misc_feature (188)..(189): n is a, c, g, or t
cttaaggggctagcgaagaagaagggannagngcgcgtggccctcttagcacncagcgnagcacgaccaacacnccnaggnagaaccgnaagagncacagaaganggaacggnancncnccccgacncnagagganaccaacncgnaanccncaagagagggaccgagcccagacaagncgaggccgnncccagaagcccaaacacaagaacc

SEQ ID NO: 20228 - DNA, 647 bp, Diabrotica virgifera
  misc_feature (483)..(508): n is a, c, g, or t
attcttgacttatggtctttagtgtgattaacgcctttgaccgtattgtccgacttgcactccgtggacttcttgaacaaggagctgaagtaatacttgtctgccatcccttccttgctgtcgactacatgaaatacttgatcgaatttggctctccccacggacgctacaatggatgagtcactaccgctgattctaactgcattgatgatggcaaacgcatatatccatagctgaaccaagagacccatctgctattccatgagaacacgctgcggactattgtgaaggataatctaccggagagtgccccagaattgcaaaggaccaaaaccatcttgccggtgcggctcccagaggcatcatctcccctccatctgctgatgctccgatgtatgtatgccgagtgatcttggatgcctactatccacctgatccagaactctctaacgcttcttgcactcccaactgccttgctccacnnnnnnnnnnnnnnnnnnnnnnnnnngaaatacgggaagagatgatgagcaccgtacctgtcacgaccgccacattgaaaactgtcgacggactctctgaaaaattgcggcgcgacgtatgtgacgtcgtaccaaccatcatcccagcttcgactggtgccgcca

SEQ ID NO: 20229 - DNA, 947 bp, Diabrotica virgifera
  misc_feature (524)..(544): n is a, c, g, or t
tatagggaaagcggaatttataatttattgtacctaattatcatcctataaaaatttactacaaatatttgaaggtgttttcatcgaaaaaacaatataaacattttaaattttggtagtaaattgttcaataaatattataaatcaacatgttcaatttttggtcaaaacctgatccaaaagatgaacagagagaagtggataggtcattaagaaaagtaggaagggatattgaaagagatcgcagacaattagaaagagatgagcaaaaattggaactagaaattaagaaattagcaaagagtggagatgcggcaggttgtagaatattagcaaaacagttagtgcagcttcgtaaacagaaacaacgaacatatacagctggcagtaaagtacaaggaatagcgttccagaacaaagctatgggagctaatgttaaattggcaaatgcgatgggcacagcaggaaagacgatgtcagatatgaacaaaattatgaatcctgaagaattatcatctactctnnnnnnnnnnnnnnnnnnnnntatgaaaatggagatgacagatgaaatggtgaatgatactttagatgacatgctaacagaatcaggagatgaagaggaaagtgataacattgttacccaagtattagatgagattggcattgaagtcagtggaaagatggcaggggcaccgttaccagagactggcaagataggacaaggttccaaaatctaaaggaatgagcgatgaggacattgaggctcaactggctaagctaagaggttaaaagccacattttctgactgtatattatccgaatccgggcttattgtaaatgaaattactttcaatggtggaaatcttgttattttttaatagaaaatgcacagagcataattttaatcgttgaataactttccttgtaaaaaattggtaaattttttg

SEQ ID NO: 20230 - DNA, 487 bp, Diabrotica virgifera
  misc_feature (103)..(127): n is a, c, g, or t
  misc_feature (361)..(384): n is a, c, g, or t
ccaaaagcagatttcgaatttgcaaaccaatatagatttcaataggcttcccgatgtggcaccggctattgatattctcggaaaactaaatttaaacttgttnnnnnnnnnnnnnnnnnnnnnnnnnagtaaactggacaatatagaacggcacatcactagcagtttgaaccaaacgcttaaacaggcgctcaaaaaggtcgaagaagcaggtagaactgtccaagccaatctaaataaagtcctcaacactatatcggacctacagaaccagataaacagtgtgaatggtaccttggaagatggatacacgtacctagcgtactattcaccgtatcggtactacgctggtctaggcatnnnnnnnnnnnnnnnnnnnnnnnncatttgtatagtattgggtttgatatgcggtatatgcggtaaacgaccagatgggtacagcgataattgctgtaacaaaggtgctggaagacagatttttgat

SEQ ID NO: 20231 - DNA, 391 bp, Diabrotica virgifera
cttaagggggatgaggttgatgatgctctttcaggggttccctttatgaatgtcttatatttagaactgtttaagttatgatatgtggaatttgaatatgattgataagaacgctccagactcgcaaaaagatactgattataacgtataaaatgatagttcgaatgaacatctctgaaaagagaaagaatctttatactattatgtcgaaatggaaaataggagtacctaacacgcatatgaaaaatattgcgcatatgcatcatgaggaatttacaggggggcattgtgaagatttataagacttatcaccgtatcgccgacttatatcattgtggctggtatgcctcaatgcctataaaaaggtacatatataaatgtatggcatgtg

SEQ ID NO: 20232 - DNA, 281 bp, Diabrotica virgifera
  misc_feature (11)..(248): n is a, c, g, or t
cctttgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgctattcgtttttaatcatatctaactt

SEQ ID NO: 20233 - DNA, 262 bp, Diabrotica virgifera
tcctcgtccgaggttttacttggaatttgtccctctgtcgatttgtggggttgtttttaataaagtggttttcacccgcgggaaggggtggtgttcaccaccagggtggaggtgcgggtggtaccggatcagttttgtttcttgaggtgtgctctggctagtcaccagttttcatgaaaatcgccggaggtttgaaaaaatgcgaagcgcaagccttatatgattgaactgcctttaccattaaatcccttatatgctgctt

SEQ ID NO: 20234 - DNA, 148 bp, Diabrotica virgifera
  misc_feature (22)..(23): n is a, c, g, or t
  misc_feature (27)..(31): n is a, c, g, or t
  misc_feature (34)..(35): n is a, c, g, or t
ccccaccactaagggggggaanncggnnnnnaannaggaacccggcaccctttacggcaaaaaggcgggcccccgcaagagaggacggcgggggaaccccaaaggaccaggagacggcgcccttccctctgagaagagctttcttaat

SEQ ID NO: 20235 - DNA, 305 bp, Diabrotica virgifera
  misc_feature (47)..(61): n is a, c, g, or t
  misc_feature (64)..(96): n is a, c, g, or t
  misc_feature (106)..(158): n is a, c, g, or t
tatttcgcgtccggcgcggtctgttaacagccgattacaagtacttnnnnnnnnnnnnnnnagnnnnnnnnnnnnnnnnnnnnnnnnnnnnnnnnncgctgatccnnnnnnnnnnnnnnnnnnnnnnnnnnnnnnnnnnnnnnnnnnnnnnnnnnnnnaaagatgggtagttccgatcgaacgagtaaagatgcttttgcaagcaccacacagtttccgagccaatcgctgaggatcagccttacaagggtatggtagactgactcccacctatcctaaaggaacaccctgttcctgtataccgg

SEQ ID NO: 20236 - DNA, 655 bp, Diabrotica virgifera
  misc_feature (44)..(559): n is a, c, g, or t
gcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaaactggaagcttgctaacttcccacaatgccttgcggcatgcgaagtaaagtctaaccatcaccctcaatacaacgcaatcacggataaat

SEQ ID NO: 20237 - DNA, 596 bp, Diabrotica virgifera
  misc_feature (108)..(122): n is a, c, g, or t
aaattaagacaaagctacgaaaacgatctgcaggccatggcaccccagaccatgatgttcccggggttgcatccgatggcgatgatggccacagcaggtaaaaacaannnnnnnnnnnnnnntggttcaagaggactttattcaggtcaagctccttaccccggtatgtaccccgcagggtcccaatctggtggcgatacccaagaaacaacctacttgtatatccctaacaacgctgtaggcgctatcattggtactaagggatcacacattagaaatatcattcggttttccggagcgtccgtcaaaatagcacctattgatgaaaccaaaccacaagaaacacagaacgagaggagggtgaccattgtcggatcaccagaagcacagtggaaagctcaatattttgatttttgaaaagatgagggaagaaggtttcgtcgctggatccgacgatgtacgattaaactgttgaaattatggtacccaagttctcaagttggggcgaattattggtaaaggtggtcagaaatgtaaagggaactgcaaacgtggttaccggtagcgtttatcaaacttaccccgaacaaaggggc

SEQ ID NO: 20238 - DNA, 776 bp, Diabrotica virgifera
ctcgctggtgcgatgtcgggagtacgctctggaatccactaagaattgaagtaatcatctacagagccaacgaagcagtctccgttacaaactatcatgatgatagtcatatctcgagaaatatatcaagaggaacaatttaatatgcattttaactagggacaaggacaaagaatctaacatgaccattaatatgaccgaatacaaatctccttccatatggcagtcttgaagagagagaagatacgtaaggacattcatgctctttctgatattcttccacacctactgcctaccatacagcctcagagttgctatcgtagctatgactcaatataacaatgacacattggcagatgcaacgactattgtgactccaaatgttgactgagataccgaaagacaggcctatctcttgagttccttcttgtatgcctatatatatactcatataattgcaccatatatgggaatctagatcggaagaaagattgtatttgctgtaggactcgctgtggcatccattttgaccattcttacgccagtacctgcatatataaatgcatgtatcctggtatgtgtcctgatattggaaggattattggagggagtatattataccgtgtattctaccgagtaggaaaaactgtgctccaaagttagaacggagtatattactaacaatatccatatctgtaacctatataggcacagatatatgttcacctatgtcagcacaactgtctacacatcttgcttgcgagagcatatgctac

SEQ ID NO: 20239 - DNA, 996 bp, Diabrotica virgifera
  misc_feature (36)..(57): n is a, c, g, or t
  misc_feature (213)..(237): n is a, c, g, or t
gtagtatttacagtacttgaaataatttcaatgtannnnnnnnnnnnnnnnnnnnnntttacttagtacctgttaaaacttatattccggtgaagttgctttaatttcgtttaaaccaaactaaatccaaatttgttgacagcaaaacgttaggttttcaaattttaccagtgattttccaaatatatcctaacttctgttcaaaatcgtatnnnnnnnnnnnnnnnnnnnnnnnnntgcttaaaatatatacaacataatgtaaatccgtgtgtcttaaagctaagatatacataacttttgatgggggttaggaagacagcatttagagtctattattattaaatttgttttgtttatagcttttatctgcaactgttcattccataaaaggtattatttgtgttggttcggtatattttatgtttgtttgttatattggtggtctacactcactagatctggttcaacaaaagcagcagtaccaaaaatcgttagtcaaacgctcctataacctcacataacctctttgtttccttaaactcaaattttgttacattgttgtagtgtaataaatgtgtaaggtttatttatgatgatctttttagaccaaatatgatctaattatgatcagttcttgtgagtagagacctctatacttctgtacagtgtcgtccaaagagatgaatatatttatcgaagtaaaatttattacacactagtttacgtcctgttgaaaagttccttcatgaatattattgtattgttggcagtctgtacttcaatgtaatattacacatagtgtataatgtgttttatattgtatttaaattcgggaaaattggctaaattttggtttttggacatattaatgttaatacatgaaacaaaaatcaaattatatacatttgttataaacatattaacgatgtgatcgctgcaataagttcctttttggcataatataattgcaaaaattacccttaatcttcaaaa

SEQ ID NO: 20240 - DNA, 574 bp, Diabrotica virgifera
cagaatatacttgttttttatatatctttatccataaatttacaaaaagcaccaatgcatcacatttctcatttaacaataaaaattacaactttgactctgtcagccaatggaatgattgtggttttctatcagcagttgtatcgataataacatttattattgtaggtccgtcaataacatttagggcttccttaacggctgcgtgcagttctggaattgtgttaacgaaaaatcctgttcttccaaaaagactcatcatattgtcataacgcgttacactggttaaacatcctggaggtgaaactttggcgatttcttctactccaacactatctcttatttcatttaatacagtggcttccattccagaataaatgccaaaattgttaactatcacaataataacaggaagtatatatctaaccatagtttccatttccataccagaaaaaccaaaacccgactctccttctacacaaataactctcttaatatggatgacttacgtttaccattaaaatgcagcaccaatggtaaaatccggtaccacacccctatagttcaaaactaa

SEQ ID NO: 20241 - DNA, 342 bp, Diabrotica virgifera
aaatagcatgcttgtacattaaacaggtttattgaaattacatagttcctatcctgttatatcgggttctataaaagaattcacccgattattaagttgaacatacctgactgtacgaagtacgtgaagacaatactagactgttgagacccagcccgactagactaacagacaaatgctgacagccaatagccccctcactgatgaggagctgcagaatcaccacgagctaacatattttaccataaacgaacgcctgcatgttcttccgatagagcaaagctgtgaccccatagaaagtaacacacaataacaaagacgaactaccccatggaaaagatt

SEQ ID NO: 20242 - DNA, 417 bp, Diabrotica virgifera
  misc_feature (378)..(395): n is a, c, g, or t
ggacccctgaactgaccaagataggaatcgaaagtgaaccctttataaaaacaaactgaactctttcatcaagataactactcaaccatgaaagaaaccactcaggaaaaccaacacattttaatttaaagatgagtaaaaaatggatcaccgtgtcaaaggccttcgagaaatcagtataaatggagtccacttggtacccatcttcgaaagccctgacaatgtaatcatgatataaaacaagatttgtagacgtagatttaccctgcctaaatccatgttgctcattaatcaagagattgctacagcgggaagtaagatatttgtttaaaattaattccaaagaggtgtggggattgaagataaaataacaggtcnnnnnnnnnnnnnnnnnntcctctgccaccgtttttaaat

SEQ ID NO: 20243 - DNA, 982 bp, Diabrotica virgifera
  misc_feature (419)..(442): n is a, c, g, or t
  misc_feature (502)..(530): n is a, c, g, or t
  misc_feature (567)..(582): n is a, c, g, or t
  misc_feature (585)..(599): n is a, c, g, or t
  misc_feature (621)..(647): n is a, c, g, or t
  misc_feature (669)..(704): n is a, c, g, or t
  misc_feature (733)..(750): n is a, c, g, or t
  misc_feature (783)..(801): n is a, c, g, or t
  misc_feature (806)..(845): n is a, c, g, or t
  misc_feature (876)..(917): n is a, c, g, or t
  misc_feature (959)..(979): n is a, c, g, or t
agttaaaaggtttgtttattatacaccatttcatggatgatacatacataaaacaaattatgttaaagacatacaaacttaaaaaaactaaacgttaaagccggcgcataaactaaatttttaaaatgagtacaataaatggaacggacatgacaccaagtgattttttgctttagcttaacactaaaactaagaaatactacaaactattatttcttgtgttaccacatagttaaaaccttcaacatgtgatgaaatatggaatatgcctaaaagatagttaccctctgaacaataaaatttttgtttattagtttcaaaaataatataaacatgtttattagatgtacccttaaattttccgacgattatatttaatatagcatgaagagaatgacataaagatagatatataggcnnnnnnnnnnnnnnnnnnnnnnnntcaacttgggatgaaatatgcctaaaaaatagttaccctctgaacaataaaattttctgnnnnnnnnnnnnnnnnnnnnnnnnnnnnnggtttataaaatggtaccccctaaaattttcccaccnnnnnnnnnnnnnnnngcnnnnnnnnnnnnnnntataaagataaatatatagggnnnnnnnnnnnnnnnnnnnnnnnnnnntcatcttccgtaagttttggcnnnnnnnnnnnnnnnnnnnnnnnnnnnnnnnnnnnngaaaatgattaaaattttgggggacgttnnnnnnnnnnnnnnnnnncctggcaatggcccaaaaccaggacctgattannnnnnnnnnnnnnnnnnnacctnnnnnnnnnnnnnnnnnnnnnnnnnnnnnnnnnnnnnnnngcgctttttcccattttttgaccacaccccnnnnnnnnnnnnnnnnnnnnnnnnnnnnnnnnnnnnnnnnnncccaacatctctcttaactttttgctccttacaacttttcannnnnnnnnnnnnnnnnnnnntct

SEQ ID NO: 20244 - DNA, 457 bp, Diabrotica virgifera
  misc_feature (32)..(61): n is a, c, g, or t
attacaatataaatttttcgatgtacctaccnnnnnnnnnnnnnnnnnnnnnnnnnnnnnnctacttggtggattgtactatttttatttgatggtaaataaaaaattcagatatggtataggtatgaacctggttccttgaaacatatatttctgtatgttaaattagtaaaataaataggggtatttattcccactcagaagagatacaaattcatgttccactatcaaaaaaagggactgtatataaatgaattcgaagagggaaataaatacataatgtactggaccctatattttttctatgtccataaaaatgtcttatgtcaacataaatttgcctcattctgatttttatggcccctacgaactttgtcacattttctacctcgcattaaaaggtcatataaaccccttatgtttcaaacccccccacattctagatttacccgacaaa

SEQ ID NO: 20245 - DNA, 850 bp, Diabrotica virgifera
ctttgtttagcttcttccctgctgcctggtgaagataagttgtcattttctgtattttgggagatgacccaagacggggatattgtaaatacaagatttacaagaagcgtagttaattcttgtgctaagttggcttatgagcatgctcaatcagttatagaaaaccctgataaggagtttagtaccaaggactttccccaaatttacaatggatttgaacctaaagatctggtgaatattgttaatattttgcaaggtttagctgtaaaattaggggagaaacggatacaaaatggtgccttacgaattgataaagtaaaactatcgttttcacttgatcctgtatcaggcgaacccgtaagttattccatatatgaaaacaaggaatcgcatcgtttgatagaagaatttatgcttttggcgaatatatcggtagcacaaaagatctatgatgattttccagaagtagcgttcttgcggtgccatgaaccgcccaaagttaccatgttaactgctcttcaagacaaattggccatgtacggaatgcatttggacatatcctcttctggagccatagctacgtcagtcaagaagtatatgactgacgattttataggtaaagctagagcggtagccctcaatcactttacatcaaaagcaatgatacgagcgcagtatttctgtgcgagttttaaaactggcgctgaagaattcaaacattacgctctcagtattcctatatacactcacttcacctctcctattagaagatatgcagatattatggtccatcgactggtggcagccagtttaggttacaccaatccaccgaaaatgggacgcacagtac

SEQ ID NO: 20246 - DNA, 54 bp, Diabrotica virgifera
cgcctgcaggcaccggcccggaacccccggggccccccaagggggcgggtgcaa

SEQ ID NO: 20247 - DNA, 250 bp, Diabrotica virgifera
  misc_feature (9)..(41): n is a, c, g, or t
  misc_feature (51)..(102): n is a, c, g, or t
  misc_feature (130)..(187): n is a, c, g, or t
cttttgagnnnnnnnnnnnnnnnnnnnnnnnnnnnnnnnnncgctgatccnnnnnnnnnnnnnnnnnnnnnnnnnnnnnnnnnnnnnnnnnnnnnnnnnnnnaaaacatgtgtagctccaatcgaacgtnnnnnnnnnnnnnnnnnnnnnnnnnnnnnnnnnnnnnnnnnnnnnnnnnnnnnnnnnnacaagggtatgggagactgcttcgtaccgccatccccaaatgaacagcgtggatattgcatca

SEQ ID NO: 20248 - DNA, 337 bp, Diabrotica virgifera
  misc_feature (64)..(77): n is a, c, g, or t
  misc_feature (80)..(102): n is a, c, g, or t
  misc_feature (111)..(130): n is a, c, g, or t
  misc_feature (174)..(201): n is a, c, g, or t
  misc_feature (212)..(272): n is a, c, g, or t
  misc_feature (276)..(330): n is a, c, g, or t
taacagcgtaattttattggagagttcacatcgataataaagattgcgacctcgatgttggatnnnnnnnnnnnnnnggnnnnnnnnnnnnnnnnnnnnnnntgttcgacnnnnnnnnnnnnnnnnnnnntctggaggttaaaccggtgtggaggccaggttggtttctattcnnnnnnnnnnnnnnnnnnnnnnnnnnnncaaaaggaccnnnnnnnnnnnnnnnnnnnnnnnnnnnnnnnnnnnnnnnnnnnnnnnnnnnnnnnnnnnnnaccnnnnnnnnnnnnnnnnnnnnnnnnnnnnnnnnnnnnnnnnnnnnnnnnnnnnnnngccctaa

SEQ ID NO: 20249 - DNA, 926 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(399): n is a, c, g, or t
  misc_feature (408)..(422): n is a, c, g, or t
  misc_feature (424)..(440): n is a, c, g, or t
  misc_feature (443)..(461): n is a, c, g, or t
  misc_feature (476)..(496): n is a, c, g, or t
  misc_feature (585)..(617): n is a, c, g, or t
  misc_feature (637)..(656): n is a, c, g, or t
  misc_feature (694)..(708): n is a, c, g, or t
  misc_feature (710)..(779): n is a, c, g, or t
  misc_feature (781)..(794): n is a, c, g, or t
  misc_feature (812)..(834): n is a, c, g, or t
  misc_feature (836)..(861): n is a, c, g, or t
  misc_feature (872)..(920): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatnnnnnnnnnnnnnnnnnnnnnnnnnnnnnnnnnccgaattcctttattaaacnnnnnnnnnnnnnnnnnnnnatacaatttttttaatactaatattatcattcattacnnnnnnnnnnnnnnncnnnnnnnnnnnnnnnnnnnnnnnnnnnnnnnnnnnnnnnnnnnnnnnnnnnnnnnnnnnnnnnnnnnnnncnnnnnnnnnnnnnnggaaattttttactcccnnnnnnnnnnnnnnnnnnnnnnncnnnnnnnnnnnnnnnnnnnnnnnnnngttcccccctnnnnnnnnnnnnnnnnnnnnnnnnnnnnnnnnnnnnnnnnnnnnnnnnnggggac

SEQ ID NO: 20250 - DNA, 686 bp, Diabrotica virgifera
ctaaaatgaacagcaaaaccattgtatttaattctcagtcagccatcacggccatgtcttaaaggtcaatgagttcatcttgtaaagttaattcatagtgtcagttaatattcattaaatattaactgacattctgtcaacgtgtatcaatcctggtgtgttgtggtggatgattttttaaagtttggaaacagaaagaaatctcccagtgccaaatctggagaatacgttggatggggcagtaagtcctagcccaattcaaccaaatgttttctgggcctacaatgaatcattagaacaatggtttaatttatttctgtcatttggatttctttgctactcctccttgtggatgtcaaaaaggtttgatctaaaacaaaagatgctgcccctagaaagtaaacgtatttcttgtgtgtaagcaacatacacaacacttcaaatctcatgattttaaaatgatttaatattaactgttcttttcgttccaggttgatgcagctgtcaaccatgtcatgtttcaactgctgttgtggttaacaatattatgtaacgtttgtttatgtattaaaaaacttgtgcaaaatatgttgttttaatttcctatagaagacaatcttttagtattacataaactcgaaacataacaaaaatcactaaaaattcccgaatttttttattttata

SEQ ID NO: 20251 - DNA, 209 bp, Diabrotica virgifera
  misc_feature (48)..(118): n is a, c, g, or t
  misc_feature (149)..(188): n is a, c, g, or t
gggggaacccgcggggcccgggaatccccgggccgccccccccgcccnnnnnnnnnnnnnnnnnnnnnnnnnnnnnnnnnnnnnnnnnnnnnnnnnnnnnnnnnnnnnnnnnnnnnnngtagtgaggaggtaatgaggatgggagaagnnnnnnnnnnnnnnnnnnnnnnnnnnnnnnnnnnnnnnnngcccgtggggaagcagggaag

SEQ ID NO: 20252 - DNA, 582 bp, Diabrotica virgifera
  misc_feature (268)..(286): n is a, c, g, or t
  misc_feature (447)..(471): n is a, c, g, or t
cttttccaaaactgtctcaacattcaaacttccctttccccattccaaattgccaagccaatcagaaacatttctctttccacattcctcttcgaaaaaccaggcattctttcaaacaatacttctactcatcctaatcactttccggaaattatacaaatactcttgtgcttaaaacaaacagacttacaattccaaatctctctacctttatttttctaaaaactaataattacagctacctgtggattttaccttcccgcaacannnnnnnnnnnnnnnnnnnaatccgaaataaattgtcatttcacttcactgtatttacaaatgtctttaagtcttctgggaaaaactcaattaaagagaaacacactgtgtaaaagcttaaccttctactaaatagttacaaatcaatatacagggcgaatcctaaatatgtgcccgcgnnnnnnnnnnnnnnnnnnnnnnnnnctcaccccaacttttgactgcaaaaacggatacataatctctttgaagaatcctccagggacaaactccctcaacctaataaaacaaaaaaaggcctaaaaccaacaaaaa

SEQ ID NO: 20253 - DNA, 627 bp, Diabrotica virgifera
ggttaattttagaaaacgaaccagtatcagatgatgtggatatggaagcactagcgtcatctaccgacggtttttcaggctccgatttaagagaaatgtgcagaaacgcctctgtgtatagagtcagagactacttgcggaaccatatcgatactcccattcctgcgtcttcccaaaaagatgacgaagaggaagaagtgtttcacgacactctccgtcccatatcgatggaagatctgaagttatccttcaacaaaatgagaggcagtaaactacagtgcggttcgttacagatacagactagaatcgatctcgattaaaagtgatagaaaataaatgttagtgctgagtacctattaagagaagacattctacttgaaacttgttgaaatttatattaagtattaggcgtagatattatttttgtttttctatgtaaaaaatacatctacaaagtcaaagttcttttatgaccactgtatatatgtttgatataccaaatgtaaacaggtgcatgcgacttaaaccttaaatgttatttatgtagagtagcacacattggaaaattgtttaaaacacgttaaatacagttttctgccctccgaaataaaataaaaagaacaatct

SEQ ID NO: 20254 - DNA, 763 bp, Diabrotica virgifera
  misc_feature (722)..(739): n is a, c, g, or t
gtactgtgtatagaattgaataacctttcaaatgagctgccacacgacccctattctcatttggaaaaatggtcgattacgtcatcacgcccagatgaatgacgtcactagtacgatgtatatgtcgggaaatcataatgtgagagtcgaataacttttgtattttgcatttttttctaattctgtaaatggggcagtttgcaggggggtcgaggtatagtgaataaccctgtacattcattggggctgaccgactgtaataacttttatttgtattcggtttggagtgtgtgtactgattttcggccttagtagatggatttaattgccttcgtaggagggcaactttgatgccctctcagtggcccctgttctgcgtttcgcttgaccgaccgaagtatgtttctctacacaatcactggagacagctttgaaaggtgtagatttggtggattcaaggagatttttttagcgctgcctctccgtctataacaaaacggcgaacaatcgccatgttttactaattacctcactggatactaataaaaaacaatttgacagggtgcctgggatcagtcacccgaatttattaattaagagtttttactggccaaaaataatgggcctttgacactaaattcacatttttatatatacaaacaactcaccacccagctaagggttatcagtaacttcttcacctcgtataagaacaagttgcnnnnnnnnnnnnnnnnnncttcattttaacacggcacttttt

SEQ ID NO: 20255 - DNA, 830 bp, Diabrotica virgifera
  misc_feature (234)..(252): n is a, c, g, or t
  misc_feature (584)..(614): n is a, c, g, or t
gttactgcccataagtcctttcaacaaacgacagagtttctacagcaacaacccttttccgagtaaaacagtggaagtttataataataattatcaatttcaaatacaaattttttagttttagttaaaaattaatgcaatgtttttgtatatatcgaaaaattgtaaattatagactgaaatttattgagtcgctttgttctaaaataatccgaatacgtatctaatagtaannnnnnnnnnnnnnnnnnngcctaactccaagttaagtgagagatattataagtatagtattttatacatatctaaacgagtcaacaaggaccttcttatctttataaaagagctgcttgctcaatgagtgcttccatatagtgaaatgacagtaatccgagagtgccaggtctgtggagtaaggtggatgagttccagtgatctatctgttttcgatttttttaacatctttagtgttcacgatatggaacaacttattggtggcccttcttcttcttaacgtgccctatcaagtccccttgacgttggcgattaacatggcgaaactgtctctgtctcgagctattctnnnnnnnnnnnnnnnnnnnnnnnnnnnnnnncactcccggatattcttcaaccaagaggcctgctttctaccaattcctctgcgtccttcgattttacccatcataataagttgaagaatattataccggtctccccttactacgtgtccaaaataggccatctttctatatttgatgttatcaagcagctcgcgggtagcatttgctctcttaaggactgccacatttgtcagcatagccgtccat

SEQ ID NO: 20256 - DNA, 386 bp, Diabrotica virgifera
  misc_feature (2)..(126): n is a, c, g, or t
  misc_feature (139)..(209): n is a, c, g, or t
  misc_feature (217)..(279): n is a, c, g, or t
  misc_feature (284)..(312): n is a, c, g, or t
  misc_feature (351)..(370): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaccctatannnnnnnnnnnnnnnnnnnnnnnnnnnnnnnnnnnnnnnnnnnnnnnnnnnnnnnnnnnnnnnnnnnnnnngggggggnnnnnnnnnnnnnnnnnnnnnnnnnnnnnnnnnnnnnnnnnnnnnnnnnnnnnnnnnnnnnnncccannnnnnnnnnnnnnnnnnnnnnnnnnnnntcaggggaaaacccgcggtattttttttggggaagttcnnnnnnnnnnnnnnnnnnnnggccccccccgggggg

SEQ ID NO: 20257 - DNA, 226 bp, Diabrotica virgifera
gcaaacttacatatttataatgtatattatttatttattctcattcacaaaaatcttctcagacccactaaaacgtcactaattgtttaaactgtgactcatgaaattctgtctagaaatggtaaattaaagctcaaatgcctttgaatatgccaaaatctccctattacgaatccgaaaatacatatcgtttacaccgccatagatgaaaactactaaagagtga

SEQ ID NO: 20258 - DNA, 959 bp, Diabrotica virgifera
  misc_feature (92)..(119): n is a, c, g, or t
  misc_feature (779)..(813): n is a, c, g, or t
  misc_feature (851)..(876): n is a, c, g, or t
  misc_feature (892)..(933): n is a, c, g, or t
gaaaagggggtcttgtctgtttaatcaatcctcgatttggcgccttgttttgtgttttggcggtttttaactccaagcacatattttcttannnnnnnnnnnnnnnnnnnnnnnnnnnncatacatacaaaatttcatttttatatttcaatttttcagttgtttgaaaaaaatctgttcgttagaacacattatttgattaaccaagattttgtttagcaagaaacaatggattcgatctaccaatctactacttcaacgagccttcaatcgacttaaactagccatcaatcgacttcaacaagttctgaatttgtctcaggagctcaggatttgtcaagaacctgccatctttgcagcaaaatatttaaaactgtgaaaatacgaaatcatcatatcaaaagcatacataaaatagatgtgtcagttaagaaaattaatcatattgtttgtccgttatgtgagcaagaaactaatttacaaacccatgaaaatttacgaaaacatctcaaggagaaccaccagttgagtattgaactaataactttggaaatttttcaacaaacaaaaatatgagacttggaaagaaaagcaaaaaattgagacccgttctgctttgactaaagtatgtaataaaaaggaaactaataatcttattactatgaggggtaaaaaaagggacataacgtgggaataacccccacttataaaaattaagaacaaaaaaatctgggtggatcaattaaaaaataaaaggagttttgtcccctcccaagacnnnnnnnnnnnnnnnnnnnnnnnnnnnnnnnnnnnttttcctccccaattttttggaaaaaccattggttggnnnnnnnnnnnnnnnnnnnnnnnnnncccctcctttttgttnnnnnnnnnnnnnnnnnnnnnnnnnnnnnnnnnnnnnnnnnnccggctgggggggcgccccccttatt

SEQ ID NO: 20259 - DNA, 296 bp, Diabrotica virgifera
  misc_feature (180)..(214): n is a, c, g, or t
  misc_feature (228)..(274): n is a, c, g, or t
tgtgtttgagtgaaaatggttgtatgtgtgaaatattttatgtttgttttgggatgtgtgtttgaatttatggataagtataatggggtttgtatgaggttggaagtgttttggtgtactgttatgtgtaagatttgttgtggtttgttttttgcgttttattgagtacggtgtatatgnnnnnnnnnnnnnnnnnnnnnnnnnnnnnnnnnnncgctgtttttgttnnnnnnnnnnnnnnnnnnnnnnnnnnnnnnnnnnnnnnnnnnnnnnngggcgagggggtgttttttttt

SEQ ID NO: 20260 - DNA, 699 bp, Diabrotica virgifera
  misc_feature (263)..(282): n is a, c, g, or t
  misc_feature (453)..(470): n is a, c, g, or t
aaaatccgaatagctatgatgattgccgacctccgtcgcagagatggcacttaaagtaaaagaagatgatacctataggttgattcagagggctatggaatgaagaatgccgaatattaagctcagcgatcacaaagccaatggagaaataagaagacgatcgaaagtaacagatgtgagccaaaagattgccatattaaaatgaaactgggcaagatgcatagtaagaatggaatatattgcccaataaaaaggaaagcttnnnnnnnnnnnnnnnnnnnntgttttgtaataaattccaggacacatgacagaggctcgaaacaaatgactgtgaatgaaaagccctattcataatccctccgctactgatcggtcataaaaaataacactatctgtaataaacaaaaatgtaatatgccaacaagttgaatttgagggtaatacgatatnnnnnnnnnnnnnnnnnntaagtaacatgaatatttcctaataatatgtttttgtaaagccataactttgattattaatttcgtatagccgcttatttagtctaccaaaagttatcagaatttaatgacaaagacaacgcacttttcactcggggtgttgactatggtaatatttttaattatcataataaattgtacttaggtaccatccgtattcatttcagatacgtccacctccccaacaaaa

SEQ ID NO: 20261 - DNA, 886 bp, Diabrotica virgifera
  misc_feature (865)..(885): n is a, c, g, or t
atcacatatgtaatttggccgataaatttataataacatttatagattggaatgataactcatgaaatccggatggtactccacaacaaggctcttcgacatcatatcataacaggttcggttttgggggaaaatgtaaaatatgcatattggtaagaaaagacctacaagtaaattttttaaagtcgatcgtgtgagcgacttttgccagcttaagggtgctgcatttgtcactgatactgtttcggttggtctgcttggtattggcgttatagtttgcactgatatcaccataagtcccatatagcgtttccctggagttgccagaaatttgccttgcataaaataagcctcgtatccacatactattaggcgatgcacaagttccaatgtaaggagttcaaatgccattggtactgtaccatccgaattttccaaatttttgtggaacaactcaagaccataatagccagtgtcaataatgtcaaaactttccaataggagaaatgtcagtgctactttcaacaacaaaaggagcaagaagtccatcaactctgctgctgctctcttccaaaggggaggtataatgaattcatagataggtgggggttgattattttgtgcaggttgtcgagctgcttgaaacaatggttgttggtaattgccatttggtgtaaaaccaactctttgccttaaaacatttggctgattttgaggttgaagattagcaaaaggatttacaaactgttgaaaagaatttttctctgacatagcccagattgtaggaaaatcctgcacatacattgtaatgccataatcttgcttcatctagccacttctttagtttctcaatgtattcttctcnnnnnnnnnnnnnnnnnnnnnc

SEQ ID NO: 20262 - DNA, 218 bp, Diabrotica virgifera; identical to SEQ ID NO: 7300
  misc_feature (6)..(28): n is a, c, g, or t

SEQ ID NO: 20263 - DNA, 749 bp, Diabrotica virgifera
  misc_feature (181)..(197): n is a, c, g, or t
  misc_feature (624)..(645): n is a, c, g, or t
  misc_feature (722)..(740): n is a, c, g, or t
tacacacgcatatcaaagaaaatttattataggatttaatacagaaataaaagataaaatggttgtgttgaaagttaaaaacaacaaaactttgaaagatgaacaagaaaagacgtggccgcaaatttatgctattttaataagtactatggtgggcataaccaacgggcaattcttcgcnnnnnnnnnnnnnnnnntggttcaaatagtcaacgacaaggagaaatacaacatctcagaacaagaggcatcatattttaatacaatcaatccaatttttaccctcgttatctgccccttctgtgccatgcttaccgatggtctcggccgcaagaagacacttctcttgaccgctgtaccgcaggttgccagttggttgtgtgctgcatttgcaaaggatgtttatatgttctacgtatcaagagcttttgcaggaattgcagatggactattcttttcagctctacctccttatgtcggagaaataacaacgcctgctgtaagagataagtggggtaatctgcttgcaggttcttactacataggagagtttttgattaacgttattggtagttactttggagttgtattaacatcttacatatgtctaccaatacctattannnnnnnnnnnnnnnnnnnnnnggtacccgaaactccttattattactttaatccaggaacaaagaaaaagaagcaagaaagtccttactatattttannnnnnnnnnnnnnnnnnnaacaaaatt

SEQ ID NO: 20264 - DNA, 1180 bp, Diabrotica virgifera
  misc_feature (844)..(863): n is a, c, g, or t
  misc_feature (892)..(909): n is a, c, g, or t
  misc_feature (1098)..(1127): n is a, c, g, or t
  misc_feature (1135)..(1157): n is a, c, g, or t
gcatttttaagactaaactagatgaacaaattgacataaacatcccattgaaaacagaaagtgacatctacgcagcagtagaaaatcttcagaaatctatacaagaagctgcttggtatgctacctctgactgctaccaaacagaatttaaagagaattgcccaactgtaataaaggaaatgattgctagaaagagaaaaataaaggaggagtggcgaagaaaaagaacacctgagaacaagacgaaattaaataaaatcaccaaggaaattaaactacaattgcataatatcaaaaataacaaaatacaagaatatcttacaggtttatcagcaaacgcagatagtgaatattccctttggaaggccacgagaaaaatcaaacacccgaaacaacaaatactaccaatacgaaaccatagggaaactggtgtagaaataataaggaaaaagccgaagcatttgcaaatcacctcactaatgtattccagccacatcccatggaagatggtgacacagaggaagaaataaatgacttcctggaatcgccctaccagatggacttacctatacaaaaaatcaccaccaaagaagttagaaatatgatccagcatgaaatcagtccaaaaaagctccagggtatgacctggatcaacgggaaagtactgcagcaattgacatgcaaaggtctgaaaatgataacgcaagtatttaatgcaatatttaggctaggttactacccagaaacaatggaaagttgctccaattattctcatacctaagccagggaaaaataaaaactcaggggaatttcatacggaccaataagcctgctacctgttcannnnnnnnnnnnnnnnnnnncttcctccttaaaacaattatcccccagnnnnnnnnnnnnnnnnnnctaattcccccaacaccaattttggtttcaaaacacaacacggaaagaaaaaaacagggccataaaacgggtaaaacacctcaaaaagggatctaaaaaaataaaagggatttggttctgggggctttccctggaaacttgtggcagggcccctccaaaaaggggatgggccgtggctggggtagggcnnnnnnnnnnnnnnnnnnnnnnnnnnnnnnttcccctnnnnnnnnnnnnnnnnnnnnnnncccaaaaaaagattatatttttt

SEQ ID NO: 20265 - DNA, 526 bp, Diabrotica virgifera
  misc_feature (502)..(522): n is a, c, g, or t
caaaaggtaagaaaatagtgatactaacgcacatggacaagctaattgtcatagacaatgaagggaccaactttgctctttccctctacaactgataacgaaatggaacaagcgatgatgatagcttgctacacttgctcatgaccctacgccttaatacctccttagccacacaatacgaaaaagtcgtagaaaccatcaagaataaccatgaaaaaattgaaactagatggattccttcacgtcttcattcaaaaaaacaaatacaaataacaatgcaacttccaccatttcctcggatgttgcaaaacggacaataaaaaagaaaacggcaaaatgatgcttgctgaactgtcccagcactcctcctttctctaggagagaggtgatctgacgcacaaacactaacaattttgtaaccgattgtatggtaccacattatgatgatggcttcatcccttacaagccattcctcacaaaactgatggagataccatgcatnnnnnnnnnnnnnnnnnnnnncacc

SEQ ID NO: 20266 - DNA, 161 bp, Diabrotica virgifera
tgcggcagcacgatcccggggtttttcgcatccaggcccagcgccgcgcgtaggcggtggggtttcgggtgcagtttcttcaagtcactggcggccttgttggtgccgataaacgcaaagatatcgatcttgccgctggccatcagcgcgctgacggtctc

SEQ ID NO: 20267 - DNA, 364 bp, Diabrotica virgifera
  misc_feature (64)..(77): n is a, c, g, or t
  misc_feature (80)..(102): n is a, c, g, or t
  misc_feature (110)..(132): n is a, c, g, or t
  misc_feature (167)..(194): n is a, c, g, or t
  misc_feature (201)..(249): n is a, c, g, or t
  misc_feature (256)..(275): n is a, c, g, or t
  misc_feature (282)..(334): n is a, c, g, or t
taacagcgtaattttattggagatttcaaatcgataataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatnnnnnnnnnnnnnnnnnnnnnnnnnnnnaaaaggnnnnnnnnnnnnnnnnnnnnnnnnnnnnnnnnnnnnnnnnnnnnnnnnnaaccccnnnnnnnnnnnnnnnnnnnntacaacnnnnnnnnnnnnnnnnnnnnnnnnnnnnnnnnnnnnnnnnnnnnnnnnnnnnncaccatttataagaaccagaaattaagact

SEQ ID NO: 20268 - DNA, 432 bp, Diabrotica virgifera
cgggaattcccggggtcgactctctgcgcccgagtgaatgagttttaattcgtttctggggagggattagattgtggactctgtgattgggtcaggttatttgttgacaattatcttcttggaaacgctgtcgattttgtattgatgggttgtgcttcgacccataattttggttaaccacctgtaaggatttggctgtctaggaagattctattttggcaaccatggatttagtgcatttggtagcggcgggaagagatcatttggctgcggaggaaatcgcccattttgtgttgaggtggaaatagcccatttggtaccagtggaaatagacccttcgggggcaacgccactgggccatttggcgataatcccgagctatatcaccttatgatgccggggtgatctttctttcatctgatccctcactta

SEQ ID NO: 20269 - DNA, 766 bp, Diabrotica virgifera
  misc_feature (85)..(112): n is a, c, g, or t
  misc_feature (595)..(619): n is a, c, g, or t
  misc_feature (621)..(634): n is a, c, g, or t
ctacacagggccataaaaatataatcaacaataaattggtactcaaaagtggtgtaatgatattgagaggataggatggtgtagnnnnnnnnnnnnnnnnnnnnnnnnnnnnctttaaaaatttctggaaacgatgtattatttcaatacatttgtagtgtcaagtctttacttcttaacgttgtaacagtagtgctgctggatcacgcatcttacgtgtcaccgattcgtacgcacgcactcccaccttacttcccactaccatcgacaagtgttaagggatggttcaccggcaatgatataaaaacagcttagccacaatccactttagctgaactctccttctgttgtggcgaagctccttttatatcgttccggtaatttattaccagcgcgcgtcgaatggaagtggtagttagtgggagcgcgtatatacgcaacactggcgactcggatgtgcgagccagaggcgctatccttacaacttttactagatattcacaaaaaaatattctccagatgtttctctgttgtaacgacgttgtgatatacttatatttggagtattatttaatttcctacttaaattacctcnnnnnnnnnnnnnnnnnnnnnnnnncnnnnnnnnnnnnnnactttacatgttttgttttgttttgagttttgtcttccaaattgtcaatcaattgcttatcatggactaattatatattgtaagacttttgataagtttcacctttatatccttttacgaagcaatacttga

SEQ ID NO: 20270 - DNA, 762 bp, Diabrotica virgifera
aatggtaatgctgacgccgcacaatctaatgacaacggagcagctgcagaaaataatactaatgctgatgctcaaaacgacgccgcacaaggtactgccaatgaagccaacgcagaaaataatgccaatgcagatgcccaaaatgatgctgcacaagctaatgaaaatggagctgctgcagaaaatagcggtaatgctgatgctgcccaaggtaccgacaatggagccgctgcagaaaacactggtaatgctgaccctgcacaaggtaacgaaaatggagctgccgctgaaaacaatgcccaaacagatgcccaaactgatgctgcacaagggaacggcaatgaggcagctgcaggtaacaatggtagtgctgacgcggcccaaggtaatgacaacggagcagctgcagaaaataatgctaacgcagatgcccaaaccgatgccgcacaaggtagcgccaatgaagccaacgcagaaaacaatgctaatgcagacgctcaaaatgatgctgcccaagctaatgaaaatggagctgccgcagaaaacaacggtaatgccgatgctgcccaaggtaccgacaatgaagctgctgcagaaaacagtggcaacgagaatggaacaggcgcggaaaataatgctaatgcagatgcccaaaccgacgccgcacaaggcagcaccaatgaagccaacgcagaaaataatgccaatgcagatgtccaaaatgatgctgcacaagctaatgaaaatggaactgctgcagaa

SEQ ID NO: 20271 - DNA, 1090 bp, Diabrotica virgifera
  misc_feature (856)..(868): n is a, c, g, or t
  misc_feature (871)..(893): n is a, c, g, or t
  misc_feature (958)..(989): n is a, c, g, or t
ccagtcatgtcctttatttggtccgaccatcgtaatggagatgttcctctggatattttgccctctacattgcctttgactatcattcgtgctatttcttttaatgaattcttatcagtcacttctgaacctcgtttttgttgagcacagaatggttctgggacaccaaggttcctttcgagctttgttttgccaacaaatctgctcatttaattttatacaccccttaatgaccagtgaccaggcacataatatcttaaagacattttattatattttcgaggttgttaaagagctctttgcagttccttgtcagtttggatttaaggagtgggttctttcttcttcttcatgtgtcttgtccgttgtcgacgttggctatcatcatagcaatttttattttgtttgcggtgttttaaataactcgattgatgttagtccaaaaaattggcgtaatttttaaaaccacgagtgtcttcttcttccgggtccacgtttgctctttattttaccctgtattatcagttgcagcgtccgatatttatcatgtctcataatatgaccgagatatttaagtatccgtttcttaatattgaaagagatttctttgtgttttccaactcggcgcaatacctctacgttggtgatgtcggtcgtccaggatattttgataatacttcggtacacccacatttcgactgggctcttaactgacagaatagccgcttggctatctgtataaatgttgattctttttgctttggggctttcatccatgaatttattcatgcaggccaccaaaattacaataaaggctgttataagtggttagcaagtagttaaaaattacctaccnnnnnnnnnnnnnggnnnnnnnnnnnnnnnnnnnnnnngattaaatgattttcccaattcaaaccaaaacccagttaacttactttatggttataagggggcnnnnnnnnnnnnnnnnnnnnnnnnnnnnnnnngtattttgtttggagataaaacttaatttaaacgaattttaaagggggttccgctggaatttaacacctaaaaatatgtccaggggaagtttttccggttt

SEQ ID NO: 20272 - DNA, 869 bp, Diabrotica virgifera
attaaaaagtgtccttactttgaaagttttatatacgctgtctgtaaaggtaggaattggaaaacttagtcggatatttaagaacctcaaaataccccaattcctgagaagcaaactgttcaaccagtgcatccttcctatcataacatatggatgtcaaacctggagcctaatcaaggcaaatataaataaactagccacaacagaaatattaatggaaagagcaatgataggtatacgactgtcggataaaagaggaacaactggataagaccaaaaaaagaggcgaggacatacttaacaacaaaaattgcgaaactaaaatggagctcagcaggccacactgctaaataagaagaccaacgttggaacgcattagagaccatacgaaagtaaacgaccaagaggaagaccacatatgagatgaattgatgatataaaaggaataggcggaacaaattggaaatatgttgctcaggttagagaccgatggaaggagttgagagacgcctatatcaaaacagggacgataaaagggaatagaagaagtctgtaaaggcgttatggaaatcttacatggaaaaaattataaggattatttcttattcataggagattctgaccaatagaaagctacagaaataaaaattaaactgattatttcattcataggagattctgaccaatagaaaactacataaatctaaattaaatcgataatttttgataattgcccgtcgtcaagtatattacgtcagatgcccttcgttgctacgaaaaaatacattcagtgacattaatgacaattaatgttttaaaaattataaacgtgatgactttcaaccgtgaaatatttatacataacaact

SEQ ID NO: 20273 - DNA, 744 bp, Diabrotica virgifera
  misc_feature (594)..(608): n is a, c, g, or t
aattacttatgaggaactacaacctgtgataataagtattgaagatgcaattaggcatcaatcattctttgaaacggtcaccttactggagaagggagacattgataatgtttttaggcgagcgccacatactcttgaaggagaatgtaggatgggaggccaggaacacttttactttgagacgcaaagttgcattgctattcctaaacctgaagacgacgaattggagattttttcatcaactcagaatcctacggaagtagcaagactagtcagtgaagttttggacattccccagcacaaaatagtaagcagagtaaagcggttaggaggtggatttggaggaaaagaatctaaagccgctatgttggcgctaccgatagcagttgcagctaaaaagtttaacagaccgataaggtgcatgttggatagagatgaagacattgtgatgactggtgcaagacacccgttctattataaatataaagtagcctttgacgaaagtggtaaaatgttaggtctcaatgcagaactttatgcaaattctgggtattcaaatgatctttcattctcggtaatggctagggccgtgannnnnnnnnnnnnnncttaccacatacccacttgtaaagtcaagggcactctatgtaaaacaaacctttctttcaatacagcctttcgaggatttggagccccccaaggaatgtacatggttgagggttattggtccacaaattgctgatt

SEQ ID NO: 20274 - DNA, 521 bp, Diabrotica virgifera; identical to SEQ ID NO: 7280
  misc_feature (23)..(322): n is a, c, g, or t
  misc_feature (329)..(366): n is a, c, g, or t
  misc_feature (386)..(399): n is a, c, g, or t
  misc_feature (402)..(424): n is a, c, g, or t
  misc_feature (432)..(454): n is a, c, g, or t
  misc_feature (484)..(515): n is a, c, g, or t

SEQ ID NO: 20275 - DNA, 822 bp, Diabrotica virgifera
  misc_feature (4)..(393): n is a, c, g, or t
  misc_feature (395)..(539): n is a, c, g, or t
  misc_feature (546)..(563): n is a, c, g, or t
  misc_feature (726)..(745): n is a, c, g, or t
  misc_feature (764)..(781): n is a, c, g, or t
  misc_feature (793)..(816): n is a, c, g, or t
cacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatagnnnnnnnnnnnnnnnnnncgccacatttttttcccccgtttattaaaaacatgcctttttgattaaatataaagtctccgccctgccccctgattaatttgcatgcccgccggaatttgacccgggcctaaggaaccacaatccttacgttttttaattgaaagctggaaaagaaagggtnnnnnnnnnnnnnnnnnnnnccttcctctaatttccacnnnnnnnnnnnnnnnnnncgaaaaaccccnnnnnnnnnnnnnnnnnnnnnnnnaacccc

SEQ ID NO: 20276 - DNA, 708 bp, Diabrotica virgifera
tgacgatatctctaaattgggaagaattatgcaatggaacaattcccattacctacctttttggggcacgtcacaatccattaacaacgacacctgtcaattagtagaaggtggagactcgactatgtacccgcctcatgctaccaaagacaaaggttttgtaatattttcaactgatatatgtaggagagtggaagtttcttacagtagcacaggaacatacaaggatatagaaggataccgttatgagccaaaatcagatacgttctattcgaaattagcaaacgttgaggaagattgcttttgtacagggagaactctcaatcccaacggtgtacgtgactgctatctgaatggagttatagatgtatacgactgttttggtgctcctctgctattatcctttccccatttcctccacgctgatgagtcatacattaatggagtacaaggagtgacttcgccagataccgaaaaacatggcatctattttattgattgagccaaatacttggcactccccttacaaggaaggaagagggtccaacttaacgtggtgttaaaaaaaatcgaataaatacagtttactccaaaattaaaagcctacaggtggtggcctgtgaatattggattgaaagagtggtggctgaactttgaacaaaacgcacctttataaaacatttctaaaacaacccaatttttttcaaa

SEQ ID NO: 20277 - DNA, 722 bp, Diabrotica virgifera
tgtttatagtgttgggatttgtgtcagaagttcaaagtcatgaaaggtgaactagagaaatcaccatcaagttcacccactaccaagaagggtacgttgaacgatggtctgttgatagtacctaacaacgtgagaagcatggccaaaatggtgacagagcatagaagaacaggttcgacaggtacaacaggggacgaatcctacaccacggatgacgaagacgatgtagacgaaccagacataacaatcaaagaccacgtcacccgtaacctcttcaacgaccatgcccccggtaccttcggttgtttttcggacatttccaccatcactgataaagtcagacatttgggtgtgatgcacagaaacagctcagacagttccgtgtatagtgaaaaatactctgaagagttaggtttagacagtgacaaaaaccatgacagtgataacaggagtgcggctagtagtagtagttggactaacggcgtgaccgagacgaaagaacaatgttttttgcggttgcagagtgaactcatggaagctaaccaggtgttaaagctgcgggaccaggagttgagcaggctgagcaggatacggcaagacgtagaatccgaggttggaaggatctgacctgcttagtttatttcaagaagcgcaacaccgaggtttcgaagaagcaaatcacaaaacaaaagcaggctgctaaaaaggggttaagggaaagt

SEQ ID NO: 20278 - DNA, 875 bp, Diabrotica virgifera
  misc_feature (750)..(751): n is a, c, g, or t
aacatctgtcatgtcaatttgtggtgagtccgtattaacagccactactgaggtgaaaaccctaacgtcaccaggatatgatacaggccattatccatcttacattaaatgcagctacgccatatccacgggaactgtatatgacaaaatcgtccttcacttcgacgagtttgatattaccgatgagatagttgtaactgaagaaaccagggactgtattggagactatattcaaatttacgaagatccaaatcttggcgttaacactggtttgggttcaaatgtcgtgtataatggcgctaatacacatacaaatctgatgtacactgatgttaagggacggcatctattctgtggaaaagacgaaaaacctttcgattactatacatccggacggtccgttactgtatcactggttagcaaagataaaacaccaaaaggaaaaggtttcaagttagaatattcacgagcagggtgtaacagaaattacactgaacctcaaggaagaataactaacggaaatagtaaagtagactgtaaattctcgattatagtagcagaaaacagtacaatctcagtatacttctattcattttacatgtatttaacggcaaattgtacggatagtgcaatggaggtcagagatggttcaccaacaggaaaagtattattgaaagcatgcggttaccgtttacctgatccgatattttctacaacaaataaactctattttaccgcatttaatcatannataaatggacttttactaagatatgatatgctctatgttagtaccgacgatgaccctggatgtggaggttccattttcacaaacaaagaaagatctacagtccctaatatccaaacctttatag

SEQ ID NO: 20279 - DNA, 863 bp, Diabrotica virgifera
  misc_feature (514)..(538): n is a, c, g, or t
attcatttttttcgaatccggagaggactaataggtatttttgaggaatttaaaggcagagtgaaagattacattattgccgactcccgaaagtccctgaaaacttctataatgtttattttaataaggtacacgggtgaaaataaaagagaaaatttagtgtgatttgtatttgcaaatatttcattcaaaagaaactttttatttattctaagggcctttcggccctcggtaatggggtagtcttccattctgcgtttgggtttttcagaaatactgattggttttctcaggattcgaggggaattaatacatttggaacatattgaaaattttgacaggcgtcaaagtgttgaattttgcgccttttcccttaatcttaacgtattgccaaatactattgactgtaatacatccaactcccacagaaatgtgcaagcacgttgccactagcgccactgttggcttgagttgaactaagttttgacaacgtaaaatttgacgtaaacattcnnnnnnnnnnnnnnnnnnnnnnnnntaacaaactaagtttgctaaattgaattaaaataaaaatagttcaaacacttatacaaaaacaataataaagcaattttataaatgtaaggttagattgctctggttatcctactcataccgctaggtggcgctatttttttgcttcctcaaaattaatgggaaatgtcaagagttgtatgtattacagtctatagtatttggtattgcttatttgttatgctactttatttaacatacttctcgaaaagttcatcttttaaataaatcaattttaaaaaagttgtatacatacttaataacagaggtatacagtatattctggg

SEQ ID NO: 20280 - DNA, 1142 bp, Diabrotica virgifera
  misc_feature (36)..(54): n is a, c, g, or t
  misc_feature (100)..(168): n is a, c, g, or t
  misc_feature (183)..(228): n is a, c, g, or t
  misc_feature (253)..(329): n is a, c, g, or t
  misc_feature (336)..(371): n is a, c, g, or t
  misc_feature (374)..(393): n is a, c, g, or t
  misc_feature (439)..(465): n is a, c, g, or t
  misc_feature (483)..(507): n is a, c, g, or t
  misc_feature (510)..(536): n is a, c, g, or t
  misc_feature (549)..(582): n is a, c, g, or t
  misc_feature (650)..(671): n is a, c, g, or t
  misc_feature (690)..(724): n is a, c, g, or t
  misc_feature (754)..(796): n is a, c, g, or t
  misc_feature (853)..(870): n is a, c, g, or t
  misc_feature (961)..(993): n is a, c, g, or t
  misc_feature (1056)..(1076): n is a, c, g, or t
ccccccaaaacccacgtgtttttttttaaagggggnnnnnnnnnnnnnnnnnnnaacaaccccccgcccacaaaagaaaaaaaccaccggggaggggggnnnnnnnnnnnnnnnnnnnnnnnnnnnnnnnnnnnnnnnnnnnnnnnnnnnnnnnnnnnnnnnnnnnnnagacccgggggaggnnnnnnnnnnnnnnnnnnnnnnnnnnnnnnnnnnnnnnnnnnnnnncaccaacttattaaaaaaaccccgnnnnnnnnnnnnnnnnnnnnnnnnnnnnnnnnnnnnnnnnnnnnnnnnnnnnnnnnnnnnnnnnnnnnnnnnnnnnngcggtannnnnnnnnnnnnnnnnnnnnnnnnnnnnnnnnnnncgnnnnnnnnnnnnnnnnnnnnccctttcggtggaggaacgccatattgtgaggggcgaggaggagannnnnnnnnnnnnnnnnnnnnnnnnnngggaaggaagacccctcnnnnnnnnnnnnnnnnnnnnnnnnngcnnnnnnnnnnnnnnnnnnnnnnnnnnngggggggcccccnnnnnnnnnnnnnnnnnnnnnnnnnnnnnnnnnnatagggaaaggggggggggcgggcgcccccccccctcataaaagagacacccacccccatttattccnnnnnnnnnnnnnnnnnnnnnnggcgggggggcgcgcgcannnnnnnnnnnnnnnnnnnnnnnnnnnnnnnnnnngaatctctgggtgccggagcccgcccagcnnnnnnnnnnnnnnnnnnnnnnnnnnnnnnnnnnnnnnnnnnnctccccacccaacaacacattataaaactaaagcaccgctcagccaccgccccccannnnnnnnnnnnnnnnnnaaaagaaggaaccacccccaccacaccaccaccaaaaacaaaaagaatatcaaccctcgacacccacgccccccggcgcgagacgccgcgnnnnnnnnnnnnnnnnnnnnnnnnnnnnnnnnngacccccagccaacaaaacaaaaacaaccaagaaagccagccaggggcggcgccccgccgcgnnnnnnnnnnnnnnnnnnnnnaacacaccccacaccccaccccacacacacaacaaacaacagacagcacaccgagccctagttcct

SEQ ID NO: 20281 - DNA, 818 bp, Diabrotica virgifera
  misc_feature (65)..(89): n is a, c, g, or t
  misc_feature (373)..(390): n is a, c, g, or t
  misc_feature (588)..(588): n is a, c, g, or t
  misc_feature (619)..(619): n is a, c, g, or t
  misc_feature (666)..(666): n is a, c, g, or t
gaatattgagttaagatattgtacaatagtttacagcccattcacgggaactagcctgatttagnnnnnnnnnnnnnnnnnnnnnnnnnctattattgaggtagcaatgaaccccaaaaacacagtattcgacgccaaacgactgattggcagaaaatttgatgaccccaaaattcaagcagacatgaaacattggacttttaatgtagtcaatgactgtggtaaacccaaaatccaagttgagtacaagggggaagtcaaaacattcgcaccagaggaagttagctcaatggttctcaccaaaatgaaggaaattgctgaaacatacctagggggaaaagtaacagatgccgtcgtcacagtaccagcgtannnnnnnnnnnnnnnnnnacaagccacaaaagacgcaggtgccatagctggacttaacgtattaagaataatcaacgaaccaacagctgctgccttagcttatggtctagacaaaaacctcaaaggcgaaaagaatgttcttatttttgatcttggaggtggcaccttcgacgtctctatcttggctattgatgaaggatctctctttgaagttanatccactgccggagatacgcatttaggtggngaggactttgataacagattagttaaccactttgttgaagaatttanaagaaaacacaagaaagacttaagtaataatactcgagctctaagacgtttaagaacagcttgcgagagggctaagagaacactttcgtccagtactgaagctagcattgaaattgatgctctacacgaaggagtagacttttactctaaag

SEQ ID NO: 20282 - DNA, 206 bp, Diabrotica virgifera
gcgccttttgcgcccgaagtgtggcgcttttctgaccaggggagcctttccacgaaacaaggacgtcgtatggaatatcaagtgattaataatctccctgttttacgttattcccattatgtatattaagttcatggaatggatggataatattgttttatggggtgacttttaactagaaacttgaaaaaatgatatgcgcgatg

SEQ ID NO: 20283 - DNA, 145 bp, Diabrotica virgifera
ccccctttgcgtccgcaaagatttgtttcagtccgatgtttgaaaccctttaaatgcataataccgaataaactgtttaatctgcgagccgcggcgggcaaagcaataaagcatggactacttattcccaataatagtggggggg

SEQ ID NO: 20284 - DNA, 941 bp, Diabrotica virgifera
  misc_feature (608)..(628): n is a, c, g, or t
  misc_feature (655)..(680): n is a, c, g, or t
  misc_feature (838)..(856): n is a, c, g, or t
gtttcgtcagtgtgcaatctcatatgatatagcgaggaatacgaataatataaaatgtaatcctcattacattcagttgtggtttaatcccatgtactgtttacgatagtagacattcattgcctttgaccatatcggctgcaattgcagaaaaaaataccgggaagaaataattgcgtaccacgctttataaactcccattacgttcttgtagtatcagtattgaattttatttggaatattgaattctctacattagaaaaaacttgctcaacatgataaaaaattccactttgaatcagctctaatgaaattttttatggaaacttttaacaaatcactactttcatttggtggtttatgtatgtaataattacagttaagtccatggttctttgcccatgcatcattatttaaaacatacgaaataagtcgaaaatttaccccacgcaacagcaaatgacagaaagtagctactgctccgatgacggagcagtagctacttctattataaaatttgacgttatcaaataaataaaatgtaaaatgttagttttgctttaaaatttttgtgcagaattacagctacatttgaagtagcttaattnnnnnnnnnnnnnnnnnnnnngtaaatataataaccaggcataatctnnnnnnnnnnnnnnnnnnnnnnnnnntttgtcatttctttcacttttgcggaaaattaacaaaaacggaaacaaaacccgttccttaaactgtgttaactgaggttaacttttgtaggtgtataattttatggcaaaataaaataaacttatatggaccccataaaaatttcaaacttcaatannnnnnnnnnnnnnnnnnncaaactggtttggtgaattattaattaactttctaaaagaaaacaagcttaacaggacaaaaaaccgaaaaaaaatccaacaaac

SEQ ID NO: 20285 - DNA, 208 bp, Diabrotica virgifera
gcagttaacagtcaactcaaattgtttaaccccttttatcaggcgcacaaatttgaatattttaaccgaatctatttattctcaaattggtatttacatacttaatacccagtggttaagtacgtattgctagatactatcttaaaccagcgacggttactcaaagatccggaattgtattcaaatatgcgccaagtttgcgaattac

SEQ ID NO: 20286 - DNA, 753 bp, Diabrotica virgifera
agctgccaaagaccttagccaagctatagaacacgctgctaatcagaatcaagttgatatgctcaaagcttacatttcatcatttcaaactgggtccctagatgatcacaagttgggttctaggtattggattaaagataaaggacctgctgtagaaagttatattggatttatagaaacttacagggatcccgctggtgtaagaggagaattcgaaggatttgtggcagctgtaaatagagcaatgtcagccaagtttgcaacgttggtcagtaatgctgaacaattcttgacacttcttccttggaataagggattcgaaaaggacaaatttttgaaacctgatttcacatcattggatgttctcactttcgctggcagtggaataccagccggtataaatataccaaattgtaggacttcacgaacttctaggacacggatccggtaaattattaagaaaagaaaaagacggtactttcaacttcccctccaatcttctagaccctcttaccggtaaacctccggcatcatgctacgaaccaggtgacacctatgatagtaaattcggtccgttaagttcgacttatgaaaaatgcagggcagaagccgtaggactctatttaagtctcgatccggatgtactaagaatatttggacacgaaggtcagcaagcggaagaaattacttacgtcaattggctttcccttgtgtgggccggagctggaaggggattggaaaatgtgggagcct

SEQ ID NO: 20287 - DNA, 318 bp, Diabrotica virgifera
cccacgcgtccgaacaccacgagtccgtacgttgagtggagttttctttaagcaactcagttgaatttagaaataaaagacagacttataagataaattgaatcacgagtgggattttattagactatttcacgaacaaagtgataggtcaaaaatttcagtagaatgagaggaaggaatttaataataatacatttgatctaggtaacttaaatctacccattttttgaataattcacaattacttcataatcatcgaaatatttattagtaccatccacctttttgcctgtggaacgaccagacttttacaatgaa

SEQ ID NO: 20288 - DNA, 756 bp, Diabrotica virgifera
  misc_feature (359)..(379): n is a, c, g, or t
  misc_feature (451)..(469): n is a, c, g, or t
  misc_feature (505)..(525): n is a, c, g, or t
  misc_feature (647)..(670): n is a, c, g, or t
gaagccagtaatgattatgaggttccttgtaccaacgattttgacgtttgttgtccagtcgaatgcggaaacaggaaactttctagtaacgacattttgactgcaagacaatttgaggaagaagttttcggactcacaattctgggagaaaacaatgaagctgaatttgcaaaatttccctggatgttaggaattttggaaggaaaaaaatatagatgtggtgcatctttgatacatccacaagttgctgtgaaagctgctcacctgtgtgaggcaagaaggagtttataaaattaaagcaagcgaatggaattggggaataaagttttgagcctcttgccccatccagacccacatgnnnnnnnnnnnnnnnnnnnnnccctcattttcccccaccctcgcctttcggaaggaaataagaatacatcctcctggaaaacccccccctccnnnnnnnnnnnnnnnnnnnggaactaaaaactggttaaccttttccaggggggcnnnnnnnnnnnnnnnnnnnnngggtcttggtttttgggttgggggggaaataattccaataatataaaaaagaaccctaccccccctctctttttaaacatagaggaattctcctttggtccccaaaaaacccgagggtggannnnnnnnnnnnnnnnnnnnnnnnggactctttttcttattctttacctccccttcttttttttcccgaagggggaacttggtcaagacacacctctaaaggggaggggg

SEQ ID NO: 20289 - DNA, 176 bp, Diabrotica virgifera
  misc_feature (76)..(97): n is a, c, g, or t
gattgatgtcatttcctataattagttaaataaatgttcacgtaacctctggaattgtaactatattaactttgtnnnnnnnnnnnnnnnnnnnnnnagccccatgcgtcccaatcgttgcctgccatgcatgcaccgcctactccctggacataaccaactgtttctaaggtgag

SEQ ID NO: 20290 - DNA, 385 bp, Diabrotica virgifera
  misc_feature (334)..(355): n is a, c, g, or t
aaaatagccaaagaaagatgcgttgaaaatcccactcaccaggaaattcgtgatgttctggtcgcggctggtttgaaagtgggtgtcgaaaacaaattgtacagcagagagagaagtaaagaaatgttatatcgtggtagaataaggatacagttaaagaacgacgatggaagtttgtgtaatgacagtttccctaccagagacagcattatgtaccatttaggagacatgattcccaaactgaaaagcaggcaaaataaaagctcgaccgaggctcctcagcaagcatctactggttctaaaggcaagggaaaaggaaaaggacgaagataannnnnnnnnnnnnnnnnnnnnngttaatttgtaataaaatatactcctatat

SEQ ID NO: 20291 - DNA, 327 bp, Diabrotica virgifera
  misc_feature (5)..(44): n is a, c, g, or t
ctagnnnnnnnnnnnnnnnnnnnnnnnnnnnnnnnnnnnnnnnntactaaacttttttatttctaacaagaaatcgaacatattatatctttgatactacctacctactatgaagacaattaataatttgtctattcataaaagataatttacagttccagtagtttaaaattcctggggacggtatccacctctcccccaagtccgactaccagtcacaaccacccttctcgcaacatcataacaaggaaatcctttctataatggacacaccttgatacttttaacctatacctcaattcaccacgaccgttgggaaaaatttct

SEQ ID NO: 20292 - DNA, 954 bp, Diabrotica virgifera
  misc_feature (190)..(209): n is a, c, g, or t
  misc_feature (711)..(758): n is a, c, g, or t
  misc_feature (893)..(914): n is a, c, g, or t
  misc_feature (933)..(953): n is a, c, g, or t
gagtgccaggagtacgaattcggaaaatcaagcgaaggatagaaaggaatggaagctaatcccagaacacaccaagactcaccatggcttgttgagctaatgatgatgaagtttttctattatttattcaaaatacaataaacaaggaagcaaaatgaggtatttggaagattaaataacatctcaaacnnnnnnnnnnnnnnnnnnnncttgtttattatttgttctacttcctcttcatgttccttatccgttgcgcatattggttatcatcatagcaatattaattttgtttgcggcgtttctaaataactcgatcaaagttagtccaaaccattggcgtaagttttgaagcctggagagttttcttctttcgggttagcgtttgctctctattttacactgtattattagttgcagtttacaatatttatcatggctcatattatgaccgagatattcaggtatttgtttctaaattgtgaaaaacatatcttttggttttcccggtcagcgcagtacctctacgttggttgtgtgggtcgtccaggatattttgaggatacgtcggtacacctatatttcgaatagctttatttctcggcaatattttgttaccaccttacagatttattcgaatttattactttcatttaaggttttttttaataagagatgggctggcattaacttatatgtttcactatctcnnnnnnnnnnnnnnnnnnnnnnnnnnnnnnnnnnnnnnnnnnnnnnnntggtttggattttttaattaaaattttgtattaataaaggaaaggaaaatttccggaatttaattaccgttcccggaagaacctggagggagcattggaaaatttgtaagtatggccaaaccctttccccccccnnnnnnnnnnnnnnnnnnnnnnggggaccaagtcccctctnnnnnnnnnnnnnnnnnnnnnc

SEQ ID NO: 20293 - DNA, 605 bp, Diabrotica virgifera
  misc_feature (58)..(575): n is a, c, g, or t
gacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccaactggaagctgccaacttccaca

SEQ ID NO: 20294 - DNA, 351 bp, Diabrotica virgifera
  misc_feature (7)..(36): n is a, c, g, or t
  misc_feature (51)..(185): n is a, c, g, or t
  misc_feature (229)..(256): n is a, c, g, or t
  misc_feature (259)..(275): n is a, c, g, or t
  misc_feature (277)..(298): n is a, c, g, or t
  misc_feature (319)..(348): n is a, c, g, or t
cgcccgnnnnnnnnnnnnnnnnnnnnnnnnnnnnnncccccaatattaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggccgcgggattttgaccgcgctaaagtagcataaacaatagnnnnnnnnnnnnnnnnnnnnnnnnnnnncgnnnnnnnnnnnnnnnnncnnnnnnnnnnnnnnnnnnnnnntcttatttttaagctcaaagnnnnnnnnnnnnnnnnnnnnnnnnnnnnnncct

SEQ ID NO: 20295 - DNA, 592 bp, Diabrotica virgifera
  misc_feature (235)..(264): n is a, c, g, or t
tctcttttgaattgttattactgtttttttatgtacataatcgtagaatttattgcttttattagtaattttgtgtaaaattataattttaccatatcttaagttactaccaactatgttctttctttcttttttatttcttcaaatttctttcctcacacacaattttaccatcgaactatgaagatttgtcgaaatttgtcgtgtcgggagatgaataggttataactgctgnnnnnnnnnnnnnnnnnnnnnnnnnnnnnnatgacttattgctcttatttattgatacctatatagatgtataagtgaattaatcatatttattatgtaaataaagcgaaacttctattaaaagtgtcaaaatcgtagtcatgtaagtgtttttctggggtatttatccattgttgcttaaacttactttactggaaatagtcttaactttttgttctcgttctgttctttctcattctcttcaatcttgaaacatcacgcagttggcccaactccaaaactattcttttacgcggttttctttttacatctcttttacatttaaccccatcttttatcccttcccacactctttttt

SEQ ID NO: 20296 - DNA, 631 bp, Diabrotica virgifera
aaaccatcgaacgaaaataatcttataaaaactacaacaacaactaatacaacaatccgaacatcaactccaagggaaatagtcagaaaacctggagaaagatctagtccagaaagacagtctcctcaaaggcaagctagtccaactcgtactcaaactactgtccaaagcagctacaggcttacaagtagcagtgatgtacccacaacaaaacaaattactagaaaaacagaggagctacgaagatttagtccagaaagagtttccttagttgaaactacctcgagaactgaacaagtacgaaaaacatcaacggaaaaaagtactctacataccaaaactacaagcccagaaagaaacgtacctcaaaagaaggaaccaaggtattctagtccagataagaagggccctaaaagtggacactccattctgaagaaaacagaagtgcagcaaaagaaagtggaggaaaagaagcctgagtgggtccccaacaggaatctgaagaaagttacgggttcaaaccgaacaagtaccaactaccagtagcagtaaaaagattggtaaagaaaaaagattgcccaacagaaggccagggaggatcaacctactggatttaattactgctagctac

SEQ ID NO: 20297 - DNA, 674 bp, Diabrotica virgifera
  misc_feature (650)..(673): n is a, c, g, or t
cgtgaacatcttgcttgggaactgcaagttaaaaatttaaataccaagagcatgaatattttggtatttctaactgaaaatgcctttcagaatttgtatggtgtcggattttttctttccaaacatgggtggagtagaagagcacatatacaatctttcccaatgtctcttacaaaaaggtcataaagtaatagtcctaacacacagctatgaggatcgagttggtgttcggtacatgacaagtggtctcaaggtgtattatttaccaattaaagtgttctataaccaatgtgttcttccatcaatggtttcaaatgtaggtcttataaggtacattcttgtaagggagagaattgatataattcatggccattctgcgttttccgctttagcacatgaagctttgttgataggaaatttgatgggtatgaagacagtattcacggatcatagcctgtttggatttgcagatgcaagtgctgtgataactaacaaattcatacacatttcattatcagactgtaatcattgcatttgcgtttcacacactggaaaggagaatacagtattaagagctaaaatggagtcttggaaggtttctgaaattccaaatgctgttgatacctattcctttaaaccaaatggggatnnnnnnnnnnnnnnnnnnnnnnnnc

SEQ ID NO: 20298 - DNA, 224 bp, Diabrotica virgifera
  misc_feature (67)..(79): n is a, c, g, or t
  misc_feature (82)..(121): n is a, c, g, or t
ataagagaaaaaagctgggtacgcgcgtgcaggtaccgggacgcggaattcccaggggccgaccttnnnnnnnnnnnnntcnnnnnnnnnnnnnnnnnnnnnnnnnnnnnnnnnnnnnnnnccaaccccctctaatatttctttaaaagtgaaattttggatcattataagggggatgtttgggaattatgattattcacaggcctatttttaactaatagatg

SEQ ID NO: 20299 - DNA, 250 bp, Diabrotica virgifera
  misc_feature (130)..(147): n is a, c, g, or t
  misc_feature (203)..(232): n is a, c, g, or t
aatacccttaagggataacagcgtaaattttattggagaggtcaaatcgatataaagaattgccgacctcgatggttgaataaaagtttataattggtggtagcagctaattttattaaggcttgttccnnnnnnnnnnnnnnnnnnattggatcttggagttataacccgggggggggggcccgggtggggttttcttttcnnnnnnnnnnnnnnnnnnnnnnnnnnnnnntacccaaaagggccccac

SEQ ID NO: 20300 - DNA, 203 bp, Diabrotica virgifera
  misc_feature (3)..(18): n is a, c, g, or t
agnnnnnnnnnnnnnnnngcaaaaaagaacgcgggataaccacggccaaatgggcagaaaattaaacattcacgcaaatccggggggggtcagttttatttctttacggtggtgtaggggggaggtttacagtcttctctaggttttagttttttaccatccacaagtgggccccttctaaatctagaatttatccgggaaca

SEQ ID NO: 20301 - DNA, 865 bp, Diabrotica virgifera
gggtgatgcaagagagtatttttttaaacaaggatttgaccttactgcaaataaatcagcggtggtgttttttacgcgacatcgcttaccagttatgaacagcatcatgattaacaacctaagtatacccgttcataagcattacacttatcttggtattacattggacaccaagttaacatgggatgaacacattaataagtgcttaataaaatgtgagaaaagtttaaatattcttaaagtagttaaccgctatcgatggggtgctgaccctaaaattaatttaatgttttatcgtgcatataccagatccattctcgactatggaagcattctatatggatctgccacaaacagtcgccttaaaaaactagatcgcattcaatataaggctctgcggttcgttctaggtgcgctcaagtctacgcctatagagaatcttttagctgaatccatggagcctcctttacatttaagacgactatttttggctgaaaaatttattcttaaatgccaatcttacaaccaaactgaactactacaaaaaatatgtgacatctctgtttctaatcttgtcgacaaatggtggcacaacaggaattctcctattttagcagtggcatactcgaacgtttctcagcacctaaacagtccaggtgaattaactttctttaaatcgagttttaatatatcttatgccaatgttaatgtttggttcccaaattttgacagtgagaatccagttgactttcagcaacatatagccaagcttgataatccatgcaggattttcacggatggttcaaaatcaagattgggaagtggatgtgctgtatatattccggatcaacaagaatccttgatg

SEQ ID NO: 20302 - DNA, 528 bp, Diabrotica virgifera
  misc_feature (90)..(130): n is a, c, g, or t
  misc_feature (138)..(160): n is a, c, g, or t
  misc_feature (174)..(231): n is a, c, g, or t
  misc_feature (236)..(292): n is a, c, g, or t
  misc_feature (295)..(323): n is a, c, g, or t
  misc_feature (478)..(523): n is a, c, g, or t
actgattatttgaatgccgcggtatttgaacgtgctaggtagcataatcttaagttttttattggaagctgaaatgagggttggatggannnnnnnnnnnnnnnnnnnnnnnnnnnnnnnnnnnnnnnnngtaaaaannnnnnnnnnnnnnnnnnnnnnngaacccaaaaaggnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnaannnnnnnnnnnnnnnnnnnnnnnnnnnnnttagggaaaaacgggaaattttttgggaagtccaaatcaaaaaaaaagatgggaccccaagggtgaataaaattttaattgggggagcaccttattattaagctgtttcaattttaaatttatctgattttgggttaaacccggggggggccgannnnnnnnnnnnnnnnnnnnnnnnnnnnnnnnnnnnnnnnnnnnnngggcc

SEQ ID NO: 20303 - DNA, 242 bp, Diabrotica virgifera
taaaattttatcttattttcaaattctctcgggtaataaaatccaccaagaaaactatttacattttttgtttaatttatacctctatgtccttttggaccttctcattggtcatctaagagccatactttacctcatcgtgggggtttttcgctcaccgttattcaagaataacttttaaataaatgatagtactgttgacgtcttcctccattatcttccaccgtagaatcactgtgttt

SEQ ID NO: 20304 - protein, 158 aa, Diabrotica virgifera
  misc_feature: Coding regions on vcDNA: vcDNA=SeqID_1; Strand=+; Position=96-569
  misc_feature: Homolog annotation: Hit_ID=AAD38565.1; Match level="QueryCoverage =75%, HitCoverage=28%, E-value=6e-55, Identity=92%"; Hit description =elongation factor-1 alpha [Papaipema sp.]
  misc_feature: Pfam annotation: Pfam_ID=GTP_EFTU; Match level="Score=64.1, E-value =3.8e-16, Copies=1"; Pfam description=Elongation factor Tu GTP binding domain
MTPTATVCLMSRTAKRPRGGNSWNDSTHMVLGGYQVDNGGITRFDIALRKFQTAKYYVTIIDAPGHRDFIKNMITGTSQADCAVLIVAAGTGEFEAGISNNGQTREHALLAFTLGVKQLIVGVHKMDSTEPEYSESRFKQIKKEVSSYIKKIGYNPLA

SEQ ID NO: 20305 - protein, 173 aa, Diabrotica virgifera
  misc_feature: Coding regions on vcDNA: vcDNA=SeqID_2; Strand=-; Position=156-677
  misc_feature: Homolog annotation: Hit_ID=XP_321189.1; Match level="QueryCoverage =100%, HitCoverage=94%, E-value=1e-87, Identity=88%"; Hit description= ENSANGP00000020842 [Anopheles gambiae]
  misc_feature: Gene Ontology Annotation: Molecular function=N-acetyltransferase activity; Cellular component=nucleus; Biological process=protein modification
  misc_feature: Pfam annotation: Pfam_ID=Acetyltransf_1; Match level="Score=60.3, E -value=5.3e-15, Copies=1"; Pfam description=Acetyltransferase (GNAT) family
MTTLRPFTCNDMYKFNNVNLDPLTETYGLSFYMQYLAHWPEYFQVAESPSGEIMGYIMGKAEGIGENWHGHVTALTVSPDFRRLGLAACLMNFLEDVSEKKRAYFVDLFVRVSNKVAINMYNHLGYIVYRTVLEYYSGDPDEDAYDMRKACSRDVNQKSVIPLTHPVRPEDVD

SEQ ID NO: 20306 - protein, 70 aa, Diabrotica virgifera
  misc_feature: Coding regions on vcDNA: vcDNA=SeqID_3; Strand=+; Position=2-214
  misc_feature: Homolog annotation: Hit_ID=P18601; Match level="QueryCoverage=100%, HitCoverage=18%, E-value=5e-32, Identity=95%"; Hit description =Actin, clone 211 emb|CAA36836.1| unnamed protein product [Artemia sp.] pir||S11451 actin (clone
  misc_feature: Gene Ontology Annotation: Molecular function=structural constituent of cytoskeleton; Cellular component=cytoskeleton; Biological process= actin cytoskeleton organization and biogenesis
YPGIADRTVLEITALAPSTIKIKIIAPPERKYSVWIGGSILASLSTFQQMWISKQEYDESGPGIVHRKCF

SEQ ID NO: 20307 - protein, 481 aa, Diabrotica virgifera
  misc_feature: Coding regions on vcDNA: vcDNA=SeqID_4; Strand=+; Position=15-1457
  misc_feature: Homolog annotation: Hit_ID=EAA12037.2; Match level="QueryCoverage =97%, HitCoverage=83%, E-value=1e-135, Identity=53%"; Hit description= ENSANGP00000001916 [Anopheles gambiae str. PEST] ref|XP_555874.1| ENSANGP00000001916 [Anopheles gambiae s
  misc_feature: Gene Ontology Annotation: Molecular function=monooxygenase activity; Cellular component=extracellular space; Biological process =leukotriene metabolism
  misc_feature: Pfam annotation: Pfam_ID=p450; Match level="Score=147.9, E-value=2.2e- 41, Copies=1"; Pfam description=Cytochrome P450
MSQSVVQPLETETSSILTSHLPLILIRVISALLAYHYWFKNQRYVQLGNKFPGPATLPLIGNAHLAFGKSAHGLFRDAVQYYEEFKIDVVRFWLGSRLIIGVGNADDIEVILGNSVHLEKSSEYSLFEPWLGDGLLISKGEKWRSHRKMIAPTFHTSILKSFMPVFNRNAIALVETFRKEKGKVFDCHDYLSTTTVDTLLETAMGVTKEHDSNTGFDYAMAVMRMCNILHLRHLKAWLRPDIIFNFTKLSNIQVNLLKVIHDLTNGTIKRKKANYFEREKSGEKSLYEQAVKTSKFDEKQGNLIETRDLMSNLLRDDLDENEENDVGEKKRLAFLDYLIEASQTKGNALSDKEINEEVNTIMFEGHDTTAAASSFVISLLGIHQDVQERAFNELKEIFSDNLHRPVTFNDTLHMKYLERVILESLRMYPPVPMIARKVNEDVKLASGDYTIPAGTTVIVSQYILHRNEKYYKNPTVFDPDN

SEQ ID NO: 20308 - protein, 344 aa, Diabrotica virgifera
  misc_feature: Coding regions on vcDNA: vcDNA=SeqID_5; Strand=-; Position=2-1033
  misc_feature: Homolog annotation: Hit_ID=AAH86701.1; Match level="QueryCoverage =25%, HitCoverage=19%, E-value=3e-44, Identity=98%"; Hit description =Zgc:101545 [Danio rerio] ref|NP_001008638.1| zgc:101545 [Danio rerio] sp|P02993|EF1A_ARTSA Elongation fact
  misc_feature: Gene Ontology Annotation: Molecular function=translation factor activity, nucleic acid binding; Biological process=protein biosynthesis
  misc_feature: Pfam annotation: Pfam_ID=GTP_EFTU; Match level="Score=55.6, E-value =1.4e-13, Copies=1"; Pfam description=Elongation factor Tu GTP binding doma
MVKEKIHINIVVIGHVDSGKSTTTGHLIYKCGGIDKRTIEKFEKEAQEMGKGSFKYAWVLDKLKAERERGITIDIALWKFETAKYYVTINHVLTNKQTTCHGLFTCDSSEECKNKHCKDCLYTSNGNIEHEENVKCEVNCTLQPHQVFFSYDFTPDTPEEFKQLFPVEFPKLESSHEEMIQVFAQVAYTRGLNVNPHPYDKRLVPMCWKTLAYTIHSIEVLLRDAQKPLLGHLSSRQRDCIESLVRIVGVLGSTWKSSAFINSHAVSLLSILFENGNEGPSILQWDSFGLLISLTFSLPSLSCRNSKKTPVPTGGTSDWHVLRIIFISHIVKILILLQNDDLST

SEQ ID NO: 20309 - protein, 141 aa, Diabrotica virgifera
  misc_feature: Coding regions on vcDNA: vcDNA=SeqID_6; Strand=-; Position=115-540
  misc_feature: Homolog annotation: Hit_ID=XP_313284.1; Match level="QueryCoverage =92%, HitCoverage=26%, E-value=5e-44, Identity=67%"; Hit description =ENSANGP00000010498 [Anopheles gambiae] gb|EAA08857.1| ENSANGP00000010498 [Anopheles gambiae
  misc_feature: Gene Ontology Annotation: Molecular function=translation factor activity, nucleic acid binding
  misc_feature: Pfam annotation: Pfam_ID=GTP_EFTU_D3; Match level="Score=101.7, E -value=1.9e-27, Copies=1"; Pfam description=Elongation factor Tu C -terminal domain
PPRGASDFPAQIIVFNPPGQISNGNTPVFDCPPAPISCKFAEIKKKVGRRFGKTPEKNPKTLKFGDAPLVNLVPPKPQGVKSFQKFPPLGRFSVRDKRQTVAVGVLKRVPFKNPPPGKIPKTAEKTQKKKKFFWAPLLKKF

SEQ ID NO: 20310 - protein, 75 aa, Diabrotica virgifera
  misc_feature: Coding regions on vcDNA: vcDNA=SeqID_7; Strand=-; Position=540-767
SKGSKLHYNILYIMYIILFDYVSLFYFNLSFFVLFLFFLYKVWFPLGNPMAPQYFIFCIFLYFLFHILISIFLSF

SEQ ID NO: 20311 - protein, 269 aa, Diabrotica virgifera
  misc_feature: Coding regions on vcDNA: vcDNA=SeqID_8; Strand=-; Position=1-807
  misc_feature: Homolog annotation: Hit_ID=EAA09222.2; Match level="QueryCoverage =75%, HitCoverage=5%, E-value=2e-48, Identity=50%"; Hit description =ENSANGP00000017034 [Anopheles gambiae str. PEST] ref|XP_562189.1| ENSANGP00000017034 [Anopheles gambiae str
  misc_feature: Gene Ontology Annotation: Molecular function=actin binding; Cellular component=plasma membrane; Biological process=common-partner SMAD protein phosphorylation
  misc_feature: Pfam annotation: Pfam_ID=PH; Match level="Score=53.8, E-value=4.9e -13, Copies=1"; Pfam description=PH domain
EALQQSTQSPAENNNISIRKTNSIAHTFDRDRIRRGSDVSVKRAESMKVGNLVKPVKRTPSFNTRRRGSIRSKNELVLPPVEAEAFLERKQLLLPGQKRATNRAWKHSYTVLCGQLLCFFKTKDDFVASKANAAPLNIHNATCGIADDYQKRKHTFRLSITDGSEFLFASNSEVDMMDWINKITFRAKLPPANQLQHFEITKDPNDFEISSQSSRTSSPDVPDTVVLRQDPHATNGSISSSTNHPYRHTIEGFNNSTPSRGQEWNSTSR

SEQ ID NO: 20312 - protein, 69 aa, Diabrotica virgifera
  misc_feature: Coding regions on vcDNA: vcDNA=SeqID_9; Strand=-; Position=214-423
  misc_feature: Homolog annotation: Hit_ID=XP_310858.1; Match level="QueryCoverage =82%, HitCoverage=64%, E-value=7e-20, Identity=77%"; Hit description =ENSANGP00000012584 [Anopheles gambiae]
  misc_feature: Pfam annotation: Pfam_ID=ATP-synt_Eps; Match level="Score=103.7, E -value=4.8e-28, Copies=1"; Pfam description=Mitochondrial ATP synthase epsilon cha
DSKSVKLIFTKMSAWRAAGLNYINYSNIAAKLLRQALKPELRTEAMRRNETHIKVTKWQDGKPIRESTF

SEQ ID NO: 20313 - protein, 177 aa, Diabrotica virgifera
  misc_feature: Coding regions on vcDNA: vcDNA=SeqID_10; Strand=-; Position=3-533
  misc_feature: Homolog annotation: Hit_ID=CAE47498.1; Match level="QueryCoverage =98%, HitCoverage=53%, E-value=2e-99, Identity=95%"; Hit description =cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=48.4, E -value=3.2e-14, Copies=1"; Pfam description=Papain family cysteine protease
  misc_feature (133)..(133): Xaa can be any naturally occurring amino acid
RKQWAFGAVEAMSDRVCIHSNGESNFHFSSDDLVSCCWTCGMGCNGGYPGAAWHYWVRKGLVSGGQYGTKQGCRPYEIPPCEHHTNGSRPACDASEGNTPKCAKSCESNYKINYSNDLHFGSKAYSISSDVKXIQDEILQNGPAEGAFSVYADVVNYKTVVYQHIEGLFLGGLAIRI

SEQ ID NO: 20314 - protein, 88 aa, Diabrotica virgifera
  misc_feature: Coding regions on vcDNA: vcDNA=SeqID_11; Strand=+; Position=3-269
  misc_feature: Homolog annotation: Hit_ID=CAB75361.1; Match level="QueryCoverage =100%, HitCoverage=21%, E-value=3e-36, Identity=81%"; Hit description= USP protein [Tenebrio molitor]
  misc_feature: Gene Ontology Annotation: Molecular function=retinoid-X receptor activity; Cellular component=nucleus; Biological process=signal transduction
ILYNPDVRGLISIQEVEILREKIYGVLEDYTRTTHPNEPGRFAKLLLRLPALRSIGLKCLEHLFFFRLIGDASVDTFLTEMLENPLDS

SEQ ID NO: 20315 - protein, 68 aa, Diabrotica virgifera
  misc_feature: Coding regions on vcDNA: vcDNA=SeqID_12; Strand=+; Position=3-209
  misc_feature: Homolog annotation: Hit_ID=P18601; Match level="QueryCoverage=95%, HitCoverage=17%, E-value=4e-31, Identity=100%"; Hit description =Actin, clone 211 emb|CAA36836.1| unnamed protein product [Artemia sp.] pir||S11451 actin (clone
  misc_feature: Gene Ontology Annotation: Molecular function=structural constituent of cytoskeleton; Cellular component=cytoskeleton; Biological process= actin cytoskeleton organization and biogenesis
ANDDRMQKEITALAPSTIKIKIIAPPERKYSVWIGGSILASLSTFQQMWISKQEYDESGPGIVHRKCF

SEQ ID NO: 20316 - protein, 84 aa, Diabrotica virgifera
  misc_feature: Coding regions on vcDNA: vcDNA=SeqID_13; Strand=-; Position=6-260
PDCFFYVWQKGRKSELHIANVLMISGPAKNCCRRKLYVPIKRADFSGPEIIKTLSMCTSDLSPFSQTSENCNVQILLSDSSRIL

SEQ ID NO: 20317 - protein, 197 aa, Diabrotica virgifera
  misc_feature: Coding regions on vcDNA: vcDNA=SeqID_14; Strand=+; Position=385-1050
  misc_feature: Homolog annotation: Hit_ID=AAC34373.1; Match level="QueryCoverage =78%, HitCoverage=55%, E-value=1e-31, Identity=42%"; Hit description =apoptosis inhibitor IAP-1 [Buzura suppressaria nucleopolyhedrovirus]
  misc_feature: Gene Ontology Annotation: Molecular function=apoptosis inhibitor activity; Cellular component=cytosol; Biological process=anti -apoptosis
  misc_feature: Pfam annotation: Pfam_ID=BIR; Match level="Score=106.4, E-value=7.1e -29, Copies=2"; Pfam description=Inhibitor of Apoptosis domain
  misc_feature (181)..(181): Xaa can be any naturally occurring amino acid
MAVVQSNYIQNIPSFGCVDQPGNGSKTTRESLVEVSSSRPRQEDYSVYENRLASFTNWPNTQVSRESLARAGFIYTGQDDIVICPICKIEGYRWVSGDNPMDDHRVWNPNCPFLNRRDNIEHDHSVGSRDTCGLFGIELLPNSVPEDNTSRLATFPGVGPRAFKQRASELTEAGFLFKQEXDQTVCFYCGGGLKDWD

SEQ ID NO: 20318 - protein, 338 aa, Diabrotica virgifera
  misc_feature: Coding regions on vcDNA: vcDNA=SeqID_15; Strand=-; Position=448-1464
  misc_feature: Homolog annotation: Hit_ID=XP_319496.1; Match level="QueryCoverage =81%, HitCoverage=86%, E-value=5e-91, Identity=61%"; Hit description =ENSANGP00000020208 [Anopheles gambiae]
  misc_feature (197)..(197): Xaa can be any naturally occurring amino acid
  misc_feature (204)..(204): Xaa can be any naturally occurring amino acid
MYREAVGWAFTALLVSSSLVGTFSYPNVQINSRPVSSDAAESPSEPRNFYPVKGPRDVPQFQRAERKFAEKPNAIKKVALDRLDDVESNSIAESSDNGLASGGGFSWSNLLAPENYIGMLMQMIFNPGGNQGPNKSDDLDTAPVPTSPWANLLSVGLKMLTAILGGGNTGGDGIDKVDNGNSPMQGVLAAVVEAVVXDRDPEQXNKIARQAGEFINIVVNLLDALKTSFSHRSLQARSLGKKDSVSDAAVASLSMMKGYMRSLSTGDTKCMERYVCQANSECSKNVGQSSLYCHLGSYAISYVMEKSLGSSFDVFYEAGRRGRYGDNCQEKYLECNEV

SEQ ID NO: 20319 - protein, 542 aa, Diabrotica virgifera
  misc_feature: Coding regions on vcDNA: vcDNA=SeqID_16; Strand=+; Position=1-1625
  misc_feature: Homolog annotation: Hit_ID=BAA74713.1; Match level="QueryCoverage =99%, HitCoverage=42%, E-value=1e-112, Identity=40%"; Hit description= copia-like retrotransposable element [Bombyx mori]
  misc_feature: Pfam annotation: Pfam_ID=rve; Match level="Score=137.0, E-value=4.5e -38, Copies=1"; Pfam description=Integrase core domain
  misc_feature (244)..(244): Xaa can be any naturally occurring amino acid
  misc_feature (526)..(526): Xaa can be any naturally occurring amino acid
  misc_feature (529)..(529): Xaa can be any naturally occurring amino acid
RTRGQFISNIIEIEPVGIKIADGRVMTARTKGKLKVYYNETPINIDVLILNELEYNLLSVSKLNSLGFTVVFKENKAEIRKKNFKLICYKHKSNLFAANFQLNNFQSSLVAKHSDKDLWHLRLGHVNRRGLQLLGLPYSDKLCDSCQQGKATRQPFKEVIYKKSSRVGELLHVDTWGPSKDPTFSGEKYYLSIIDDFSHFSVVYLMTRKSESESHLINHIEKLAAEGRRVSRIRMDKGGEMSSXYFKNYCIQHGIVQEFTAGYTPQQNSIAERLNRTILDKVRAMFVETNLPKSLWGEAVRTAVYQLNRTPSRAIELQVPAEIYLGRLDLSKLRIFGSKVWYYNLPKQSKLEPRASKGVMVGYSGAGYRIWNPLTKQIKISRDVVFDETQYKYSPEISSNNQNVEEILPSQNELETFETNYEESTVQTLRNTTEINSQDEEPVNLQNTKITSSNREIKQPSKFKDYELYYAYCLVTSTPVTYEEAVEEDEWKQAIETELECLEKMNTWSEATKIPHDQQIINTKWXYLXTKSDGTKKARLVA

SEQ ID NO: 20320 - protein, 284 aa, Diabrotica virgifera
  misc_feature: Coding regions on vcDNA: vcDNA=SeqID_17; Strand=+; Position=121-969
  misc_feature: Homolog annotation: Hit_ID=AAA28316.1; Match level="QueryCoverage =100%, HitCoverage=75%, E-value=1e-152, Identity=95%"; Hit description=actin
  misc_feature: Gene Ontology Annotation: Biological process=reproduction
  misc_feature: Pfam annotation: Pfam_ID=Actin; Match level="Score=517.6, E-value =1.1e-152, Copies=1"; Pfam description=Actin
  misc_feature (237)..(237): Xaa can be any naturally occurring amino acid
  misc_feature (240)..(240): Xaa can be any naturally occurring amino acid
  misc_feature (255)..(255): Xaa can be any naturally occurring amino acid
  misc_feature (267)..(268): Xaa can be any naturally occurring amino acid
MCEEEVAALVVDNGSGMCKAGFAGDDAPRAVFPSIVGRPRHQGVMVGMGQKDSYVGDEVQSKRGILTLKYPIEHGIVTNWDDMEKIWHHTFYNELRVAPEEHPVLLTEAPLNPKAREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLCYVALDFEQEMATAASSSSLXEKXYELPDGTVITIGNEXRFRCPEALFHHXXWGMEAAGIHETTYNSI

SEQ ID NO: 20321 - protein, 261 aa, Diabrotica virgifera
  misc_feature: Coding regions on vcDNA: vcDNA=SeqID_18; Strand=-; Position=2-784
  misc_feature: Homolog annotation: Hit_ID=NP_650717.1; Match level="QueryCoverage =94%, HitCoverage=71%, E-value=2e-82, Identity=63%"; Hit description =CG7675-PB, isoform B [Drosophila melanogaster] gb|AAF55546.2| CG7675- PB, isoform B [Drosophila
  misc_feature: Gene Ontology Annotation: Molecular function=electron transporter activity; Cellular component=nucleus; Biological process=induction of apoptosis
  misc_feature: Pfam annotation: Pfam_ID=adh_short; Match level="Score=62.4, E-value =1.2e-15, Copies=1"; Pfam description=short chain dehydrogenase
MNFLGVELDTSTVLAILAVLLLGFLTAVSLLKFYAYVTCGFFHEKVRMERKTVIVTGATGGIGKETARELAKRGAKVIIACRNVESAKKVRDELAQDTKNQNIIVKKLDLSSQKSIREFAEDINRTETKLDVLIHNAGTAENKLKKSEDGIELTMATNHFGPFLLTHLLIDLLKRSAPSRIVVVASELYRLASLNLDNLNPSSTWCPEYWYYVSKYANICFTLELARRLEGTGVTVNCLHPGMIDSGIWRNVPIPLNWGLK

SEQ ID NO: 20322 - protein, 264 aa, Diabrotica virgifera
  misc_feature: Coding regions on vcDNA: vcDNA=SeqID_19; Strand=-; Position=1-792
  misc_feature: Homolog annotation: Hit_ID=EAA14601.2; Match level="QueryCoverage =75%, HitCoverage=68%, E-value=5e-63, Identity=61%"; Hit description =ENSANGP00000020208 [Anopheles gambiae str. PEST] ref|XP_554213.1| ENSANGP00000020208 [Anopheles gambiae st
MYREAVGWAFTALLVSSSLVGTFSYPNVQINSRPVSSDAAASPSEPRNFYPVKGPRDVPQFQRAERKFAEKPNAIKKVALDRLDDVESNSIAESSDNGLASGGGFSWSNLLAPENYIGMLMQMIFNPGGNQGPNKSDDLDTAPVPTSPWANLLSVGLKILTAILGGGNTGGDGIDKVDNGNSPMQFINIVVNLLDALKTSFSHRSLQARSLGKKDSVSDAAVASLSMMKGYMRSLSTGDTKCMERYVCQSHSECSKNVGQSSLY

SEQ ID NO: 20323 - protein, 348 aa, Diabrotica virgifera
  misc_feature: Coding regions on vcDNA: vcDNA=SeqID_20; Strand=+; Position=188-1235
  misc_feature: Homolog annotation: Hit_ID=EAL27742.1; Match level="QueryCoverage =98%, HitCoverage=92%, E-value=7e-80, Identity=46%"; Hit description =GA19449-PA [Drosophila pseudoobscura]
  misc_feature: Gene Ontology Annotation: Molecular function=N-acetylglucosamine kinase activity; Cellular component=soluble fraction; Biological process=N-acetylglucosamine metabolism
  misc_feature: Pfam annotation: Pfam_ID=BcrAD_BadFG; Match level="Score=133.0, E -value=6.8e-37, Copies=1"; Pfam description=BadF/BadG/BcrA/BcrD ATPase family
  misc_feature (135)..(135): Xaa can be any naturally occurring amino acid
LNDCEGATHSNAIILDSSGNILGQAPGPGTNHHLAGMKEAQKRIAQLVDAAKSKANISLDTKLDALGLSLSGCEQEETNNILKKGLLEDYPNLAEKVLVASDTEGSVAATSKTGGVVCIAGTGSNTLLINPNGSXFNGGGWGNLLGDEGSAWNISHMAIKTCFDELDNFEKSPHPIGAVWDVIRSHFKIKIQADILDYFYANFDKAFIASLAKKISELATRKNDPLAQHIFSKAGSSIAQNITAVVLKADPKLTDREGGIHITCVGSVWHSWELLKPGFLKYLATTNVKELTLMRLDVESGVGAAYLASDKLGLSLDRDYSKNYKILFHYLKEQSACNTSGHNHICDK

SEQ ID NO: 20324 - protein, 254 aa, Diabrotica virgifera
  misc_feature: Coding regions on vcDNA: vcDNA=SeqID_21; Strand=+; Position=191-951
  misc_feature: Homolog annotation: Hit_ID=AAN46650.1; Match level="QueryCoverage =77%, HitCoverage=52%, E-value=5e-44, Identity=44%"; Hit description =inhibitor of apoptosis protein [Bombyx mori]
  misc_feature: Gene Ontology Annotation: Molecular function=apoptosis inhibitor activity; Cellular component=cytosol; Biological process=anti -apoptosis
  misc_feature: Pfam annotation: Pfam_ID=BIR; Match level="Score=211.0, E-value=2.3e -60, Copies=2"; Pfam description=Inhibitor of Apoptosis domain
  misc_feature (244)..(244): Xaa can be any naturally occurring amino acid
MTHIVKWLWTKLFHGTKMAVVQSNYIQNIPSFGCVDQPDNGSKTTRESLVEVSSSRPRQEDYSVYENRLASFTNWPNTQVSRESLARAGFIYTGQDDIVICPICKIEGYRWVSGDNPMDDHRVWNPNCPFLNRRDNIEHDHSVGSRDTCGLFGIELLPNSVPEDNTSNLQKLGIQPGTGPQNQDKITLESRLATFQGWPKSIKQRPSELAEAGFYYTGAGDQTVCFYCGGGLKDWDEGDDPWEXHALWFSKCVF

SEQ ID NO: 20325 - protein, 185 aa, Diabrotica virgifera
  misc_feature: Coding regions on vcDNA: vcDNA=SeqID_22; Strand=-; Position=64-621
  misc_feature: Homolog annotation: Hit_ID=XP_320076.1; Match level="QueryCoverage =93%, HitCoverage=82%, E-value=3e-18, Identity=30%"; Hit description =ENSANGP00000012317 [Anopheles gambiae]
  misc_feature: Gene Ontology Annotation: Molecular function=lipid transporter activity; Cellular component=extracellular space; Biological process= lipid metabolism
MIVLAVTLCLLVISIQGQIPVERCPDVKGVANFDGQAYLGDWIEQARYPTLLEDHGECVITNIAVGADGVIRSRTKYTNTKTNEDHVLEGEGVSNSTTGEAKFLVHFLNPDVTVPFWILGTDYKRWSVGFSCFERNGVFLESLFLTTRYQEASPDDIDNIVQVLEDNNLSVDALVNDDQDNCYYD

SEQ ID NO: 20326 - protein, 146 aa, Diabrotica virgifera
  misc_feature: Coding regions on vcDNA: vcDNA=SeqID_23; Strand=+; Position=1733-2173
VSLCFITIFNMDSHMQPIQYLNNARLATLLHRYKELNIKKMLQKSKIFYNNECLRLNLLPSYARGRLRELNFNATKAKQVKILGRSIIRDEIRKLYQHIYTIDLQLKTIYNSLHRRMTALEFDECMRDLHGTINFHRSRQYRKLLS

SEQ ID NO: 20327 - protein, 304 aa, Diabrotica virgifera
  misc_feature: Coding regions on vcDNA: vcDNA=SeqID_24; Strand=-; Position=649-1563
  misc_feature: Homolog annotation: Hit_ID=EAA14601.2; Match level="QueryCoverage =78%, HitCoverage=85%, E-value=4e-85, Identity=64%"; Hit description =ENSANGP00000020208 [Anopheles gambiae str. PEST] ref|XP_554213.1| ENSANGP00000020208 [Anopheles gambiae st
MYREAVGWAFTALLVSSSLVGTFSYPNVQINSRPVSSDAAASPSEPRNFYPVKGPRDVPQFQRAERKFAEKPNAIKKVALDRLDDVESNSIAESSDNGLASGGGFSWSNLLGMLMQMIFNPGGNQGPNKSDDLDTAPVPTSPWANLLSVGLKILTAILGGGNTGGDGIDKVDNGNSPMQFINIVVNLLDALKTSFSHRSLQARSLGKKDSVSDAAVASLSMMKGYMRSLSTGDTKCMERYVCQANSECSKNVGQSSLYCHLGSYAISYVMEKSLGSSFDVFYEAGRRGRYGDNCQEKYLECNEV

SEQ ID NO: 20328 - protein, 262 aa, Diabrotica virgifera
  misc_feature: Coding regions on vcDNA: vcDNA=SeqID_25; Strand=+; Position=208-993
  misc_feature: Homolog annotation: Hit_ID=NP_727048.1; Match level="QueryCoverage =100%, HitCoverage=69%, E-value=1e-149, Identity=99%"; Hit description=CG4027-PA, isoform A [Drosophila melanogaster] ref|NP _511052.1| CG4027-PB, isoform B [Drosophila
  misc_feature: Gene Ontology Annotation: Biological process=reproduction
  misc_feature: Pfam annotation: Pfam_ID=Actin; Match level="Score=485.5, E-value =5.6e-143, Copies=1"; Pfam description=Actin
MCEEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLCYVALDFEQEMATAASSSSLEKSYELPDGQVITIGNERFRCPEAL

SEQ ID NO: 20329 - protein, 181 aa, Diabrotica virgifera
  misc_feature: Coding regions on vcDNA: vcDNA=SeqID_26; Strand=-; Position=29-576
  misc_feature: Homolog annotation: Hit_ID=Q9U639; Match level="QueryCoverage=97%, HitCoverage=27%, E-value=1e-80, Identity=87%"; Hit description=Heat shock 70 kDa protein cognate 4 (Hsc 70-4) gb|AAF09496.1| heat shock cognate 70 protein
  misc_feature: Gene Ontology Annotation: Molecular function=protein binding; Biological process=reproduction
  misc_feature: Pfam annotation: Pfam_ID=HSP70; Match level="Score=-264.0, E-value =5.8e-07, Copies=1"; Pfam description=Hsp70 protein
  misc_feature (17)..(17): Xaa can be any naturally occurring amino acid
  misc_feature (19)..(19): Xaa can be any naturally occurring amino acid
  misc_feature (137)..(137): Xaa can be any naturally occurring amino acid
  misc_feature (166)..(166): Xaa can be any naturally occurring amino acid
GEDFDNRMDNHFVGEFXEXYKKDLTTNKRALRRLRTSCERAKRTLSSSSQVSIEIDSLYEGIDFYTSITRDRFEELNADLFRSTMEPVEKAIRDAKMDKSQVHDIVLVGGSTRIPKVQKLLQDFFYGKELNKSINPXEAVAYGDADQDAILHGHKSEEVQDLLLAXVTPLYLGIETAWRSL

SEQ ID NO: 20330 - protein, 103 aa, Diabrotica virgifera
  misc_feature: Coding regions on vcDNA: vcDNA=SeqID_27; Strand=-; Position=475-786
  misc_feature: Homolog annotation: Hit_ID=ZP_00357698.1; Match level="QueryCoverage =64%, HitCoverage=33%, E-value=2e-19, Identity=76%"; Hit description =hypothetical protein Chlo02002738 [Chloroflexus aurantiacus]
PGFSPSRGFKTRAPEINFGAPLKKILLPHPPFLNLVPFKGPPPFFFFPPFFFFFFFFFFFFFFFFFFFFFFFFFFFFFFFFFFFFFFFFFYNKLSYILLDTNV

SEQ ID NO: 20331 - protein, 182 aa, Diabrotica virgifera
  misc_feature: Coding regions on vcDNA: vcDNA=SeqID_28; Strand=+; Position=1019-1564
  misc_feature: Gene Ontology Annotation: Molecular function=molecular_function unknown; Cellular component=cellular_component unknown; Biological process=N-linked glycosylation
IIFIFKKKKKKKKKKKKKKKKKKKKKKKKKKKKKKKKKKKKKKKKKKKKKKKKKKKKKKKKKKKKKKRGGALKKKKNLKRGGGGLFFFFWGPKKFFPGRVFKKGGGEKTGGPPIIIPVENPPLFRGGKKKKKPPPPPPPPNKAPLFRGKGPPPFNTFYKGGGGGGFFPGWGPFFLWDPPTPP

SEQ ID NO: 20332 - protein, 296 aa, Diabrotica virgifera
  misc_feature: Coding regions on vcDNA: vcDNA=SeqID_29; Strand=+; Position=104-994
  misc_feature: Homolog annotation: Hit_ID=AAN10050.1; Match level="QueryCoverage =99%, HitCoverage=98%, E-value=5e-62, Identity=48%"; Hit description =Y-box protein Ct-p50 [Chironomus tentans]
  misc_feature: Gene Ontology Annotation: Molecular function=DNA binding; Cellular component=nucleus; Biological process=negative regulation of transcription from Pol II promoter
  misc_feature: Pfam annotation: Pfam_ID=CSD; Match level="Score=131.5, E-value=2e -36, Copies=1"; Pfam description='Cold-shock' DNA-binding domain
  misc_feature (270)..(270): Xaa can be any naturally occurring amino acid
  misc_feature (272)..(272): Xaa can be any naturally occurring amino acid
  misc_feature (274)..(274): Xaa can be any naturally occurring amino acid
MAEAEQQQTAPEQPKAVPKQKEVLATKVTGTVKWFNVKSGYGFINRNDTKEDVFVHQSAIIKNNPKKAVRSVGDGEVVEFSVVVGEKGNEAANVTGPNGDPVRGSPYAADRRRGYRQWYYPRGRRGRRGGSRGGGPPRESEGELKDGVQSGGEGGQGGQGPPRRYAPRRGRGGYSYYRGPYRGPPGELEQNGDAPRGRRPPRGFFRRNYRGGRGGARPRSQDSQGQAGELNGQEGGPRGPRGPRYRRRGPARPRAGNSQSESAGGNQPNXQXSXKAVSDKTEESQPVQNTTTESSA

SEQ ID NO: 20333 - protein, 385 aa, Diabrotica virgifera
  misc_feature: Coding regions on vcDNA: vcDNA=SeqID_30; Strand=+; Position=40-1194
  misc_feature: Homolog annotation: Hit_ID=AAV65298.1; Match level="QueryCoverage =98%, HitCoverage=99%, E-value=0.0, Identity=97%"; Hit description =actin [Apriona germari]
  misc_feature: Gene Ontology Annotation: Biological process=reproduction
  misc_feature: Pfam annotation: Pfam_ID=Actin; Match level="Score=896.6, E-value =9.5e-267, Copies=1"; Pfam description=Actin
  misc_feature (16)..(16): Xaa can be any naturally occurring amino acid
  misc_feature (25)..(25): Xaa can be any naturally occurring amino acid
  misc_feature (55)..(55): Xaa can be any naturally occurring amino acid
  misc_feature (89)..(89): Xaa can be any naturally occurring amino acid
STTKDNTCDDDVAALXVVDNGSGIXCKLGFAGDDAPRAVFPSIVGRPRHQGVIGXGSGQKDSYVGDEAQSKRGILTLKYPIEHGIITNXDDMEKIWHHTFYNELRVAPEEHPVLLTEAPLNPKANREKMTQIMFETFNTPAMYVAIQAVLSLYASGRTTGIVLDSGDGVTHTVPIYEGYALPHAILRLDLAGRDLTDYLMKILTERGYSFTTTAEREIVRDIKEKLCYVALDFEQEMATAAASTSLEKSYELPDGQVITIGNERFRCPEALFQPSFLGMESCGIHETVYNSIMKCDVDIRKDLYANTVLSGGTTMYPGIADRMQKEITALAPSTIKIKIIAPPERKYSVWIGGSILASLSTFQQMWISKQEYDESGPGIVHRKCF

SEQ ID NO: 20334 - protein, 192 aa, Diabrotica virgifera
  misc_feature: Coding regions on vcDNA: vcDNA=SeqID_31; Strand=+; Position=49-627
  misc_feature: Homolog annotation: Hit_ID=AAA64736.1; Match level="QueryCoverage =96%, HitCoverage=94%, E-value=4e-31, Identity=36%"; Hit description =apolipophorin-III
MNKYFVFVAIAFLAIQAVESKPRASQQQRPAAQNVAEDDLAKKAQDLIKKADEVVTGNLPSTEQIINNVEETGKKLVSNIKDFNDYLKTQLTANKGDVDKILRQVSDNLHAASEKIQKDVLGPQGQKKASEIRENLHAQIKSAATQIEKLTAAVKPEAEKVKNDLLAAANLFLDKAINVADDLKKVVAEHKN

SEQ ID NO: 20335 - protein, 354 aa, Diabrotica virgifera
  misc_feature: Coding regions on vcDNA: vcDNA=SeqID_32; Strand=-; Position=26-1089
  misc_feature: Homolog annotation: Hit_ID=NP_608786.2; Match level="QueryCoverage =92%, HitCoverage=72%, E-value=1e-89, Identity=48%"; Hit description =CG17593-PA [Drosophila melanogaster] gb|AAF51095.1| CG17593-PA [Drosophila melanogaster]
  misc_feature: Pfam annotation: Pfam_ID=DUF1682; Match level="Score=178.1, E-value =1.9e-50, Copies=1"; Pfam description=Protein of unknown function (DUF1682)
  misc_feature (330)..(330): Xaa can be any naturally occurring amino acid
MLLRYFILFILLIQSGLTNDFHDQADNEFAEFEDFEVEDEQVISEEVQSDTEGPPEQVPENEDDPDMVVDDDDSEFEHFQDGEEFEGYELKEENVESEPKITIAKVPLNFRQNWDSYYLEILMMAGLVVYFINFATGKSKNSKIANTWFNTHRQLFEDNFSLVGDDGTLDRNENTSLTKESENIFTLWCSGRTCCEGMLVELKLIKRQDLLATLSGMMRPTMDQIHFTIRMNKEDMDNFVFCLATKKTATSLVKDMADLSVYCPERKSGDKFNLPSSFNVMSEIGEAASAILDHKVSTVINKYPEYIDYIHISDQFSGLKQTEETGLLNXPDTEKVIMSGSIYPVKGMPLEERV

SEQ ID NO: 20336 - protein, 445 aa, Diabrotica virgifera
  misc_feature: Coding regions on vcDNA: vcDNA=SeqID_33; Strand=+; Position=120-1453
  misc_feature: Homolog annotation: Hit_ID=AAG44910.1; Match level="QueryCoverage =100%, HitCoverage=78%, E-value=1e-168, Identity=66%"; Hit description=phosphoglucomutase [Drosophila melanogaster]
  misc_feature: Gene Ontology Annotation: Molecular function=phosphoglucomutase activity; Cellular component=mitochondrion; Biological process =carbohydrate metabolism
  misc_feature: Pfam annotation: Pfam_ID=PGM_PMM_I; Match level="Score=171.5, E-value= 1.8e-48, Copies=1"; Pfam description =Phosphoglucomutase/phosphomannomutase
  misc_feature (382)..(382): Xaa can be any naturally occurring amino acid
  misc_feature (397)..(397): Xaa can be any naturally occurring amino acid
  misc_feature (417)..(418): Xaa can be any naturally occurring amino acid
MALSSVDVETTAFEGQKPGTSGLRKKVKVFMEKHYTENFVQSIINALGDKAKGSTLIVGGDGRYFSKQAINIIIRIASANGVSKLLIGQLGILSTPAVSSLIRHHKVLGGIVLTASHNPGGIRNDFGIKYNIENGGPAPDQVSDAIYEHTKKIKSYKYTPKLETDRLIDILGTTAVKVDGRDFIVEVIDSTANYVALMKDIFDFKKLRTLIRGTEQRPPFNVLIDSMNGVTGVYVRRIFVEELGASPDNNVCRIVPLDNFGEIHPDPNLTYAKDLVDKVKANPSYDLGAAFDGDGDRNMIIGKNAFFVTPSDSLAVLANNLECIPYFQKHGVQGFARSMPTAAAVDRVAEKLGKEMFEVPTGWKYFGNLMDAGRLSLCGEEXFGTGSDHIREKDGIXAVLAWVSVIEHKNMSVEEIXXEHWSIYGRNYFTRYDYEEMRSDAANDM

SEQ ID NO: 20337 - protein, 71 aa, Diabrotica virgifera
  misc_feature: Coding regions on vcDNA: vcDNA=SeqID_34; Strand=+; Position=1520-1735
TITFVQDPRITFHTLLQLIRNSWSIVFLHSNKTSPVSHTHLPSGSIPNLKSYCVLTYVTCLFTLSLSQQTN

SEQ ID NO: 20338 - protein, 141 aa, Diabrotica virgifera
  misc_feature: Coding regions on vcDNA: vcDNA=SeqID_35; Strand=+; Position=75-500
  misc_feature: Homolog annotation: Hit_ID=CAH04327.1; Match level="QueryCoverage =100%, HitCoverage=100%, E-value=3e-65, Identity=87%"; Hit description=S12e ribosomal protein [Curculio glandium]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L7Ae; Match level="Score=118.1, E -value=2.2e-32, Copies=1"; Pfam description=Ribosomal protein L7Ae/L30e/S12e/Gadd
MSDNEVDDAPPAPQVQSGGPMDVNQALQEVLKTALIHDGVVHGLHEAAKALDKRQAVLCVLAENCDEPMYKKLVSALCSEHQIPLIKVDNNKKLGEWSGLCKIDNTGKARKVVGCSCVVIRDYGEESPALDVLRDYLKNAK

SEQ ID NO: 20339 - protein, 452 aa, Diabrotica virgifera
  misc_feature: Coding regions on vcDNA: vcDNA=SeqID_36; Strand=+; Position=819-2174
  misc_feature: Homolog annotation: Hit_ID=EAA12037.2; Match level="QueryCoverage =97%, HitCoverage=77%, E-value=1e-121, Identity=52%"; Hit description= ENSANGP00000001916 [Anopheles gambiae str. PEST] ref|XP_555874.1| ENSANGP00000001916 [Anopheles gambiae s
  misc_feature: Gene Ontology Annotation: Molecular function=monooxygenase activity; Biological process=leukotriene metabolism
  misc_feature: Pfam annotation: Pfam_ID=p450; Match level="Score=28.7, E-value=1.2e -12, Copies=1"; Pfam description=Cytochrome P450
  misc_feature (436)..(436): Xaa can be any naturally occurring amino acid
MSQSVVQPLETETSSILTSNIPLILIGIISVLLGYQYWFKNQRYVQMGNKFPGPATLPFIGNAHLAFGKSAHGLFELAMAYYKELQIDVGRIWLGPRLIIGVANADDIEIILGNSVHLEKSPDYGLFEPWLGDGLLISKGEKWRSHRKMIAPTFHTSILKSFMPVFNRNATALVETFRKEQGKVFDCHDYLSSTTVDTLLETAMGVTKEHDSKAGFDYAMAVMRMCNILHLRHMKFWLRPDTIFNFTKLSNIQVNLLKVIHDLTNGTIKRKKANYFEREKSGEKSLYEQAVKTSKFDEKQGNLIETRDIMSNLLRDDLDENEENDVGEKKRLAFLDYLIEASQTKGNALSDKEINEEVNTIMFEGHDTTAAASSFVISLLGIHQDVQERAFNELKEIFSDNLHRPVTFNDTLHMKYPGRVILESLRMYPPVPMIAXKVNEDVKLASGDYTIP

SEQ ID NO: 20340 - protein, 1000 aa, Diabrotica virgifera
  misc_feature: Coding regions on vcDNA: vcDNA=SeqID_37; Strand=-; Position=422-3423
  misc_feature: Homolog annotation: Hit_ID=AAD09820.1; Match level="QueryCoverage =99%, HitCoverage=99%, E-value=0.0, Identity=91%"; Hit description =sarco(endo)plasmic reticulum-type calcium ATPase [Heliothis virescens]
  misc_feature: Gene Ontology Annotation: Molecular function=calcium-transporting ATPase activity; Cellular component=nuclear envelope-endoplasmic reticulum network; Biological process=calcium ion homeostasis
  misc_feature: Pfam annotation: Pfam_ID=E1-E2_ATPase; Match level="Score=422.8, E -value=4.2e-124, Copies=1"; Pfam description=E1-E2 ATPase
  misc_feature (962)..(962): Xaa can be any naturally occurring amino acid
MEDGHAKTVDEVLRYFDADQERGLSLDQVKKNQAKYGPNELPAEEGKSIWQLVLEQFDDLLVKILLLAAIISFVLALFEEHDGAFTAFVEPFVILLILIANAVVGVWQERNAESAIEALKEYEPEMGKVVRQDKSGIQKIRAKEIVPGDIVEVSVGDKIPADIRLVKIFSTTLRIDQSILTGESVSVIKHTDAIPDPRAVNQDKKNILFSGTNVAAGKARGIVIGTGLNTAIGKIRTEMSETEEIKTPLQQKLDEFGEQLSKVISVICVAVWAINIGHFNDPAHGGSWIKGAVYYFKIAVALAVAAIPEGLPAVITTCLALGTRRMAKKNAIVRSLPSVETLGCTSVICSDKTGTLTTNQMSVSRMFIFDKVEGSDSSFHEFEITGSTYEPIGEVFLKGQKVKCAEFDALHEIGTICIMCNDSAIDFNEFKQAFEKVGEATETALIVLAEKMNPFSVSKTGDRRQVAICVRQDIETKWKKEFTLEFSRDRKSMSSYCTPLKPSRIGNGPKLFVKGAPEGVLERCTHARVGSQKVPLTSTLKKRITDLTAQYGCGRDTLRCLALATADNPMKPDEMDLGDSTKFYTYEVNLTFVGVVGMLDPPRKEVFDSIVQCRAAGIRVIVITGDNKATAEAICRRIGVFTEDEDTTGKSYSGREFDDLPTSEQKAACARARLFSRVEPAHKSKIVEYLQSMNEISAMTGDGVNDAPALKKAEIGIAMGSGTAVAKSASEMVLADDNFSSIVAAVEEGRAIYNNMKQFIRYLISSNIGEVVSIFLTAALGLPEALIPVQLLWVNLVTDGLPATALGFNPPDLDIMSKPPRKADESLISGWLFFRYLAIGGYVGAATVGAAAWWFMYSPEGPQMNYYQLTHHLQCIGGGPEFKGVNCKVFSDPHPMTMALSVLVTIEMLNAMNSLSENQSLIAMPPWSNWWLIGSMALSFTLHFVIIYVEVLSVVFQVCPLXLEEWMTVMKFSIPVVLLDETLKFVARKITDVPQKMCRM

SEQ ID NO: 20341 - protein, 301 aa, Diabrotica virgifera
  misc_feature: Coding regions on vcDNA: vcDNA=SeqID_38; Strand=+; Position=192-1091
  misc_feature: Homolog annotation: Hit_ID=AAU95191.1; Match level="QueryCoverage =98%, HitCoverage=78%, E-value=1e-168, Identity=98%"; Hit description= putative muscle actin [Oncometopia nigricans] gb|AAU84943.1| putative muscle actin [Toxoptera citricida]
  misc_feature: Gene Ontology Annotation: Biological process=reproduction
  misc_feature: Pfam annotation: Pfam_ID=Actin; Match level="Score=605.0, E-value =5.9e-179, Copies=1"; Pfam description=Actin
  misc_feature (264)..(264): Xaa can be any naturally occurring amino acid
  misc_feature (286)..(286): Xaa can be any naturally occurring amino acid
MCDDDVAALVVDNGSGMCKAGFAGDDAPRAVFPSIVGRPRHQGVMVGMGQKDSYVGDEAQSKRGILTLKYPIEHGIITNWDDMEKIWHHTFYNELRVAPEEHPILLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLCYVALDFEQEMATAASSTSLEKSYELPDGQVITIGNERFRCPEALFXPSFLGMESCGIHETVYNSIMKXCDVDIRKDLYATLSF

SEQ ID NO: 20342 - protein, 360 aa, Diabrotica virgifera
  misc_feature: Coding regions on vcDNA: vcDNA=SeqID_39; Strand=+; Position=409-1491
  misc_feature: Homolog annotation: Hit_ID=AAN46650.1; Match level="QueryCoverage =86%, HitCoverage=81%, E-value=1e-64, Identity=40%"; Hit description =inhibitor of apoptosis protein [Bombyx mori]
  misc_feature: Gene Ontology Annotation: Molecular function=apoptosis inhibitor activity; Cellular component=cytosol; Biological process=anti -apoptosis
  misc_feature: Pfam annotation: Pfam_ID=BIR; Match level="Score=230.1, E-value=4.2e -66, Copies=2"; Pfam description=Inhibitor of Apoptosis domain
MLCIMKFHGTKMAVVQSNYIQNIPSFGCVDQPDNGSKTTRESLVEVSSSRPRQEDYSVYENRLASFTNWPNTQVSRESLARAGFIYTGQDDIVICPICKIEGYRWVSGDNPMDDHRVWNPNCPFLNRRDNIEHDHSVGSRDTCGLFGIELLPNSVPEDNTSNLQKLGIQPGTGPQNQDKITLESRLATFQGWPKSIKQRPSELAEAGFYYTGAGDQTVCFYCGGGLKDWDEGDDPWEQHALWFSKCVFLNLKKGKEFIDQVKRKADPQFSIPGPSGTQAKEETTATESSSDKQSETVKTKSDRESFATDTTLCKICFKNELGVVFLPCGHIVACVDCAAALKTCAVCRKPLEATVRAFLS

SEQ ID NO: 20343 - protein, 336 aa, Diabrotica virgifera
  misc_feature: Coding regions on vcDNA: vcDNA=SeqID_40; Strand=-; Position=231-1241
  misc_feature: Homolog annotation: Hit_ID=CAE47498.1; Match level="QueryCoverage =92%, HitCoverage=94%, E-value=1e-175, Identity=91%"; Hit description= cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=203.0, E -value=5.9e-58, Copies=1"; Pfam description=Papain family cysteine protease
  misc_feature (281)..(281): Xaa can be any naturally occurring amino acid
  misc_feature (321)..(321): Xaa can be any naturally occurring amino acid
MIPLLLLLIPYCSGLRMDIVTHSSDEVTNSKELHPLSDEFINSINAAKSTWTAGRNFAQDKSMDYIIKLMGVLPDHKNYMPPVLTHKLEALEIPADFDARQQWPHCPTIREIRDQGSCGSCWAFGAVEAMSDRVCIHSNGESNFHFSSDDLVSCCWTCGMGCNGGYPGAAWHYWVRKGLVSGGQYGTKQGCRPYEIPPCEHHTNGSRPACDASEGNTPKCAKSCESNYKINYSNDLHFGSKAYSISSDVKQIQAEILQNGPVEGAFSVYADFVNYKNWGVXQHLKRQFLGRSGFRFFRWGGKKKPPFWVVCNSWKPDGGDXGTFKNLLKEGTIWRL

SEQ ID NO: 20344 - protein, 284 aa, Diabrotica virgifera
  misc_feature: Coding regions on vcDNA: vcDNA=SeqID_41; Strand=+; Position=928-1782
  misc_feature: Homolog annotation: Hit_ID=BAD12426.1; Match level="QueryCoverage =95%, HitCoverage=74%, E-value=1e-115, Identity=75%"; Hit description= fructose 1,6-bisphosphate aldolase [Antheraea yamamai]
  misc_feature: Gene Ontology Annotation: Molecular function=fructose-bisphosphate aldolase activity; Biological process=fructose metabolism
  misc_feature: Pfam annotation: Pfam_ID=Glycolytic; Match level="Score=518.3, E -value=7.4e-153, Copies=1"; Pfam description=Fructose-bisphosphate aldolase class-
MTTSWNYPDAALRAELKKIADAITAPGKGILAADESTATVGKRFADIGVENNEENRRKYRQLLFTTDPAIGQYISGVILFHESLYQKADDGTPFPELLKQRGIIPGIKVDSGVVPLFGSNDECTTQGLDDLAKRCAQYKKDGCHFAKWRCVLKISAQTPSIQSLIENANVLARYASICQANRIVPIVEPEILPDGGHDLLTCQKTTETVLAYVYKALADHNVYLEGTLLKPNMVTAGQSSANKATPAQVAEATVTALQRRLPPAVPGVTFLVWKTIPKKKLPST

SEQ ID NO: 20345 - protein, 185 aa, Diabrotica virgifera
  misc_feature: Coding regions on vcDNA: vcDNA=SeqID_42; Strand=-; Position=104-661
  misc_feature: Homolog annotation: Hit_ID=XP_320076.1; Match level="QueryCoverage =97%, HitCoverage=85%, E-value=2e-20, Identity=31%"; Hit description =ENSANGP00000012317 [Anopheles gambiae]
  misc_feature: Gene Ontology Annotation: Molecular function=lipid transporter activity; Cellular component=extracellular space; Biological process= lipid metabolism
  misc_feature: Pfam annotation: Pfam_ID=Lipocalin; Match level="Score=10.4, E-value =0.0021, Copies=1"; Pfam description=Lipocalin / cytosolic fatty-acid bind
MIGFAVTISLLVISVQGQIPVERCPDVKGVANFDGKAYLGDWFEQARYPTLLEDHGRCVVTNIAVNSNGSVKSRTQYINSETNETHVLEGEGISNSTTGEAKFLVHFLNPDVTVPFWILGTDYKRWSVGFSCFERDGVFLESLFLTTRHQYGSPDDIDAIVDVLEANNISRKEIIMTDQMGCDYD

SEQ ID NO: 20346 - protein, 564 aa, Diabrotica virgifera
  misc_feature: Coding regions on vcDNA: vcDNA=SeqID_43; Strand=+; Position=137-1831
  misc_feature: Homolog annotation: Hit_ID=AAG44924.1; Match level="QueryCoverage =100%, HitCoverage=100%, E-value=0.0, Identity=66%"; Hit description =phosphoglucomutase [Drosophila melanogaster]
  misc_feature: Gene Ontology Annotation: Molecular function=phosphoglucomutase activity; Cellular component=mitochondrion; Biological process =carbohydrate metabolism
  misc_feature: Pfam annotation: Pfam_ID=PGM_PMM_I; Match level="Score=171.5, E-value= 1.8e-48, Copies=1"; Pfam description =Phosphoglucomutase/phosphomannomutase
MALSSVDVETTAFEGQKPGTSGLRKKVKVFMEKHYTENFVQSIINALGDKAKGSTLIVGGDGRYFSKQAINIIIRIASANGVSKLLIGQLGILSTPAVSSLIRHHKVLGGIVLTASHNPGGIRNDFGIKYNIENGGPAPDQVSDAIYEHTKKIKSYKYTPKLETDRLIDILGTTAVKVDGRDFIVEVIDSTANYVALMKDIFDFKKLRTLIRGTEQRPPFNVLIDSMNGVTGVYVRRIFVEELGASPDNNVCRIVPLDNFGEIHPDPNLTYAKDLVDKVKANPSYDLGAAFDGDGDRNMIIGKNAFFVTPSDSLAVLANNLECIPYFQKHGVQGFARSMPTAAAVDRVAEKLGKEMFEVPTGWKYFGNLMDAGRISLCGEESFGTGSDHIREKDGIWAVLAWLSVIEQKNMSVEEILKEHWSIYGRNYFTRYDYEECESDAANDMMKHLENLIATNALVGKAFTAGGKSYKVSKADNFSYVDPIDNSVTKNQGIRILFDDGSRLIFRLSGTGSSGATIRVYIDSYEKKNVLSDAQEMLKPLVDVGLEISQLKKFTGRDAPTVIT

SEQ ID NO: 20347 - protein, 291 aa, Diabrotica virgifera
  misc_feature: Coding regions on vcDNA: vcDNA=SeqID_44; Strand=+; Position=500-1371
  misc_feature: Homolog annotation: Hit_ID=AAL89658.1; Match level="QueryCoverage =100%, HitCoverage=77%, E-value=1e-164, Identity=98%"; Hit description=cytoplasmic actin A3a1 [Helicoverpa zea] gb|AAL89657.1| cytoplasmic actin A3b [Helicoverpa zea] emb|CAA6
  misc_feature: Gene Ontology Annotation: Biological process=reproduction
  misc_feature: Pfam annotation: Pfam_ID=Actin; Match level="Score=587.2, E-value =1.3e-173, Copies=1"; Pfam description=Actin
  misc_feature (266)..(266): Xaa can be any naturally occurring amino acid
MCEEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPXLFLGMEANGIHETTYNSIMKCDVDI

SEQ ID NO: 20348 - protein, 192 aa, Diabrotica virgifera
  misc_feature: Coding regions on vcDNA: vcDNA=SeqID_45; Strand=-; Position=189-767
  misc_feature: Homolog annotation: Hit_ID=NP_787960.1; Match level="QueryCoverage =86%, HitCoverage=75%, E-value=5e-18, Identity=35%"; Hit description =CG33126-PA [Drosophila melanogaster] gb|AAF51378.2| CG33126-PA [Drosophila melanogaster]
  misc_feature: Gene Ontology Annotation: Molecular function=lipid transporter activity; Cellular component=extracellular space; Biological process= lipid metabolism
  misc_feature: Pfam annotation: Pfam_ID=Lipocalin; Match level="Score=-4.4, E-value =0.064, Copies=1"; Pfam description=Lipocalin / cytosolic fatty-acid bind
LRVTGSWTGWATSAVTFCLLVISAQGQIPVERCPDVEVVTNFNGSAYLGDWYEQARYPTLLEDHGRCVVTNIAVGDDRTIRSRTQYINSETNERHVLEGETQGSTTGEGKFIVHFLNPDVTVPFWVLGTDYESYSVGLSCFERDGAPLASLFISTRTPFPPKDLVDSILQVLDDNNFAIKPLIFTDQNECTY

SEQ ID NO: 20349 - protein, 376 aa, Diabrotica virgifera
  misc_feature: Coding regions on vcDNA: vcDNA=SeqID_46; Strand=+; Position=170-1300
  misc_feature: Homolog annotation: Hit_ID=AAL89658.1; Match level="QueryCoverage =100%, HitCoverage=100%, E-value=0.0, Identity=99%"; Hit description =cytoplasmic actin A3a1 [Helicoverpa zea] gb|AAL89657.1| cytoplasmic actin A3b [Helicoverpa zea] emb|CAA662
  misc_feature: Gene Ontology Annotation: Biological process=reproduction
  misc_feature: Pfam annotation: Pfam_ID=Actin; Match level="Score=940.8, E-value =4.7e-280, Copies=1"; Pfam description=Actin
MCEEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMEANGIHETTYNSIMKCDVDIRKDLYANTVLSGGTTMYPGIADRMQKEITSLAPSTMKIKIIAPPERKYSVWIGGSILASLSTFQQMWISKQEYDESGPSIVHRKCF

SEQ ID NO: 20350 - protein, 299 aa, Diabrotica virgifera
  misc_feature: Coding regions on vcDNA: vcDNA=SeqID_47; Strand=+; Position=660-1559
  misc_feature: Homolog annotation: Hit_ID=XP_318676.1; Match level="QueryCoverage =99%, HitCoverage=92%, E-value=1e-140, Identity=84%"; Hit description= ENSANGP00000022240 [Anopheles gambiae]
  misc_feature: Gene Ontology Annotation: Molecular function=estrogen receptor binding; Cellular component=cellular_component unknown; Biological process=negative regulation of transcription
  misc_feature: Pfam annotation: Pfam_ID=Band_7; Match level="Score=216.2, E-value =6.3e-62, Copies=1"; Pfam description=SPFH domain / Band 7 family
MAQNKLNDLAGKFGKGGPPGLGIGLKLLAVGGAAAYGISQSMYTVEGGHRAIMFNRIGGVQKEIYTEGLHFRIPWFQYPIIYDIRSRPRKISSPTGSKDLQMVNISLRVLSRPMAASLPVIYRQLGLDYDEKVLPSICNEVLKSVVAKFNAAQLITQRQQVSLLVRRELVERAQDFNIILDDVSITDLSFGKDYTAAVESKQVAQQEAQRAAFVVEKAKQERQQKIVQAEGEAEAAKMLGEAIGRNPGFLKLRKIRAAQNISRTIANSQNKVYLSGNSLMLNISDKEFDDMSEKLQSKK

SEQ ID NO: 20351 - protein, 147 aa, Diabrotica virgifera
  misc_feature: Coding regions on vcDNA: vcDNA=SeqID_48; Strand=-; Position=225-668
  misc_feature: Homolog annotation: Hit_ID=P51909; Match level="QueryCoverage=87%, HitCoverage=68%, E-value=6e-11, Identity=29%"; Hit description =Apolipoprotein D precursor (Apo-D) (ApoD) gb|AAB35199.1| apolipoprotein D; apoD [Cavia]
  misc_feature: Gene Ontology Annotation: Molecular function=lipid transporter activity; Cellular component=extracellular space; Biological process= lipid metabolism
ENTISFKARYPTLLEDHGECVVTNIALDLNGVVKSRTTYTNSETREVHVLEGEGVSNSTTGEAKFLVHFLNPDVTVPFWVLGTDYTTYSVGFSCFERDGVFLESLFLTTRHQYVTEDDIDNLVKVLIDNNLSVDDLVVDSQDYCYYK

SEQ ID NO: 20352 - protein, 803 aa, Diabrotica virgifera
  misc_feature: Coding regions on vcDNA: vcDNA=SeqID_49; Strand=+; Position=1438-3846
  misc_feature: Homolog annotation: Hit_ID=AAA92124.2; Match level="QueryCoverage =65%, HitCoverage=58%, E-value=2e-48, Identity=28%"; Hit description =ORF1 [Drosophila virilis]
  misc_feature: Pfam annotation: Pfam_ID=RVT_1; Match level="Score=0.3, E-value =0.00013, Copies=1"; Pfam description=Reverse transcriptase (RNA -dependent
MDSHMQPIQYLNNARPATLLHRYKELNIKKMLQKSKIFYNNECLRLNLLPSYARGRLRELNFNATKAKQVKILGRSIIRDEIRKLYQHIYTIDLQLKTIYNSLHRRMTALEFDECMRDLHGTINFHRSRQYRKLHDKIKKLKFITHRVNNNIILSNQSVFSQLNNDQLVVDSNSNGSYIVTPSNFTNSDLYTSERLLNVTTNTSLSDLPDQTHSINTSISSDPDNIFDGSEQHTFYTPFINYSNVVFSNNELSLLQKGFKFNPPQSSKKQQLRNLELLGVESESILQSIPLENTEEIRSSLKVLLKKEKEAICNNRKGYHRNPLNEYKDTIKSIDKKISENNLTITKADKGSTVVVLHTQDYHQKVTNFILDNQFLTKSVNINTFTTKVRTAINKITEVFDNTTKKKLLPSKANVPRLYGLMKIHKTDVFENIPIRPVVSFTDSPTHALASHLNKFLKTFYNNKFDYVVSNNLSLTNKITEVNLSNEDLLISLDITNLFTNIPTQEVISIVALDLWNNNYHPNQIIEYTELLNLCLSQNFFNFNNTTYVQPDGLAMGSPLSPILADIFLNDLESNKIVKNNPFTDYIKFYARYVDDTLIIWNGTIDILHDFLDFLNTLHDTIKFTLEIQNDSKSLNFLDLTLTLRNGTIDFGIYRKPTHTGTVIPADSHHPIQHKLAAFYSYINRLVSIPLTTTSFNKELKIIQQIAVNNGYTVDLVNKILHKKTNRILEHRVYTQPILVEQEPKPYRSLTFTGQFSYKLAHIFKYYCNISFRTNSNLGLVFLNNKDSRDRSECCGVYELGRV

SEQ ID NO: 20353 - protein, 126 aa, Diabrotica virgifera
  misc_feature: Coding regions on vcDNA: vcDNA=SeqID_50; Strand=+; Position=134-514
  misc_feature: Homolog annotation: Hit_ID=AAS50159.2; Match level="QueryCoverage =100%, HitCoverage=100%, E-value=4e-62, Identity=92%"; Hit description=profilin [Apis mellifera] sp|Q6QEJ7|PROF_APIME Profilin
  misc_feature: Gene Ontology Annotation: Molecular function=actin monomer binding; Cellular component=actin filament; Biological process=cell organization and biogenesis
  misc_feature: Pfam annotation: Pfam_ID=Profilin; Match level="Score=202.4, E-value =8.9e-58, Copies=1"; Pfam description=Profilin
MSWQDYVDKQLLASKCVTKAAIAGHDGNVWAKSENFDVSKEELAKLVQGFEKQDILTSSGVTLAGNRYIYLSGTDRVIRAKLGKVGVHCMKTTQAVVVSLYEDPIQPQQAASVVEKLGDYLITCGY

SEQ ID NO: 20354 - protein, 339 aa, Diabrotica virgifera
  misc_feature: Coding regions on vcDNA: vcDNA=SeqID_51; Strand=-; Position=861-1880
  misc_feature: Homolog annotation: Hit_ID=XP_318849.1; Match level="QueryCoverage =87%, HitCoverage=72%, E-value=5e-80, Identity=46%"; Hit description =ENSANGP00000014456 [Anopheles gambiae]
  misc_feature: Gene Ontology Annotation: Molecular function=calcium ion binding; Cellular component=nucleus; Biological process=limb morphogenesis
  misc_feature: Pfam annotation: Pfam_ID=C_tripleX; Match level="Score=76.5, E-value =7e-20, Copies=6"; Pfam description=Cysteine rich repeat
WPFSLLSQSVEAAQLQGVARNNSRRGICTLEVPTIDLIPAEDRHGVIPRGNGSRNGYSKIDVCCSGYERVPRTHLQCEPVCDHCENGNCTSPGHCECKRGWIHDPYHKDCIPTCPERCLNGVCTITGQCSCNAGNTLSSSGKYCLPHCSGGCGVGGNCVGPETCACDKGFSLDARTRKCNYHCEGGCGEGSCIGPNQCSCKPGYRQAGHSCVADCPRGCHNGDCVAPNRCSCKAGWALDGTGTVCTPHCNNPCLNGDCVAPNQCKCKEGYIEAPNSIRSQTCVAHCPGGCPNGSCTAPNFCICNPGYVKERKGSNNCVRRVRRSLMHMELIPEAVLEGL

SEQ ID NO: 20355 - protein, 367 aa, Diabrotica virgifera
  misc_feature: Coding regions on vcDNA: vcDNA=SeqID_52; Strand=-; Position=154-1257
  misc_feature: Homolog annotation: Hit_ID=EAL40174.1; Match level="QueryCoverage =97%, HitCoverage=98%, E-value=1e-125, Identity=60%"; Hit description= ENSANGP00000027966 [Anopheles gambiae str. PEST] ref|XP_557484.1| ENSANGP00000027966 [Anopheles gambiae s
  misc_feature: Gene Ontology Annotation: Molecular function=phosphoserine transaminase activity; Cellular component=cellular_component unknown; Biological process=serine biosynthesis
  misc_feature: Pfam annotation: Pfam_ID=Aminotran_5; Match level="Score=235.4, E -value=1.1e-67, Copies=1"; Pfam description=Aminotransferase class-V
MGSAQSALNFGAGPAKLPREVLEEVQKEFLSYQDSGMSLIEMSHRGKEYTKINKDSQAVIRELLNVPDNYKILLMQGGGCGAFAAVAMNLLNRTGTADYAVTGTWSDKAAKEASKYGNVNLVFPKASKPGSVPPQNTWKMNPNASYVYYCDNETVDGVAFHYIPETNGVPLVTDMSSSIMTKKLDISKFGCIIAGAQKNIGPAGVVVVIVREDLLGNPMKCCPSVMDFTHIAKENSVHNTPATFSVYVMEKVLQWIKKNGGLEAMENQAIEKSSLLYNAMVESKGFYTCPIDEDVRSRMNVPFRVGGGNEKLEELFLVEAEKVKMYQLKGHRSVGGIRASLYNAVTLDDVKLLVKFMKEFQAQHGSK

SEQ ID NO: 20356 - protein, 283 aa, Diabrotica virgifera
  misc_feature: Coding regions on vcDNA: vcDNA=SeqID_53; Strand=+; Position=149-1000
  misc_feature: Homolog annotation: Hit_ID=XP_321264.1; Match level="QueryCoverage =100%, HitCoverage=99%, E-value=1e-136, Identity=92%"; Hit description=ENSANGP00000008408 [Anopheles gambiae]
  misc_feature: Gene Ontology Annotation: Molecular function=molecular_function unknown; Cellular component=muscle thin filament tropomyosin; Biological process=pole plasm oskar mRNA localization
  misc_feature: Pfam annotation: Pfam_ID=Tropomyosin; Match level="Score=504.5, E -value=1.1e-148, Copies=1"; Pfam description=Tropomyosin
MDAIKKKMQAMKLEKDNALDRAAHNEQLAKDANLRAEKAEEEARSLQKKIQAIENDLDQTQEQLTQVNGKLEEKEKALQNAESEVAALNRRIQLLEEDLERSEERLATATAKLAEASQAADESERQRKVLENRSLADEERMDALENQLKEARFLAEEADKKYDEVARKLAMVEADLERAEERAEAGESKIVELEEELRVVGNNLKSLEVSEEKANQREEEYKNQIKNLTTRLKEAEARAEFAERSVQKLQKEVDRLEDELVAEKERYKEIGDDLDTAFVELIL

SEQ ID NO: 20357 - protein, 346 aa, Diabrotica virgifera
  misc_feature: Coding regions on vcDNA: vcDNA=SeqID_54; Strand=+; Position=428-1465
  misc_feature: Homolog annotation: Hit_ID=XP_393562.1; Match level="QueryCoverage =100%, HitCoverage=83%, E-value=0.0, Identity=97%"; Hit description =similar to ENSANGP00000009996 [Apis mellifera]
  misc_feature: Gene Ontology Annotation: Biological process=reproduction
  misc_feature: Pfam annotation: Pfam_ID=Actin; Match level="Score=761.4, E-value =4.9e-226, Copies=1"; Pfam description=Actin
MCDDDVAALVVDNGSGMCKAGFAGDDAPRAVFPSIVGRPRHQGVMVGMGQKDSYVGDEAQSKRGILTLKYPIEHGIITNWDDMEKIWHHTFYNELRVAPEEHPVLLTEAPLNPKANREKMTQIMFETFNTPAMYVAIQAVLSLYASGRTTGIVLDSGDGVTHTVPIYEGYALPHAILRLDLAGRDLTDYLMKILTERGYSFTTTAEREIVRDIKEKLCYVALDFEQEMATAAASTSLEKSYELPDGQVITIGNERFRCPEALFQPSFLGMESCGIHETVYNSIMKCDVDIRKDLYANTVLSGGTTMYPGIADRMQKEITALAPSTHQIKIIAPPERNTPSGSVDPS

SEQ ID NO: 20358 - protein, 442 aa, Diabrotica virgifera
  misc_feature: Coding regions on vcDNA: vcDNA=SeqID_55; Strand=+; Position=336-1662
  misc_feature: Homolog annotation: Hit_ID=CAC51707.1; Match level="QueryCoverage =100%, HitCoverage=99%, E-value=1e-144, Identity=55%"; Hit description=NADH dehydrogenase subunit 4 [Tribolium castaneum] ref|NP_203163.1|ND4_15766 NADH dehydrogenase subunit
  misc_feature: Pfam annotation: Pfam_ID=Oxidored_q1; Match level="Score=248.3, E -value=1.4e-71, Copies=1"; Pfam description=NADH -Ubiquinone/plastoquinone (comple
  misc_feature (19)..(19): Xaa can be any naturally occurring amino acid
  misc_feature (57)..(57): Xaa can be any naturally occurring amino acid
  misc_feature (67)..(67): Xaa can be any naturally occurring amino acid
  misc_feature (115)..(115): Xaa can be any naturally occurring amino acid
  misc_feature (131)..(131): Xaa can be any naturally occurring amino acid
  misc_feature (190)..(190): Xaa can be any naturally occurring amino acid
  misc_feature (294)..(294): Xaa can be any naturally occurring amino acid
  misc_feature (345)..(345): Xaa can be any naturally occurring amino acid
  misc_feature (428)..(428): Xaa can be any naturally occurring amino acid
MIRFLFRLIFLIPLCFKKXFLINSMINIFFLHFYFFFNYGRGLNYFSISNILGIDFXSYSLILLRFXVCTLIILARGKLYKYGIYSNLFLLVLIFLILSLYLVFSSLNIFIFYLXFFEIRLVPVLLLIIGXGYQPERLEAGIYLLFYTLLISLPIIIIIFYLNEKFYCISFLLIDLSLNRIFIYLCINIXFFVKIPIFFLHLWLPKAHVEAPVSGSIILAGIILKLGGYGLLRFIVFFKYFLSLNIFFISLSLLGGFIVSMICIRQRDIKSLIAYSSVSHIRLVLGGILAINIXGFYGALFIILAHGLCSSGLFCLANIFYERIHSRRIYLNKGLLNIIPNLRLXIFLLLSSNIAAPPSLNLMREIILINSIVGFNFLTILFLSLISFFRAVYSLFLYRYSQHGIFFSGAYSFYNGLIREYILLLLHXLPLNIIFLKIEIFI

SEQ ID NO: 20359 - protein, 364 aa, Diabrotica virgifera
  misc_feature: Coding regions on vcDNA: vcDNA=SeqID_56; Strand=+; Position=425-1520
  misc_feature: Homolog annotation: Hit_ID=AAT01078.1; Match level="QueryCoverage =100%, HitCoverage=100%, E-value=1e-157, Identity=76%"; Hit description=putative fructose 1,6-bisphosphate aldolase [Homalodisca coagulata]
  misc_feature: Gene Ontology Annotation: Molecular function=fructose-bisphosphate aldolase activity; Biological process=fructose metabolism
  misc_feature: Pfam annotation: Pfam_ID=Glycolytic; Match level="Score=867.0, E -value=8e-258, Copies=1"; Pfam description=Fructose-bisphosphate aldolase class-
  misc_feature (83)..(83): Xaa can be any naturally occurring amino acid
MTTSWNYPDAALRAELKKIADAITAPGKGILAADESTATVGKRFADIGVENNEENRRKYRQLLFTTDPAIGQYISGVILFHEXLYQKADDGTPFPELLKQRGIIPGIKVDSGVVPLFGSNDECTTQGLDDLAKRCAQYKKDGCHFAKWRCVLKISAQTPSIQSLIENANVLARYASICQANRIVPIVEPEILPDGGHDLLTCQKTTETVLAYVYKALADHNVYLEGTLLKPNMVTAGQSSANKATPAQVAEATVTALQRRLPPAVPGVTFLSGGQSEEEATVNLNAINQFPGKRPWALTFSYGRALQASVLRAWGGKDENVKAGQEELMKRAKANSEASLGKYVAGSVSGKAGDAGLFIKDHAY

SEQ ID NO: 20360 - protein, 374 aa, Diabrotica virgifera
  misc_feature: Coding regions on vcDNA: vcDNA=SeqID_57; Strand=-; Position=204-1328
  misc_feature: Homolog annotation: Hit_ID=XP_312115.1; Match level="QueryCoverage =94%, HitCoverage=93%, E-value=1e-100, Identity=51%"; Hit description= ENSANGP00000017017 [Anopheles gambiae] gb|EAA07707.1| ENSANGP00000017017 [Anopheles gambiae
  misc_feature: Pfam annotation: Pfam_ID=Glyco_hydro_16; Match level="Score=-14.1, E -value=9.4e-07, Copies=1"; Pfam description=Glycosyl hydrolases family 16
MILILFAFSAILFNGVHSVCLKNSITTASGLHAPKNKSLCSGQLIFEDNFNFLDTSKWHHEQTLSGGGNNEFEWYTDDRRNSYTSNGQLHIKPTFVADEYGEDFLYSGTIDIGAACTGGDNEGCRRTGSPNAIVNPIVSARMRTLHSFSFKYGRVEVNAKIPSGDWLWPAVWMLPTNWEYGNWPASGEIDIMESRGNRQYYAPNGQNVGTATESSTLHWGPTPQFNKQLKTHWEKINYNGGWDNAFHRYQVEWTPEHIKFSCDDQELGTITPPSGGFWEYGDLGPSGLPNPWSGGTRMAPFDKEFHLIINLAIGGAYFNDEFDNKAYKKPWTSTEPYRQGMTKFWQANQKWKPTWNLNSDDSHLKVDYVRVWAL

SEQ ID NO: 20361 - protein, 283 aa, Diabrotica virgifera
  misc_feature: Coding regions on vcDNA: vcDNA=SeqID_58; Strand=+; Position=147-998
  misc_feature: Homolog annotation: Hit_ID=AAN10050.1; Match level="QueryCoverage =100%, HitCoverage=94%, E-value=7e-61, Identity=49%"; Hit description= Y-box protein Ct-p50 [Chironomus tentans]
  misc_feature: Gene Ontology Annotation: Molecular function=DNA binding; Cellular component=nucleus; Biological process=negative regulation of transcription from Pol II promoter
  misc_feature: Pfam annotation: Pfam_ID=CSD; Match level="Score=131.5, E-value=2e -36, Copies=1"; Pfam description='Cold-shock' DNA-binding domain
AVPKQKEVLATKVTGTVKWFNVKSGYGFINRNDTKEDVFVHQSAIIKNNPKKAVRSVGDGEVVEFSVVVGEKGNEAANVTGPNGDPVRGSPYAADRRRGYRQWYYPRGRRGRRGGSRGGGPPRESQSEGELKDGVQSGGEGGQGGQGPPRRYAPRRGRGGYSYYRGPYRGPPGELEQNGDAPRGRRPPRGFFRRNYRGGRGGARPRSQDSQGQAGELNGQEGGPRGPRGPRYRRRGPARPRAGNSQSESAGGNQPNTKVPEKAVSDKTEESQPVQNTTTESSA

SEQ ID NO: 20362 - protein, 559 aa, Diabrotica virgifera
  misc_feature: Coding regions on vcDNA: vcDNA=SeqID_59; Strand=+; Position=56-1796
  misc_feature: Homolog annotation: Hit_ID=EAA12037.2; Match level="QueryCoverage =97%, HitCoverage=96%, E-value=1e-164, Identity=54%"; Hit description= ENSANGP00000001916 [Anopheles gambiae str. PEST] ref|XP_555874.1| ENSANGP00000001916 [Anopheles gambiae s
  misc_feature: Gene Ontology Annotation: Molecular function=monooxygenase activity; Cellular component=extracellular space; Biological process =leukotriene metabolism
  misc_feature: Pfam annotation: Pfam_ID=p450; Match level="Score=329.7, E-value=4.4e- 96, Copies=1"; Pfam description=Cytochrome P450
MSQPVVQPLETETSSILTSNIPLILIGIISVLLGYQYWFKNQRYVQMGNKFPGPATLPFIGNAHLAFGKSAHGLFELAMAYYKELQIDVGRIWLGPRLIIGVANADDIEIILGNSVHLEKSPDYGLFEPWLGDGLLISKGEKWRSHRKMIAPTFHTSILKSFMPVFNRNATALVETFRKEQGKVFDCHDYLSSTTVDTLLETAMGVTKEHDSKAGFDYAMAVMRMCNILHLRHMKFWLRPDTIFNFTKLSNIQVNLLKVIHDLTNGTIKRKKANYFEREKSGEKSLYEQAVKTSKFDEKQGNLIETRDLMSNLLRDDLDENEENDVGEKKRLAFLDYLIEASQTKGNALSDKEINEEVNTIMFEGHDTTAAASSFVISLLGIHQDVQERAFNELKEIFSDNLHRPVTFNDTLHMKYLERVILESLRMYPPVPMIARKVNEDVKLASGDYTIPAGTTVIVSQYILHRNEKYYKNPTVFDPDNFLPEKCQERPYYAFIPFSAGPRSCVGRKYAMLKLKVLLADVIRKFHIESVDKETDFRLQGDIILKREEGFRVKVTERA

SEQ ID NO: 20363 - protein, 376 aa, Diabrotica virgifera
  misc_feature: Coding regions on vcDNA: vcDNA=SeqID_60; Strand=+; Position=738-1868
  misc_feature: Homolog annotation: Hit_ID=NP_727048.1; Match level="QueryCoverage =100%, HitCoverage=100%, E-value=0.0, Identity=99%"; Hit description =CG4027-PA, isoform A [Drosophila melanogaster] ref|NP_511052.1| CG4027-PB, isoform B [Drosophila
  misc_feature: Gene Ontology Annotation: Biological process=reproduction
  misc_feature: Pfam annotation: Pfam_ID=Actin; Match level="Score=941.8, E-value =2.4e-280, Copies=1"; Pfam description=Actin
MCEEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMEAAGIHETTYNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 20364 - protein, 485 aa, Diabrotica virgifera
  misc_feature: Coding regions on vcDNA: vcDNA=SeqID_61; Strand=-; Position=184-1642
  misc_feature: Homolog annotation: Hit_ID=Q9U639; Match level="QueryCoverage=98%, HitCoverage=72%, E-value=0.0, Identity=88%"; Hit description=Heat shock 70 kDa protein cognate 4 (Hsc 70-4) gb|AAF09496.1| heat shock cognate 70 protein
  misc_feature: Gene Ontology Annotation: Molecular function=protein binding; Biological process=reproduction
  misc_feature: Pfam annotation: Pfam_ID=HSP70; Match level="Score=879.7, E-value =1.2e-261, Copies=1"; Pfam description=Hsp70 protein
  misc_feature (248)..(248): Xaa can be any naturally occurring amino acid
  misc_feature (443)..(443): Xaa can be any naturally occurring amino acid
MAKAPAVGIDLGTTYSCVGVFQHGKVEIIANDQGNRTTPSYVAFTDTERLIGDAAKNQVAMNPNNTIFDAKRLIGRRFDDSAVQSDMKHWPFEVVNDAGKPKIKVAYKGEDKSFYPEEVSSMVLTKMKETAEAYLGKNVTNAVITVPAYFNDSQRQATKDAGTIAGLQVLRIINEPTAAAIAYGLDKKGQGERNVLIFDLGGGTFDVSILTIEDGIFEVKSTAGDTHLGGEDFDNRMVNHFVGEFKRXYKKDLTTNKRALRRLRTSCERAKRTLSSSTQASIEIDSLFEGIDFYTSITRARFEELNADLFRSTMEPVEKAIRDAKMDKSQVHDIVLVGGSTRIPKVQKLLQDFFNGKELNKSINPDEAVAYGAAVQAAILHGDKSEEVQDLLLLDVTPLSLGIETAGGVMTALIKRNTTIPTKQTQTFPYITLNNPTRENLVXESERGNVAWNKSTTNLLGKNVELNGHSLPPPPGGGPQKKNNP

SEQ ID NO: 20365 - protein, 377 aa, Diabrotica virgifera
  misc_feature: Coding regions on vcDNA: vcDNA=SeqID_62; Strand=+; Position=996-2127
  misc_feature: Homolog annotation: Hit_ID=AAV65298.1; Match level="QueryCoverage =100%, HitCoverage=100%, E-value=0.0, Identity=99%"; Hit description =actin [Apriona germari]
  misc_feature: Gene Ontology Annotation: Biological process=reproduction
  misc_feature: Pfam annotation: Pfam_ID=Actin; Match level="Score=923.5, E-value =7.7e-275, Copies=1"; Pfam description=Actin
  misc_feature (86)..(86): Xaa can be any naturally occurring amino acid
MCDDDVAALVVDNGSGMCKAGFAGDDAPRAVFPSIVGRPRHQGVMVGMGQKDSYVGDEAQSKRGILTLKYPIEHGIITNWDDMEKXIWHHTFYNELRVAPEEHPVLLTEAPLNPKANREKMTQIMFETFNTPAMYVAIQAVLSLYASGRTTGIVLDSGDGVTHTVPIYEGYALPHAILRLDLAGRDLTDYLMKILTERGYSFTTTAEREIVRDIKEKLCYVALDFEQEMATAAASTSLEKSYELPDGQVITIGNERFRCPEALFQPSFLGMESCGIHETVYNSIMKCDVDIRKDLYANTVLSGGTTMYPGIADRMQKEITALAPSTIKIKIIAPPERKYSVWIGGSILASLSTFQQMWISKQEYDESGPGIVHRKCF

SEQ ID NO: 20366 - protein, 462 aa, Diabrotica virgifera
  misc_feature: Coding regions on vcDNA: vcDNA=SeqID_63; Strand=-; Position=870-2258
  misc_feature: Homolog annotation: Hit_ID=AAR89978.1; Match level="QueryCoverage =100%, HitCoverage=100%, E-value=0.0, Identity=95%"; Hit description =putative elongation factor 1-alpha [Homalodisca coagulata] gb|AAS60203.1| putative elongation factor 1-alp
  misc_feature: Gene Ontology Annotation: Molecular function=translation factor activity, nucleic acid binding
  misc_feature: Pfam annotation: Pfam_ID=GTP_EFTU; Match level="Score=371.1, E-value =1.4e-108, Copies=1"; Pfam description=Elongation factor Tu GTP binding doma
MGKEKIHINIVVIGHVDSGKSTTTGHLIYKCGGIDKRTIEKFEKEAQEMGKGSFKYAWVLDKLKAERERGITIDIALWKFETAKYYVTIIDAPGHRDFIKNMITGTSQADCAVLIVAAGTGEFEAGISKNGQTREHALLAFTLGVKQLIVGVNKMDSTEPAYSESRFEEIKKEVSSYIKKIGYNPAAVAFVPISGWHGDNMLEGSDKMPWFKGWQIERKEGKAEGKCLIEALDAILPPSRPTEKPLRLPLQDVYKIGGIGTVPVGRVETGVLKPGMVVVFAPANLTTEVKSVEMHHEALQEAVPGDNVGFNVKNVSVKELRRGYVAGDTKNNPPRGASDFTAQVIVLNHPGQISNGYTPVLDCHTAHIACKFAEIKEKVDRRSGKTTEENPKAIKSGDAAIVNLVPTKPMCVESFQEFPPLGRFAVRDMRQTVAVGVIKSVAFKDPSAGKVTKAAEKAQKKK

SEQ ID NO: 20367 - protein, 508 aa, Diabrotica virgifera
  misc_feature: Coding regions on vcDNA: vcDNA=SeqID_64; Strand=+; Position=150-1676
  misc_feature: Homolog annotation: Hit_ID=XP_320877.1; Match level="QueryCoverage =99%, HitCoverage=90%, E-value=0.0, Identity=73%"; Hit description =ENSANGP00000019195 [Anopheles gambiae]
  misc_feature: Gene Ontology Annotation: Molecular function=dihydrolipoamide dehydrogenase activity; Cellular component=mitochondrion; Biological process=energy pathways
  misc_feature: Pfam annotation: Pfam_ID=Pyr_redox; Match level="Score=327.5, E-value= 2e-95, Copies=1"; Pfam description=Pyridine nucleotide-disulphide oxidor
MQCSVFKVLSSTIKPTLRHNQRILGNLQSRLYSNDGDADIVVIGSGPGGYVAAIKAAQLGMKTVCIEKNPTLGGTCLNVGCIPSKALLNNSHFYHMAHSGDLTERGIETSGVNLNLDAMMGQKVKAVTSLTGGIAQLFKKNKVTLIKGHGKITGPNQVTAAKEDGSTEVVNTKNILIATGSEVTPFPGIETDEETIVTSTGALSLGKVPQRLIVIGAGVIGLELGSVWSRLGSEVTAIEFLPSIGGAGIDAEVAKSLQKILSKQGLKFKLGTKVTGASREGGVIKVNIEDGKDSSKTEVLDCDVLLVCVGRRPFTEGLGLEEMGIAKDQKGRIPVNSHFQTVIPSIYAIGDCIHGPMLAHKAEDEGVACVEGLQGGPVHIDYNCVPSVIYTHPEVGWVGKTEEDLKNEGIAYKVGKFPFMANSRAKTNNDTDGFVKVLADKATDRILGTHIIGPGAGELINEAVLGQEYGASSEDIARVCHAHPTCSEALREANLAAYCGKPIKFSNS

SEQ ID NO: 20368 - protein, 271 aa, Diabrotica virgifera
  misc_feature: Coding regions on vcDNA: vcDNA=SeqID_65; Strand=+; Position=400-1211
  misc_feature: Homolog annotation: Hit_ID=XP_395799.1; Match level="QueryCoverage =64%, HitCoverage=39%, E-value=2e-78, Identity=82%"; Hit description =similar to DAPK-interacting protein 1; ubiquitin ligase mind bomb [Apis mellifera]
  misc_feature: Gene Ontology Annotation: Molecular function=structural constituent of cytoskeleton; Cellular component=plasma membrane; Biological process=protein targeting
  misc_feature: Pfam annotation: Pfam_ID=Ank; Match level="Score=96.7, E-value=6e-26, Copies=3"; Pfam description=Ankyrin repeat
  misc_feature (181)..(181): Xaa can be any naturally occurring amino acid
LSSKPTYFLLCLIAYFCLSYSAMKILLAKLPRPWIVDEKKDDGYTALHLAALNNHVEVAEQLVLNGKANMDLQNVNLQTALHLAVERQHTQIVRLLVREGANLNVADKDGDTPLHEALRHHTLSQLRQLQDVQDVGKLLMGLGTQGSDKKSSASIACFLAGNGADLTHQEQERQHPLDLCXDPNLCKILTKCQKEKQKGEMGIGFPPKTSKTPTKTSKLKKGFGLVRNAKKGKISLPPLFKSLFICFFPGGGPQKSIKKGPFFFQKNTCPP

SEQ ID NO: 20369 - protein, 235 aa, Diabrotica virgifera
  misc_feature: Coding regions on vcDNA: vcDNA=SeqID_66; Strand=+; Position=23-730
  misc_feature: Homolog annotation: Hit_ID=NP_649639.1; Match level="QueryCoverage =84%, HitCoverage=68%, E-value=1e-45, Identity=47%"; Hit description =CG1169-PA [Drosophila melanogaster] gb|AAF51889.2| CG1169-PA [Drosophila melanogaster]
  misc_feature: Pfam annotation: Pfam_ID=DUF1676; Match level="Score=53.1, E-value =7.7e-13, Copies=1"; Pfam description=Protein of unknown function (DUF1676)
MFSVYFFVGLTILAATQASSPANPSAVELLQDVYYDCLQDFSFGCVKPKTLHWLSEVTSNQNIRITDNLMIVKKGGAESVQERGFSDDIFEKFEDFLQSHELVMSAPEFLPRSLDTKEIRVPLAVTGRSSKIVKKVIVPFLLGLKFKTAILVPLALALIALKTWKALTLGLLSLVLTGALVIFKFTKPKVVNYEVVHVPHHVEHHVDHPPSSGWEHPGYGRQLTANEMAYNAHLD

SEQ ID NO: 20370 - protein, 572 aa, Diabrotica virgifera
  misc_feature: Coding regions on vcDNA: vcDNA=SeqID_67; Strand=+; Position=106-1821
  misc_feature: Homolog annotation: Hit_ID=BAD11812.1; Match level="QueryCoverage =100%, HitCoverage=93%, E-value=0.0, Identity=85%"; Hit description =ribonuclease L inhibitor homolog [Bombyx mori]
  misc_feature: Gene Ontology Annotation: Molecular function=ATP-binding cassette (ABC) transporter activity; Cellular component=cellular_component unknown; Biological process=biological_process unknown
  misc_feature: Pfam annotation: Pfam_ID=ABC_tran; Match level="Score=144.9, E-value =1.8e-40, Copies=2"; Pfam description=ABC transporter
MSKRKGMEESDKLTRIAIVNADKCKPKRCRQECKKSCPVVRLGKLCIEVVPNSKIATISEELCIGCGICVKKCPFEAIAIINLPSNLQKETTHRYGKNSFKLHRLPIPRPGEVLGLVGTNGIGKSTALKILAGKQKPNLGRYMDPPDWTEILSHFRGSELQNYFTKILEDDLKALIKPQYVDQIPKAVKGTVGQLLDRKNELDNMNQICGMLDLLHIKEREIAALSGGELQRFACAMVCIQNGDIFMFDEPSSYLDVKQRLNAARTIRSLIDPSNSRFIIVVEHDLSVLDYLSDFICCLYGVPGAYGVVTMPFSVREGINIFLDGFVPTENLRFRDESLVFKVAESATEEEIKRMNHYEYPTMTKTMGSFELKVAQGQFSDSEILVLLGENGTGKTTFIRMLAGNLEPDSGSGELPQLHISYKPQKISPKSTGLVRQLLHEKIRDAYIHPQFIADVMKPLKIEDIIDQEVQNLSGGELQRVAMTLCLGKPADVYLVDEPSAYLDSEQRLVAAKVIKRFILHAKKTGFVVEHDFIMATYLADRVIVFEGSPSVKTTAHAPQNLLAGMNRFLEL

SEQ ID NO: 20371 - protein, 366 aa, Diabrotica virgifera
  misc_feature: Coding regions on vcDNA: vcDNA=SeqID_68; Strand=+; Position=3-1100
  misc_feature: Homolog annotation: Hit_ID=XP_393771.1; Match level="QueryCoverage =97%, HitCoverage=55%, E-value=9e-67, Identity=41%"; Hit description =similar to anaphase-promoting complex subunit 5; periodontal ligament fibroblast protein [Apis
  misc_feature: Pfam annotation: Pfam_ID=TPR_2; Match level="Score=34.9, E-value=2.4e- 07, Copies=2"; Pfam description=Tetratricopeptide repeat
HFLSYLNYLRVDEYCGSVDSLFHCFDRNVDPDVKCYNDEKSKRHRFAALNLAILHYHFGHIEEALAALRESIKISQEANDNVCLQHALSWLYRLTTVNEDKLIIHCILKSSELKLSYTASLGLQTFGQYECLNTGKTYAIFETLGRSDMLNCQHNYKDLTSNNYAMKASLWQLYGKNEMCSLWSQLLLYQNMDSLTPSKGYYGEGFCLAVCNIANNLMVEGEYTLGHCVLNFAKSRFPNEPHSVIWKLCENMFLYQMSLYHEQFEEAEAAAQKIMVFDKWEGYLRLGEVHFYQRNYVQADTYVETLLNQYENDNTYKFSDRYYYVRAKVLKMEIQFATTYPDSISAGIMTVLNILLMSHSFSFDYH

SEQ ID NO: 20372 - protein, 60 aa, Diabrotica virgifera
  misc_feature: Coding regions on vcDNA: vcDNA=SeqID_69; Strand=-; Position=442-624
FSDRLYGPNERQTKFFIFDTCFKLCSVVIYNIFFEFKILCKFPITKEPIFTKEFYNVLVH

SEQ ID NO: 20373 - protein, 141 aa, Diabrotica virgifera
  misc_feature: Coding regions on vcDNA: vcDNA=SeqID_70; Strand=+; Position=732-1157
ITTEHNLEPVSKIKKFCLSFVWPLKTTTNSTYTSHPKTRRDVTPLYVYILRCIYNFKLDIINVSKKYSYVTLKCSDRLNIHRKLYFYKMVLFSVVNLLSFPSITISNSNVNKLGIYYYNDIRYMLIEYKYFSFISRRGIPK

SEQ ID NO: 20374 - protein, 72 aa, Diabrotica virgifera
  misc_feature: Coding regions on vcDNA: vcDNA=SeqID_71; Strand=-; Position=608-826
NIQGVSKKIKIFYSFPVQPEAIFLVKFIVIIDNKVPYMSAKFQILVSIKKEVTGTRIFFHKKFITPLLWGGV

SEQ ID NO: 20375 - protein, 160 aa, Diabrotica virgifera
  misc_feature: Coding regions on vcDNA: vcDNA=SeqID_72; Strand=+; Position=1015-1497
WKEDQFDNEEYFDQCVEINRNIWDNEDELDMYEDLPVVIIDLLDSPTPSDDTMEMMNITNRKDTEKRIFISYETNIMSSIWSTDQDVTIDNNFNSTIDASQNVANNTKLTVDFQFSEISIYNPSVKSSFDDWPPANSIVENDTNALLETNKVLDINIFLQ

SEQ ID NO: 20376 - protein, 77 aa, Diabrotica virgifera
  misc_feature: Coding regions on vcDNA: vcDNA=SeqID_73; Strand=+; Position=421-654
TKLNLFLLHCHSIQTSYDKQILSYIGIIKCLIYFLRLLTKKIPSTFLTSTPNHLNHKNKSKDMYKLIFLWCYALLYT

SEQ ID NO: 20377 - protein, 295 aa, Diabrotica virgifera
  misc_feature: Coding regions on vcDNA: vcDNA=SeqID_74; Strand=+; Position=42-927
  misc_feature: Homolog annotation: Hit_ID=XP_393185.1; Match level="QueryCoverage =93%, HitCoverage=43%, E-value=1e-99, Identity=65%"; Hit description =similar to ENSANGP00000022165 [Apis mellifera]
  misc_feature: Gene Ontology Annotation: Molecular function=RNA binding; Cellular component=nucleus; Biological process=mRNA cleavage
  misc_feature: Pfam annotation: Pfam_ID=WD40; Match level="Score=67.1, E-value=4.8e -17, Copies=3"; Pfam description=WD domain, G-beta repeat
  misc_feature (265)..(265): Xaa can be any naturally occurring amino acid
  misc_feature (272)..(272): Xaa can be any naturally occurring amino acid
MTNTPTLSNSNGVEDEEMPDTNNVFKTREFLYKLIISQLLYDGYQNVATSLQQAVQADPINAPSDRLYHLTVTGLEHEPSIKDRPKTSAIGNNLIGPGLDLEFEMESNVPAPEPALYETAYVTSHKGNCRAGCFSADGQLIATGSVDASIKILDVDRMLAKSAPDEMDPSRGEQQGHPVIRTLYDHMEEVTCLEFHPKEPFLCSGSRDMSIKLFDISKPSVKKAFKTITESESVKEISFHPLGDHLIVATKHPVIRLYDMNTLHXALCVVPXHQHTAPVNSLKWSRDAKLFASAA

SEQ ID NO: 20378 - protein, 290 aa, Diabrotica virgifera
  misc_feature: Coding regions on vcDNA: vcDNA=SeqID_75; Strand=+; Position=15-887
  misc_feature: Homolog annotation: Hit_ID=XP_396384.1; Match level="QueryCoverage =88%, HitCoverage=84%, E-value=1e-65, Identity=50%"; Hit description =similar to geranylgeranyltransferase type I (GGTase-I) [Apis mellifera]
  misc_feature: Gene Ontology Annotation: Molecular function=CAAX-protein geranylgeranyltransferase activity; Cellular component=CAAX-protein geranylgeranyltransferase complex; Biological process=C-terminal protein geranylgeranylation
  misc_feature: Pfam annotation: Pfam_ID=Prenyltrans; Match level="Score=109.2, E -value=1.1e-29, Copies=4"; Pfam description=Prenyltransferase and squalene oxidas
MGGGLGLLTIKLNFLNYFVYKKFIMETENIHKFAPELHKKYLLFILNGKLPSSNSSMDTNRSVLMYFAVSGLDILGEIENIPKERRQSIIEWIYSLQIINKEEPISGFQGSTTLNTDNNKERYGIYKCSHIAHTYVCLTTLLILGDDLKRVNRQAILNSLKTLQLPDGSFKGAIDGVESDMRFSYCAACICYILDDWSCIDIDAMVDFILNSISYDGGIGQGPELESHCGSTFCAVAALALSNNLDKLSRAQFNALRRWLLFRFDGGFSGRPNKPIDTCYSFWTGGALKF

SEQ ID NO: 20379 - protein, 291 aa, Diabrotica virgifera
  misc_feature: Coding regions on vcDNA: vcDNA=SeqID_76; Strand=+; Position=203-1075
  misc_feature: Homolog annotation: Hit_ID=XP_315620.1; Match level="QueryCoverage =96%, HitCoverage=42%, E-value=6e-86, Identity=57%"; Hit description =ENSANGP00000017827 [Anopheles gambiae]
  misc_feature: Gene Ontology Annotation: Molecular function=calcium ion binding; Cellular component=plasma membrane
MKWLYLCCLLLILQVCTAPPVEKKKEEPEDSEVNGLEDYMEYHRYLKEVVHALESDPDFRAKLEKAEESDIKSGKIAEELEFVSHHVRNRLDEIKRVELERLRHLVEQKRKLEDTNAIDTEDPTHNHLDHSNPHTFEIEDLKKLIAKTAQDLDEADKKRKEQFKQYELEKEYKKMDKLNHTNGDERQKLEKEYEEMENKHKRHEKLHEPGHKAQLEEVWEEQDQMQQDFDPKTFFMLHDIDGNGLWDQDEVKALFIKELDKMYQHTRSCPQFQGEEWKKMERMRESVFREM

SEQ ID NO: 20380 - protein, 391 aa, Diabrotica virgifera
  misc_feature: Coding regions on vcDNA: vcDNA=SeqID_77; Strand=+; Position=134-1310
  misc_feature: Homolog annotation: Hit_ID=AAH83286.1; Match level="QueryCoverage =93%, HitCoverage=78%, E-value=2e-52, Identity=33%"; Hit description =Unknown (protein for IMAGE:7231405) [Danio rerio]
  misc_feature (374)..(374): Xaa can be any naturally occurring amino acid
MKKSYTSTDINQNQGQELSKKLYRSISEQAKRLDDTRSCARIVGDLFSPNLQVQRKKFCEYCERLIFSDPSLYGRKGEELLWRKGFYDVVSTAKKLKKKEYLPEEISFIASHINAGIGFYSHMLSKLQYHFNLDIKTFIDFPMIHSEKKDTGDVKIEAIEWAKQSVHQCLIYLGDLSRYKLEIYPNWESTLACRYYLQAISYKPEYGMPHNQMGTLAMNQNSFLDAVYHYMRCLSCKISFEGTSNNLIALFERNSKFLEQLPKEDKNADLIIEPDQSEKIKRFVARFLLLIDIWYFNKKVPKVYDLCHQTYKNLEECLTFVKLTNSESGDGPTDGDSVETDSVASHISGDMIFKIVVISLLCISRLKSSNSSQXSTAVAFLIGIYSQKDKE

SEQ ID NO: 20381 - protein, 253 aa, Diabrotica virgifera
  misc_feature: Coding regions on vcDNA: vcDNA=SeqID_78; Strand=+; Position=172-929
  misc_feature: Homolog annotation: Hit_ID=XP_317947.1; Match level="QueryCoverage =100%, HitCoverage=57%, E-value=1e-128, Identity=90%"; Hit description=ENSANGP00000020532 [Anopheles gambiae]
  misc_feature: Gene Ontology Annotation: Molecular function=molecular_function unknown; Cellular component=AP-1 adaptor complex; Biological process= neurotransmitter secretion
  misc_feature: Pfam annotation: Pfam_ID=Adap_comp_sub; Match level="Score=22.6, E -value=8.5e-07, Copies=1"; Pfam description=Adaptor complexes medium subunit famil
  misc_feature (243)..(243): Xaa can be any naturally occurring amino acid
MSCSAIYILDVKGKVLISRNYRGDIDLGVIEKFMPLLMEKEEEGLLTPILQIPECTFSYIKTNNLYIVSTTKKNGNIALVFVFLHKIVQVMTEYFKELEEESIRDNFVVIYELLDELLDFGYPQTTDSKILQEYITQEGHKLEIQPRIPVAVTNAVSWRSEGIKYRKNEVFLDVIESVNLLASANGNVLRSEIVGAIKMRVYLSGMPELRLGLNDKVLFESTGRGKSKSVELDDVKFHQCVRXSRFEIDRTIS

SEQ ID NO: 20382 - protein, 212 aa, Diabrotica virgifera
  misc_feature: Coding regions on vcDNA: vcDNA=SeqID_79; Strand=+; Position=50-688
  misc_feature: Homolog annotation: Hit_ID=EAL34231.1; Match level="QueryCoverage =100%, HitCoverage=100%, E-value=2e-99, Identity=83%"; Hit description=GA18717-PA [Drosophila pseudoobscura]
  misc_feature: Gene Ontology Annotation: Molecular function=KDEL sequence binding; Cellular component=integral to membrane; Biological process =intracellular protein transport
  misc_feature: Pfam annotation: Pfam_ID=ER_lumen_recept; Match level="Score=511.1, E- value=1.1e-150, Copies=1"; Pfam description=ER lumen protein retaining receptor
MNIFRLTGDLSHLVAIIILLQKIWHTRSCAGISGKSQILFAIVYTTRYLDLVTSYVSMYNTVMKFVFLATSYATIYLIYMKFKATYDHNHDTFRIEFLILPSFGLAMLINHEFSFMEVLWTFSIYLESVAILPQLFMVSKTGEAESITSHYLFALGSYRALYILNWIYRYATETHYDLIAIVAGVVQTILYCDFFYLYITKVLKGKKLQLPA

SEQ ID NO: 20383 - protein, 355 aa, Diabrotica virgifera
  misc_feature: Coding regions on vcDNA: vcDNA=SeqID_80; Strand=+; Position=83-1150
  misc_feature: Homolog annotation: Hit_ID=NP_730216.2; Match level="QueryCoverage =84%, HitCoverage=71%, E-value=4e-26, Identity=29%"; Hit description =CG11905-PF, isoform F [Drosophila melanogaster] ref|NP_730215.2| CG11905-PB, isoform B [Drosophila
  misc_feature: Gene Ontology Annotation: Molecular function=molecular_function unknown; Cellular component=cellular_component unknown; Biological process=N-linked glycosylation
MVFDRKWFIILICLLVEVCSRPQLNDNAAPPSVDFRSSDKITLIPFYGGGKGQSLQIIEKSDGSVHTSIIKTPTKDEEDESTGIDNIIDTSELENPPLPSKFDLEDFGRNIKNIQSYAQRIISLQEILKQKGKLSPAQEAAYKENMDSLSSSALKLAEIQEKSNPIGLENREGISAWLENKKNSNNKNKNKKKEEDRKKDEEKKRKVDEEKRKEEQKRKQEKLEAEKEKEKEGEKEEGNQGEKEEGEKEQEGDGDTIGIGLPTDDASVAEARPVGLAVAGEGGVAASKPIATAVVGPGGLAIARPVGTAIAGVDPAQALIPIHAENYVLGSKPKGGHTETANEYLSKLITKFHQN

SEQ ID NO: 20384 - protein, 271 aa, Diabrotica virgifera
  misc_feature: Coding regions on vcDNA: vcDNA=SeqID_81; Strand=+; Position=123-939
  misc_feature: Homolog annotation: Hit_ID=XP_308110.1; Match level="QueryCoverage =61%, HitCoverage=29%, E-value=4e-58, Identity=61%"; Hit description =ENSANGP00000017172 [Anopheles gambiae]
  misc_feature: Gene Ontology Annotation: Molecular function=calcium ion binding; Cellular component=Golgi membrane; Biological process=protein amino acid glycosylation
  misc_feature: Pfam annotation: Pfam_ID=Glyco_hydro_47; Match level="Score=-193.3, E- value=1.4e-05, Copies=1"; Pfam description=Glycosyl hydrolase family 47
  misc_feature (231)..(231): Xaa can be any naturally occurring amino acid
MVDYRYDLGLDVSLDSSTDKKRKLRFRRWWNRLSKCQKSFIVTVSILILLSCTYLLNLQKDSRVITVEEVEDKRYTIKSHVEEPKQIEEVNVEAQEIKSNNNNNDVNKNVLAVPKVEHRFSGPTTPRQAAVVEAFKHAWKGYKKFAWGHDNLKPISEGFTEWFGLGLTIVDSLDTIFIMGLDEEYDEARNWVDKHLNFDVNRDVNLFEVTIRVLGGLLSIYHFSKDDMFLXKATELADRLLPCFDSESGIPYSDINLILLENHMHPKWAPK

SEQ ID NO: 20385 - protein, 213 aa, Diabrotica virgifera
  misc_feature: Coding regions on vcDNA: vcDNA=SeqID_82; Strand=+; Position=371-1012
  misc_feature: Homolog annotation: Hit_ID=EAL31478.1; Match level="QueryCoverage =88%, HitCoverage=35%, E-value=2e-44, Identity=46%"; Hit description =GA14544-PA [Drosophila pseudoobscura]
  misc_feature: Gene Ontology Annotation: Molecular function=cystathione beta -synthase activity; Cellular component=cytoplasm; Biological process =cysteine metabolism
  misc_feature: Pfam annotation: Pfam_ID=PALP; Match level="Score=-49.3, E-value=5e -05, Copies=1"; Pfam description=Pyridoxal-phosphate dependent enzyme
MSPGSRNRDPEYTFRSPLEDHPTLPNRAPKCPWTKDLHKTVRSPHGERVWKPCDRKILPSILNAVGNTPLVKINKIPKEENIDCEIYGKCEFMNPTGSIKERMLLRCIEDAEKLGTLKPGMTIIETTSGNTGIALAWVCAIKDYKCILVLPDKASKEKEDIMKAFGATVVRVPMDEPDISEHGKYGKTHYIHKQTPNSIILDHFSNPSNAVAH

SEQ ID NO: 20386 - protein, 279 aa, Diabrotica virgifera
  misc_feature: Coding regions on vcDNA: vcDNA=SeqID_83; Strand=+; Position=3-839
  misc_feature: Homolog annotation: Hit_ID=CAI13670.1; Match level="QueryCoverage =100%, HitCoverage=27%, E-value=3e-84, Identity=49%"; Hit description= insulin-degrading enzyme [Homo sapiens]
  misc_feature: Gene Ontology Annotation: Molecular function=signal transducer activity; Cellular component=extracellular space; Biological process= cell-cell signaling
  misc_feature (273)..(273): Xaa can be any naturally occurring amino acid
YISHLMGHEGPGSILSVLKARGWSNNLVAGSKPAPRGIGFFAVAVDLTEEGMDHIDEIIELVFQYLNMLKKEGPQQWVQDENKNIGHMIFRFKDKESPRTYISSLVHSIQEYPMEDILSANYMLREWRPDLVESVWNSFVPDNVRISVIAKKFENELNETEPWYGTKYKKVDIPKETIEAWKQTGLCPDLKMLEKNEFIPTDFSLYTLDEDVTEFPVIIEDTALTRVWFKQDDQFLLPKSHLMCDFVSPLAYLDPSNCNLTHMLVQLFKDALXEYAYAA

SEQ ID NO: 20387 - protein, 537 aa, Diabrotica virgifera
  misc_feature: Coding regions on vcDNA: vcDNA=SeqID_84; Strand=+; Position=125-1734
  misc_feature: Homolog annotation: Hit_ID=XP_394641.1; Match level="QueryCoverage =100%, HitCoverage=73%, E-value=0.0, Identity=64%"; Hit description =similar to ENSANGP00000016493 [Apis mellifera]
  misc_feature: Gene Ontology Annotation: Molecular function=cysteine-tRNA ligase activity; Cellular component=mitochondrion; Biological process =cysteine metabolism
  misc_feature: Pfam annotation: Pfam_ID=tRNA-synt_1e; Match level="Score=570.1, E -value=1.8e-168, Copies=1"; Pfam description=tRNA synthetases class I (C) catalyti
  misc_feature (219)..(219): Xaa can be any naturally occurring amino acid
  misc_feature (479)..(479): Xaa can be any naturally occurring amino acid
  misc_feature (525)..(525): Xaa can be any naturally occurring amino acid
MAKRVQPTWNVSNTEPQPVLKVYNSLTRQKEVFVPRSGKKVNWYSCGPTVYDASHMGHARSYITFDILRRVLSDYFGYDIFYVMNITDIDDKIIKRARQNYLFKKYVDENHSLESVLADAKLVLQDVQSRVKTTTDLDKKNMLEKMLTRLAASVEELEKSVKSGDSLRVENSKQQFILDGKDPISEWLDQKQGDTVRDNAIFSSLPRHWEQQFYQDMDXINILRPSVVTRVSEYIPEIITFIQKIIENGFAYEASGSVYFDVAAFDKSEKHYYAKLVPEAYGDTNSLQEGEGDLTTAEQRSEKHSPNDFALWKKSKPGEPFWDSPWGTGRPGWHIECSAMASDIFGATMDIHTGGVDLKFPHHDNEIAQSEAYFGNSEWVSYFLHSGHLTIAGCKMSKSLKNFVSIQDALSKYTSRQLRFAFLLHSWKDTLDYSQNSMDSAIQYEKLFNEFFLNVKDASISICLKNTTVDTFTKWSEHXKTLSNKLIAAKTAVHNALCDNIDTKSAINALRDIVTASNIYMRERXPPDALLLHDVGL

SEQ ID NO: 20388 - protein, 351 aa, Diabrotica virgifera
  misc_feature: Coding regions on vcDNA: vcDNA=SeqID_85; Strand=+; Position=2-1057
  misc_feature: Homolog annotation: Hit_ID=EAA03707.2; Match level="QueryCoverage =95%, HitCoverage=48%, E-value=1e-141, Identity=54%"; Hit description= ENSANGP00000019383 [Anopheles gambiae str. PEST] ref|XP_565675.1| ENSANGP00000019383 [Anopheles gambiae s
  misc_feature: Gene Ontology Annotation: Molecular function=calcium ion binding; Cellular component=extracellular matrix; Biological process=cell -matrix adhesion
  misc_feature: Pfam annotation: Pfam_ID=TSP_C; Match level="Score=479.5, E-value =3.5e-141, Copies=1"; Pfam description=Thrombospondin C-terminal region
PPRPDSPIDTDKDGVPDNHDNCRLIPNPNQLDTDRDGKGDACDTDIDDDAIPNNRDNCVFVYNPDQLDSNRNGYGDKCDNDTDDDHVTNDKDVCPTNSLIYQTDFSKYQTIVLDPYGETQIDPIWEIYNHGAEIVQTVNSDPGLAVGHDKFTGVDFEGTFFVDSDEDDDYVGFIFSYQSNRKFYAVMWKKHAQVYWEAEPFRAFAEPGIQIKVIDSETGPGEVLRNSLWHTGDTPNQVRLLWKDPKNVGWKEKTSYRWFLIHRPAIGLIRLKIFDGESMVADSGNLFDTTHKGGRLGVLCFSQQMIIWSDLAYRCNENLREEIWRALSPRYQKKVKIDNIGSYNVKSPDVQ

SEQ ID NO: 20389 - protein, 235 aa, Diabrotica virgifera
  misc_feature: Coding regions on vcDNA: vcDNA=SeqID_86; Strand=-; Position=155-862
  misc_feature: Homolog annotation: Hit_ID=CAH64510.1; Match level="QueryCoverage =96%, HitCoverage=42%, E-value=8e-35, Identity=38%"; Hit description =putative esterase [Tribolium castaneum]
  misc_feature: Gene Ontology Annotation: Molecular function=carboxylesterase activity
HVGRYDKVTLILGYCDREGIFLEVYKRFGYKAGSKKEGQEEDVDVKKFLVPGLSEDDPQNKRILKTLVETYKKRATESEKDKYLLPTDFYFVSGIIAAGNVHARTSKCPVYLYRISIDAGLNLLKKITKVTDPGTCHGDELGYLFKNHVAAQFLDKWKGADKVVRRFVKLWTNFAKTGNPTPPANDLQLTWKATDKDCGFIDIGKEVTVGSIPEAERRDCWKVIFQNFPIVVNNL

SEQ ID NO: 20390 - protein, 327 aa, Diabrotica virgifera
  misc_feature: Coding regions on vcDNA: vcDNA=SeqID_87; Strand=+; Position=26-1009
MTVKKKVVKKHTYTKKNGYLPHKNRSHPLYFVWLPLRVSIFFIFFWIVLVPVLYIILMAHVPGFAAVTLYFFVGMFVVFLIALSIFVCQWRCKNSRQSDIYYIEYQASEIPPQEMVELKKKPIVFEIEKEKIEIKKETPKKTEIRKETPKKTEIEKEDVNNGVHREFKEKTVIFREETKVIQRPVTLAIEKEKEPARPSSQNLSSPLSPRELFFLDMYEYANVAMRNATDNFLQKEKLLYNPSGPVQREYSDTSSDIAESQHEESINRTQQPIVEQSPARVPYLLHETSPVSELAPLHSRLSEIIKIELRLKNQILFLLSKEPSRRD

SEQ ID NO: 20391 - protein, 236 aa, Diabrotica virgifera
  misc_feature: Coding regions on vcDNA: vcDNA=SeqID_88; Strand=+; Position=90-797
  misc_feature: Homolog annotation: Hit_ID=NP_648878.1; Match level="QueryCoverage =99%, HitCoverage=24%, E-value=3e-27, Identity=36%"; Hit description =CG4998-PA [Drosophila melanogaster] gb|AAF49484.2| CG4998-PA [Drosophila melanogaster]
MRLLLAILALSVLHHTTAEEASWSWGSNDKDETPQKSSNEPLQETVPRSLKPSFLQDEEILIAEPSEYSEDIRANSTEAELVIDEILSSTKKGRAIDGFHEVYSDPNVQEALQKGDDSEARNVIKDRLCALGLMQCDGVEEKRPFYAPEELIYAQPVSINPVGKPIPTIPIKGHRGVGYGPPKPLHYPSRPLPPPGKFPPLSIPPNKFGPPSTYIQPGKPPRRQFAGPPTKPFYGK

SEQ ID NO: 20392 - protein, 338 aa, Diabrotica virgifera
  misc_feature: Coding regions on vcDNA: vcDNA=SeqID_89; Strand=+; Position=75-1090
  misc_feature: Homolog annotation: Hit_ID=AAH56022.1; Match level="QueryCoverage =96%, HitCoverage=95%, E-value=5e-87, Identity=49%"; Hit description =Dkfzp566m114-prov protein [Xenopus laevis]
  misc_feature: Gene Ontology Annotation: Molecular function=sterol transporter activity; Cellular component=cellular_component unknown; Biological process=biological_process unknown
  misc_feature: Pfam annotation: Pfam_ID=SBF; Match level="Score=-36.7, E-value =0.0094, Copies=1"; Pfam description=Sodium Bile acid symporter family
  misc_feature (315)..(315): Xaa can be any naturally occurring amino acid
MKYRITPLRFLQKNWLLVGILCCIFVAGIYPKLGSKQGPLRTEYTVKYGAVFIIFLVSGLSLKTDSIFKTFQQYKLHCFIQCFTFIFIPLFGVVLIQFLYIFGVHPWVLKGITTVASMPPPVSSAVILTRAAQGNESAAIFNSILGSFIGIIVTPILLLLQLGSTTIVPLLDTVFQLAVTVLLPLTIGQVLKKHTKLKIQTLPLNTISQCALLFVIYTTFCDTFLVPETGLSALDVLFTVFSVLLMQLSLMMISFHLANMFIKYFNPQDIIAIIFCSTHKSLTLGIPILRIMFHGYSHLSQISLPLLVYHPTQIXLGGLVVPQLKDWMHSQRAKRPPV

SEQ ID NO: 20393 - protein, 107 aa, Diabrotica virgifera
  misc_feature: Coding regions on vcDNA: vcDNA=SeqID_90; Strand=+; Position=103-426
  misc_feature: Homolog annotation: Hit_ID=NP_477136.1; Match level="QueryCoverage =97%, HitCoverage=99%, E-value=1e-16, Identity=44%"; Hit description =CG8396-PA [Drosophila melanogaster] gb|AAF52619.1| CG8396-PA [Drosophila melanogaster]
  misc_feature: Gene Ontology Annotation: Cellular component=transcription factor complex; Biological process=regulation of transcription, DNA -dependent
  misc_feature: Pfam annotation: Pfam_ID=PC4; Match level="Score=87.1, E-value=4.5e -23, Copies=1"; Pfam description=Transcriptional Coactivator p15 (PC4)
MPKNKPKRDTSDSDSGPDDDVPAKKTKKPESKSSKSSGEEENSWSLGKNKFVKLSEFKNTWYVNIREYYNADGELKPGKKGIMLTMEQWQKFKGFVDEVDEAIKKNV

SEQ ID NO: 20394 - protein, 459 aa, Diabrotica virgifera
  misc_feature: Coding regions on vcDNA: vcDNA=SeqID_91; Strand=+; Position=79-1457
  misc_feature: Homolog annotation: Hit_ID=NP_723712.1; Match level="QueryCoverage =97%, HitCoverage=80%, E-value=1e-106, Identity=42%"; Hit description= CG6756-PC, isoform C [Drosophila melanogaster] ref|NP_723711.1| CG6756-PB, isoform B [Drosophila
  misc_feature: Gene Ontology Annotation: Molecular function=protein transporter activity; Cellular component=mitochondrial outer membrane translocase complex; Biological process=protein-mitochondrial targeting
  misc_feature: Pfam annotation: Pfam_ID=TPR_1; Match level="Score=118.6, E-value =1.5e-32, Copies=7"; Pfam description=Tetratricopeptide repeat
  misc_feature (270)..(270): Xaa can be any naturally occurring amino acid
MPSLKWQIAFGLGAAGALGLAYWYLRASKKETLQTLNAAIENDKENTPFQEAQKYKTQGNEFFKRGKYDEAIACYNSAIETIPEEHKLDLATYYQNRAAAYEQLKKWSSVISDCTKAIELNNRYEKALFRRAKAEEMLKDWVNALDDITTVCLLQNFQNQATMLMADRVLKELGKQNAAEAIKNRIPVIPSRSFIKTYFSSFSEDPVFKKLQEISEPLGLGDLKGFLKAKLAFATERYDEVISACTEELNLSESESQYKFEALSLRASFXFLTGQFKEALEDLTFIIDSKEADLLIKVNSLIKRSSIYMQTEKIQDCLADFEAAAELGPEVSDVFHHRGQVKLLMEQIEDARKDFEKAVALNPDFAVAVVQKCYADYRYAMQVKDVTLLMQTMHDFRMAIDRFPNCAETYGLFAQVKTEKQEFHEAEKLYHTAMEIQSHNATIYGHRGGFCWCTGKGKN

SEQ ID NO: 20395 - protein, 343 aa, Diabrotica virgifera
  misc_feature: Coding regions on vcDNA: vcDNA=SeqID_92; Strand=+; Position=20-1048
  misc_feature: Homolog annotation: Hit_ID=EAA08054.2; Match level="QueryCoverage =83%, HitCoverage=91%, E-value=2e-83, Identity=50%"; Hit description =ENSANGP00000001212 [Anopheles gambiae str. PEST] ref|XP_563780.1| ENSANGP00000001212 [Anopheles gambiae st
  misc_feature: Gene Ontology Annotation: Molecular function=molecular_function unknown; Cellular component=extracellular space; Biological process =lipid metabolism
  misc_feature: Pfam annotation: Pfam_ID=UPF0160; Match level="Score=389.6, E-value =3.9e-114, Copies=1"; Pfam description=Uncharacterised protein family (UPF016
MALSAKFDRVLRISSSIASHVWNGFSTMATDAKTPRILKRIGTHSGVFHCDEALACYMLRQLPEYADAEIIRTRDPKILDECDIVVDVGGEYNPKKHRYDHHQRGFEETISTVRPDLIKNKSIKLSSAGLVYAHFGFEVLDAILKKEKIPTNTECLRSIFVFIYEGFVEELDAIDNGVPMFTEGKPKYRINTHLSARIHRLNPEWNSPNPVPSNETFFKAMELVGTRVRERVIDSATVWWPAREIVKKSIESRNQVHENGQIVLLNERCPWKDHLLALEEDLGISGQIKFVIFHDAGDSWRVQARPIQPDSFICRVFLHKDWRGVRDDQLSTISGIKDCIFCH

SEQ ID NO: 20396 - protein, 201 aa, Diabrotica virgifera
  misc_feature: Coding regions on vcDNA: vcDNA=SeqID_93; Strand=+; Position=327-928
  misc_feature: Homolog annotation: Hit_ID=NP_036172.1; Match level="QueryCoverage =98%, HitCoverage=25%, E-value=2e-78, Identity=72%"; Hit description =cullin 1 [Mus musculus] gb|AAH29260.1| Cullin 1 [Mus musculus] gb|AAD16038.1| SCF complex
  misc_feature: Gene Ontology Annotation: Molecular function=protein binding; Cellular component=SCF ubiquitin ligase complex; Biological process =apoptosis
  misc_feature: Pfam annotation: Pfam_ID=Cullin; Match level="Score=14.8, E-value =3.9e-09, Copies=1"; Pfam description=Cullin family
  misc_feature (176)..(176): Xaa can be any naturally occurring amino acid
  misc_feature (195)..(195): Xaa can be any naturally occurring amino acid
MSSKSSLSNNTSVLKQFDLDQIWGDLHAGIQQVYNRETMHKSRYIQLYTHVYNYCTSVHQQNNGRASANANTKGKKNQIGGGAQLVGLELYKRLRDFLRNYLVTLLSDGLHRMDEDVLKFYTNQWEDYQFCSKVLDGVCAYLNRHWVKRECEEGRKGIYEIYQLALVTWRDHLFNXLNKAVTNAVLKLIEKERNXRTINTR

SEQ ID NO: 20397 - protein, 272 aa, Diabrotica virgifera
  misc_feature: Coding regions on vcDNA: vcDNA=SeqID_94; Strand=+; Position=73-888
  misc_feature: Homolog annotation: Hit_ID=Q01443; Match level="QueryCoverage=68%, HitCoverage=28%, E-value=5e-13, Identity=32%"; Hit description =Sporozoite surface protein 2 precursor gb|EAA22580.1| sporozoite surface protein 2 precursor
MESVRFILLCMFFVACKVDGENAVNFAVNFVNKTLLESKCQLHMLTMKLSPHTHFSGTNPCDELHGQVGELPKGFDPHVELASIKPPDILTNGNVPVNKVTLSPNNSGKDKNKTGQLFPNNPFLNNGQVQNTNGVGSNIGSGIPNTQNPNGQVQPFNPYINGWNFPNNGFNPSGQWNPNTGYPNYQFNPAGQYPYPGPYNPNPNQFYPNGQPVWGNNGNFPNQGTFPNANQPNTGQSSNWPYKPHPYPGINKWQYPNVNGVPIMPNQNTNQN

SEQ ID NO: 20398 - protein, 193 aa, Diabrotica virgifera
  misc_feature: Coding regions on vcDNA: vcDNA=SeqID_95; Strand=+; Position=694-1275
  misc_feature: Homolog annotation: Hit_ID=AAN87600.1; Match level="QueryCoverage =87%, HitCoverage=44%, E-value=4e-16, Identity=38%"; Hit description =circumsporozoite protein [Plasmodium falciparum]
SKSQFYPNGQPVWGNNGNFPNQGTFPNANQPNTGQSSNWPYNPNPYPGQINNGQYPNVNGVPNWMPNQNTNQNPGHNQGQFPNPWGFNPNPNQDQNGQKPNQGTNINLNTNQGSGQTNQLPNNNPKQGQYPNQNGQPIWGNQNPNQGTGQNGQVPNINNQPVRGNVSPNENDSQNTGIVFPGPDSQGQEVEVF

SEQ ID NO: 20399 - protein, 503 aa, Diabrotica virgifera
  misc_feature: Coding regions on vcDNA: vcDNA=SeqID_96; Strand=-; Position=120-1633
  misc_feature: Homolog annotation: Hit_ID=EAL31424.1; Match level="QueryCoverage =97%, HitCoverage=86%, E-value=0.0, Identity=73%"; Hit description =GA11433-PA [Drosophila pseudoobscura]
  misc_feature: Gene Ontology Annotation: Molecular function=lysine-tRNA ligase activity; Cellular component=soluble fraction; Biological process =protein biosynthesis
  misc_feature: Pfam annotation: Pfam_ID=tRNA-synt_2; Match level="Score=573.4, E -value=1.8e-169, Copies=1"; Pfam description=tRNA synthetases class II (D, K and N
  misc_feature (246)..(246): Xaa can be any naturally occurring amino acid
GEQSPYPHKFHVSSSLESFIEKYSYLKDGDILENDHLSVAGRIHAIRESGPKLVFYDLRGEGVKIQVMANARYYEDESKFVDDTAKIRRGDIIGIEGVPTKTKKGELSILPKKIKLLAPCLHMLPHLHFGLKDKETRFRQRYLDLILNNRVRKIFEVRAKIIAYVRRYLDEMGFLEIETPMMNMQAGGAVAKPFITHHNELDMDLYMRIAPELYHKTLVVGGLDRVYEIGRQFRNERYRSYSNPEXTTCEFYMAYADYNDLMTITEEMVSGMVKSIHGSYKIQYHPNGPDDDQVVEIDFTPPFKRVSIISTLEKELNVKFPADLTSAEAQKFLNDLCIKHNVDCTPPRTANRLLDKLIGDFIEEKSINPTFIIEHPQVMSPLAKWHRSIPGLTERFELFVMKKEICNAYTELNDPVVQRERFEQQAALKAEGDDEVPLLDEDFCKALEFGLPPTAGWGMGIDRVTMFLTDNNNIKEVLLFPAMKPDDPNKHKEESEAPVDGAK

SEQ ID NO: 20400 - protein, 177 aa, Diabrotica virgifera
  misc_feature: Coding regions on vcDNA: vcDNA=SeqID_97; Strand=-; Position=1182-1715
  misc_feature: Homolog annotation: Hit_ID=NP_572573.1; Match level="QueryCoverage =74%, HitCoverage=23%, E-value=2e-41, Identity=69%"; Hit description =CG12141-PA, isoform A [Drosophila melanogaster] gb|AAN09255.1| CG12141-PA, isoform A [Drosophila
  misc_feature: Gene Ontology Annotation: Molecular function=lysine-tRNA ligase activity; Cellular component=soluble fraction; Biological process =protein biosynthesis
MMQTLRLMRKQLFSIDSGLIQKSKSELKRRLKAEQKAKEKAEKAAQQPAQAQKTKETKPSEEEISPNEYFKLRSTAVDKLKGIGGEQSPYPHKFHVSSSLESFIEKYSYLKDGDILENDHLSVAGRIHAIRESGPKLVFYDLRGEGVKIIVITTNRKLMYIKRTMKKNQRKRKQIQK

SEQ ID NO: 20401 - protein, 287 aa, Diabrotica virgifera
  misc_feature: Coding regions on vcDNA: vcDNA=SeqID_98; Strand=-; Position=1792-2655
  misc_feature: Homolog annotation: Hit_ID=NP_572573.1; Match level="QueryCoverage =100%, HitCoverage=50%, E-value=1e-114, Identity=73%"; Hit description=CG12141-PA, isoform A [Drosophila melanogaster] gb|AAN09255.1| CG12141-PA, isoform A [Drosophila
  misc_feature: Gene Ontology Annotation: Molecular function=lysine-tRNA ligase activity; Cellular component=soluble fraction; Biological process =protein biosynthesis
  misc_feature: Pfam annotation: Pfam_ID=tRNA_anti; Match level="Score=60.4, E-value =4.9e-15, Copies=1"; Pfam description=OB-fold nucleic acid binding domain
MADAAGEPLSKNELKRRLKAEQKAKEKAEKAAQQPAQAQKTKETKPSEEEISPNEYFKLRSTAVDKLKGIGGEQSPYPHKFHVSSSLESFIEKYSYLKDGDILENDHLSVAGRIHAIRESGPKLVFYDLRGEGVKIQVMANARYYEDESKFVDDTAKIRRGDIIGIEGVPTKTKKGELSILPQKIKLLAPCLHMLPHLHFGLKDKETRFRQRYLDLILNNRVRKIFEVRAKIIAYVRRYLDEMGFLEIETPMMNMQAGGAVAKPFITHHNELDMDLYMRIAPELYNE

SEQ ID NO: 20402 - protein, 442 aa, Diabrotica virgifera
  misc_feature: Coding regions on vcDNA: vcDNA=SeqID_99; Strand=+; Position=53-1378
  misc_feature: Homolog annotation: Hit_ID=XP_391940.1; Match level="QueryCoverage =90%, HitCoverage=52%, E-value=1e-175, Identity=74%"; Hit description= similar to glycyl-tRNA synthetase [Apis mellifera]
  misc_feature: Gene Ontology Annotation: Molecular function=glycine-tRNA ligase activity; Cellular component=mitochondrion; Biological process=tRNA modification
  misc_feature: Pfam annotation: Pfam_ID=tRNA-synt_2b; Match level="Score=254.9, E -value=1.4e-73, Copies=1"; Pfam description=tRNA synthetase class II core domain
MKLISILRRVTLLNRDILQNTIKKECKEVATVRTFYISPSADQWGKNKKHRNIKLNLYFDTMADPQIEEVLAPLRASVKEQGDLVRKLKADGAPVFDVKKAVVELQARKKLLEDKELSLAPNQTFDRAKMEDLLKRRFFFDQSFAIYGGITGQFDFGPMGCAFKANLLQTWRQFFVLEEQMLEVDCSILTPEPVLKASGHVDRFADLMVKDTKTGECFRLDHLIKAHLEKISADKKTSAATREECQDIVIKLDGMNKDEMGAVMKKFDMKSPLTGNALTEPMEFNLMFATQIGPSGLIKGFLRPETAQGIFVNFKRLLEFNQGKLPFAAAQIGNAFRNEISPRSGLIRVREFTMAEIEHFCDPSDKSHPKFDNVRDTQLLLYSACNQMDGKAAERKTIGVAVDSGLVANQTLGYFMARIQQFLVKSGVDPARLRFRQHMANE

SEQ ID NO: 20403 - protein, 299 aa, Diabrotica virgifera
  misc_feature: Coding regions on vcDNA: vcDNA=SeqID_100; Strand=+; Position=72-971
  misc_feature: Homolog annotation: Hit_ID=XP_313155.1; Match level="QueryCoverage =98%, HitCoverage=49%, E-value=1e-115, Identity=64%"; Hit description= ENSANGP00000013443 [Anopheles gambiae]
  misc_feature: Gene Ontology Annotation: Molecular function=protein serine/threonine kinase activity; Cellular component=centrosome; Biological process =mitosis
  misc_feature: Pfam annotation: Pfam_ID=Pkinase; Match level="Score=289.1, E-value =7.1e-84, Copies=1"; Pfam description=Protein kinase domain
MSKEEDVQVIPDIIYDVHTKTYYKKGKFYGKGGFAKCYELTNSQNNQSYAGKIVSKTLMQKQNQKEKMTQEIQIHQSLRHKNVVGFHNFFDDNHNIYIILELCRKKSMMELHKRRKALTEPETRFYMKQILSGVQYLHQARIIHRDLKLGNLFLNDNLIVKIGDFGLAAKIEYEGERKKTLCGTPNYIAPEILTKKGHSFEVDIWSIGCIMYTLLIGKPPFETTTLKETYSKIKKCEYKLSPNISSSAQQMIILMLQSDPKNRPKVDALIRHDFIQNGYCPPSLPVRALTMAPRFENLG

SEQ ID NO: 20404 - protein, 90 aa, Diabrotica virgifera
  misc_feature: Coding regions on vcDNA: vcDNA=SeqID_101; Strand=-; Position=1045-1317
RAGLDNSRDVSLGVVIHSVGVILSPFGVVLLDDRSVKNLTHWIDRIRFHSDLDITFTFRRFLSLRRFPVDPFIPSFLVIHQTNAAVPLAE

SEQ ID NO: 20405 - protein, 286 aa, Diabrotica virgifera
  misc_feature: Coding regions on vcDNA: vcDNA=SeqID_102; Strand=+; Position=294-1150
  misc_feature: Homolog annotation: Hit_ID=XP_397203.1; Match level="QueryCoverage =99%, HitCoverage=41%, E-value=1e-60, Identity=49%"; Hit description =similar to ENSANGP00000010880 [Apis mellifera]
  misc_feature: Gene Ontology Annotation: Molecular function=actin binding; Cellular component=actin cytoskeleton; Biological process=cytokinesis
  misc_feature: Pfam annotation: Pfam_ID=GTP_CDC; Match level="Score=-183.3, E-value =0.0085, Copies=1"; Pfam description=Cell division protein
  misc_feature (260)..(260): Xaa can be any naturally occurring amino acid
  misc_feature (267)..(267): Xaa can be any naturally occurring amino acid
MSANNVNAQVPTTQATATIKSRPNIMPSSYMYTSSSALLNRSSENKPTPPPTLPKYTSSFNAGSSLNRDRDKDSVGGSYRLSSLDRVAMRQKFMDQQNNTTVTTTTTNGSPQTNGNGDAVSAATLQTKREMFFTSTENNSHSITSSLTKDSNRLNKTPSLEKPIDTSLKTLSPDSNRDDTSKESTPEIIKERPKPKELDGYVGFANLPNQVYRKAVKKGFEFTLMVVGESGLGKSTLINSMFLTDIYNSSDYPGPTQRLXKTVAVEXTKVLLKENGVNLLLTVVDT

SEQ ID NO: 20406 - protein, 283 aa, Diabrotica virgifera
  misc_feature: Coding regions on vcDNA: vcDNA=SeqID_103; Strand=+; Position=118-969
  misc_feature: Homolog annotation: Hit_ID=XP_394268.1; Match level="QueryCoverage =95%, HitCoverage=63%, E-value=1e-72, Identity=46%"; Hit description =similar to CG5745-PA [Apis mellifera]
  misc_feature: Gene Ontology Annotation: Molecular function=Rab GTPase activator activity; Cellular component=Golgi apparatus; Biological process =vesicle-mediated transport
  misc_feature (176)..(176): Xaa can be any naturally occurring amino acid
  misc_feature (233)..(233): Xaa can be any naturally occurring amino acid
MESEHQEKSSFWKKNVKSVAGRPSPKRDVKDIRKTPGSTSFQDFQASVSDAWDLDDDEFCIISGLENTKISKKVAHSAALNVLNSHRSTTESEASTEKKHSKRMNISETESIKISRIPGRPKPIRRLPCEQEGVEKKLERFENILETSLTLQELCQLSWSGIPAKVRGITWRLLSXLPMNIERRNEVLERKRHDYWSLVEKYYYTEHDETNRDIQHQINIDVPRMNPSIPLFXQKTVQIMFERILFIWSIRHPASGYVQGINDLVTPLYIVFLLEYLKEESTI

SEQ ID NO: 20407 - protein, 415 aa, Diabrotica virgifera
  misc_feature: Coding regions on vcDNA: vcDNA=SeqID_104; Strand=+; Position=356-1603
  misc_feature: Homolog annotation: Hit_ID=AAU84938.1; Match level="QueryCoverage =100%, HitCoverage=100%, E-value=0.0, Identity=78%"; Hit description =putative phosphoglycerate kinase [Toxoptera citricida]
  misc_feature: Gene Ontology Annotation: Molecular function=phosphoglycerate kinase activity; Cellular component=cytosol; Biological process=glycolysis
  misc_feature: Pfam annotation: Pfam_ID=PGK; Match level="Score=946.4, E-value=9.8e -282, Copies=1"; Pfam description=Phosphoglycerate kinase
MALNKLAIDAIDLANKRVLMRVDFNVPLKDGAITNNQRIVAALDTIKYALDKQAKSVVLMSHLGRPDGSPNPKYTLKPVAGELEKLLSRPIQFLPDCVGSEVEKECADPKPGSVILLENLRYHIEEEGKGVDASGNKVKADPAKVKAFRESLRKLGDVYVNDAFGTAHRAHSSMMGEGFDKRASGFLLKKELQYFAKALDNPERPFLAILGGAKVADKIQLIENLLDKVNEMIIGGGMAYTFLKESQGMKIGDSLYDKEGAKIVNKLLEKAKANNVQIHLPVDFVVADGFSENAKTDSATAAAGISDGWMGLDIGPKTIEQFREPVRRAKVIVWNGPAGVFEWDKFATGTKAIMDEVVNVTGKGAITIIGGGDTATCAAKWKTEDKVSHVSTGGGASLELLEGKVLPGVAALSDA

SEQ ID NO: 20408 - protein, 325 aa, Diabrotica virgifera
  misc_feature: Coding regions on vcDNA: vcDNA=SeqID_105; Strand=+; Position=121-1095
  misc_feature: Homolog annotation: Hit_ID=XP_318058.1; Match level="QueryCoverage =98%, HitCoverage=73%, E-value=2e-76, Identity=44%"; Hit description =ENSANGP00000010737 [Anopheles gambiae]
  misc_feature: Gene Ontology Annotation: Cellular component=integral to plasma membrane
  misc_feature: Pfam annotation: Pfam_ID=ARM_1; Match level="Score=193.0, E-value =6.2e-55, Copies=1"; Pfam description=Adhesion regulating molecule conserve
MPAGGALFGSSAAGPGSTGGNKHLIEVRAGKMNLKGRTVNADKRKGLLYVYQSDDSLMHFCWQDRTTGIVEDDLIIFPDDCEYVKVPQCTTGRAYLLKFKSSNKKFFFWLQEPKTDKDEDNCKRINELLNNPSSAVQNTPNPDQDLQSLLNNMSQSQLMQLFGSGVGQIGGLSSLLGTIRGPNSGSARTSTTPAITHRTTVPTTPTPTPATNSQTSTTPAPGTTTPQNPIPTVTPDAPRVRGSTTRPQDESSPSSFPSSSPIQLADLQNFLSGLTPPPGAGAPAGGAQQAQSVDLSTALTSESLAGVLSNPETLQQLQNHLPAVD

SEQ ID NO: 20409 - protein, 70 aa, Diabrotica virgifera
  misc_feature: Coding regions on vcDNA: vcDNA=SeqID_106; Strand=-; Position=3-212
AGNILQTSDVTFYMVVLPLPASAAAILLSTPNPNAPEASPKPKAAFSIWPMKPKNKKTTRMYWKFSIVNR

SEQ ID NO: 20410 - protein, 149 aa, Diabrotica virgifera
  misc_feature: Coding regions on vcDNA: vcDNA=SeqID_107; Strand=+; Position=3-449
VGQCNTLKIYSTHEDQHTRSQFSTTAGMQETNQQTAATRRHSLTQNATNNISSSQENGKSAPSVISTTQHQEDQISSSKTQNAEILTKTKSEEDIYSSRLQHAEIVTITQPQEQIYSSGDQNFNTEKARIIEKGKTSDRSSGNAAVLIN

SEQ ID NO: 20411 - protein, 277 aa, Diabrotica virgifera
  misc_feature: Coding regions on vcDNA: vcDNA=SeqID_108; Strand=+; Position=82-915
  misc_feature: Homolog annotation: Hit_ID=XP_392640.1; Match level="QueryCoverage =91%, HitCoverage=100%, E-value=1e-111, Identity=76%"; Hit description=similar to Probable dolichol-phosphate mannosyltransferase (Dolichol-phosphate
  misc_feature: Gene Ontology Annotation: Molecular function=dolichyl-phosphate beta -D-mannosyltransferase activity; Cellular component=nuclear envelope -endoplasmic reticulum network; Biological process=protein amino acid glycosylation
  misc_feature: Pfam annotation: Pfam_ID=Glycos_transf_2; Match level="Score=137.0, E- value=4.5e-38, Copies=1"; Pfam description=Glycosyl transferase
KNLRMINKLKAIILIVIYTSFVKLIIAQYNMSKEKQAVNSKNKYSILLPTYNEVENLPIILYLIVKYMNRSNCDYEIIVIDDGSPDGTLEAAKQLQKIYGEDKIFLRPREKKLGLGTAYIHGINHATGNFIIIMDADLSHHPKFISQFIEKQQSQDYDVVSGTRYIGDGGVSGWDFKRKLVSRGANFLTQLLLRPGASDLTGSFRLYKKDVLEKLINSCVSKGYVFQMEMIVRARELNYSVGEVPITFVDRVYGESKLGGSEIVQFVRALLYLFATT

SEQ ID NO: 20412 - protein, 340 aa, Diabrotica virgifera
  misc_feature: Coding regions on vcDNA: vcDNA=SeqID_109; Strand=+; Position=2-1025
  misc_feature: Homolog annotation: Hit_ID=EAL29004.1; Match level="QueryCoverage =82%, HitCoverage=43%, E-value=4e-64, Identity=41%"; Hit description =GA11275-PA [Drosophila pseudoobscura]
  misc_feature (282)..(282): Xaa can be any naturally occurring amino acid
  misc_feature (285)..(285): Xaa can be any naturally occurring amino acid
DNEVTLQGTIGFGIDFTVSDCQNHYTQCAFNGSSLSINEVDSGYQIVWNSVYTDGEFVDKFQLNSGNSYWFGGPERYLQNPLEKLVLNGNDPYVIKKADNFAVAERYWLNSKGTFIFIDDKVPLFIDQNNNENGALLLIAKCINPYVNRQRNILKYDLVTKKNAKEAHLHAVNNYLGKPTGYPNENMIRKPIWTTWPKYKQPVDQNKVNEFVKSIVDHNFLGGQIEIDENWEVCFGSHVFNKDKFPDPNGLIDSIKSQGFKTALWINPFVNNDCQNYSNEGXDKXYFVKDVNGDTRAIWWESDNAHHVDFTNPDAAKWFSDKIKALSDDPGLHGFKFDAR

SEQ ID NO: 20413 - protein, 336 aa, Diabrotica virgifera
  misc_feature: Coding regions on vcDNA: vcDNA=SeqID_110; Strand=+; Position=1-1008
  misc_feature: Homolog annotation: Hit_ID=XP_310522.1; Match level="QueryCoverage =100%, HitCoverage=35%, E-value=1e-127, Identity=68%"; Hit description=ENSANGP00000022750 [Anopheles gambiae] gb|EAA45075.1| ENSANGP00000022750 [Anopheles gambiae
  misc_feature: Gene Ontology Annotation: Molecular function=motor activity; Cellular component=kinesin complex; Biological process=regulation of pole plasm oskar mRNA localization
QEINQQSQYVEKLKEQMLEQDELIASTRRDYEALQAEMNRIQQENESAKEEVKEVLQALEELAVNYDQKSQEVEAKNKEMESLSEELMQKQTNLNSTTTELQQLRDMNNHQKKRITEMLSNLLKELGEIGSSLGGGDGQDIKISNDVAKLEEEFTVARLYISRMKSEVTSLTQRLQEIENKEQDSNKKVTEYEKELAECRLLISQHEARMKSLQESMREAENKKRLLEENIDALREECAKLKAAEQVQSASESEKKEANELRVALEQQMDQLRDVHQKQVAALRDEIAEKQSLINDIKDSNQKLTLAQQQLQADYEKDQSDETEKVSKLQELIATN

SEQ ID NO: 20414 - protein, 222 aa, Diabrotica virgifera
  misc_feature: Coding regions on vcDNA: vcDNA=SeqID_111; Strand=+; Position=156-824
  misc_feature: Homolog annotation: Hit_ID=EAL26021.1; Match level="QueryCoverage =71%, HitCoverage=11%, E-value=3e-13, Identity=33%"; Hit description =GA21191-PA [Drosophila pseudoobscura]
  misc_feature: Gene Ontology Annotation: Molecular function=cell adhesion molecule activity; Cellular component=plasma membrane; Biological process =embryogenesis and morphogenesis
  misc_feature: Pfam annotation: Pfam_ID=LRR_1; Match level="Score=37.0, E-value=5.5e- 08, Copies=6"; Pfam description=Leucine Rich Repeat
MNNMNISMLCILFFGLLVSFVHCQICQVSGSDTITAIDCNTVRLVGRDLHLDSNIPATSKLVVLNLNNCSGRIDDHSFSNIKHLRSINIDNCVLEKFKVPNLPDLKDLDIRNSFLPRITRASLKNGKNLKRVALSENKVDITSGSFQDLTALTALDIEHQNITLDKHFLRGLRNLILLSITDSTVTQISSDSFTEVPELLDLSLERNPIQHIENGAFDPLKN

SEQ ID NO: 20415 - protein, 114 aa, Diabrotica virgifera
  misc_feature: Coding regions on vcDNA: vcDNA=SeqID_112; Strand=-; Position=452-796
MICRPMLEYGSAIFYNAEGPAKNNIKVAETTSLRQITRMRHPDNPLHNPSNRMLYEKTGIEPINERLNKLFKYLSINDNNKNLIEPHIVKIPEDSARRYPGRTLFEEICYSSRQ

SEQ ID NO: 20416 - protein, 166 aa, Diabrotica virgifera
  misc_feature: Coding regions on vcDNA: vcDNA=SeqID_113; Strand=+; Position=3-503
  misc_feature: Homolog annotation: Hit_ID=XP_311575.1; Match level="QueryCoverage =98%, HitCoverage=34%, E-value=5e-37, Identity=43%"; Hit description =ENSANGP00000016038 [Anopheles gambiae]
  misc_feature: Gene Ontology Annotation: Molecular function=sodium-dependent phosphate transporter activity; Cellular component=integral to membrane; Biological process=phosphate transport
  misc_feature (5)..(5): Xaa can be any naturally occurring amino acid
  misc_feature (32)..(32): Xaa can be any naturally occurring amino acid
LGALXHLMRMIFGTAYGSIGDYLKKNKVMSPXAIRKSFILASHIIPGILMICVIFMGCNWVPLIILLTFSMAINGAAVLTNLQNPQDLAPNFAGSIFGIISCIGGTTGFLVPAITGAFIQKHNGLKEWSYTFIFGGCVYIGTGIIFILFGSVEEQPWNRIADTENH

SEQ ID NO: 20417 - protein, 418 aa, Diabrotica virgifera
  misc_feature: Coding regions on vcDNA: vcDNA=SeqID_114; Strand=+; Position=30-1284
  misc_feature: Homolog annotation: Hit_ID=XP_312606.1; Match level="QueryCoverage =86%, HitCoverage=81%, E-value=4e-77, Identity=41%"; Hit description =ENSANGP00000014953 [Anopheles gambiae]
  misc_feature: Gene Ontology Annotation: Molecular function=lipase activity; Cellular component=extracellular; Biological process=digestion
  misc_feature: Pfam annotation: Pfam_ID=Abhydro_lipase; Match level="Score=66.9, E -value=5.6e-17, Copies=1"; Pfam description=ab-hydrolase associated lipase region
  misc_feature (378)..(378): Xaa can be any naturally occurring amino acid
  misc_feature (408)..(408): Xaa can be any naturally occurring amino acid
MVKLKVVILLLAISNVFCKNTTLDAIGNFIRNYRKSFNVSDAVFEPYSDLGLDIYKFLAKYNYPVETHWVKTEDGYILRMQRLVGGQNGTHVNTKDKPAVLLMHGLLSSAMDFVNYGPNRSIALMLADEGYDVWLGNNRGTTWSRMHETLDPDNDAKYYDYSFDECGYYDLPAKIDYIVNKTGQEKIFYIGHSQGTSQFFAMAALRPEYNEKIALMSALAPVAYMNHMSSTSLRIVSQYLDILKLILVDILNIHSLLSHSWIYTELAKLYIVITDVVPQAKEIGAIVAFFSSGFNNREFDRSFVPIILSNAPAGISSKMAIHYGQEIISGKFRRYDYQLGNYEKYNSLFPPDYNLSAITAPIVLYYSKNDYMVGVKDXVERLSKEYPTVVKLQLVQDRRFNHLDYLWXEDVHTISMMM

SEQ ID NO: 20418 - protein, 519 aa, Diabrotica virgifera
  misc_feature: Coding regions on vcDNA: vcDNA=SeqID_115; Strand=+; Position=1-1560
  misc_feature: Homolog annotation: Hit_ID=EAL30060.1; Match level="QueryCoverage =96%, HitCoverage=57%, E-value=1e-158, Identity=54%"; Hit description= GA18581-PA [Drosophila pseudoobscura]
  misc_feature: Gene Ontology Annotation: Molecular function=plasma kallikrein activity; Cellular component=plasma membrane; Biological process =proteolysis and peptidolysis
  misc_feature: Pfam annotation: Pfam_ID=Trypsin; Match level="Score=217.3, E-value =3.1e-62, Copies=1"; Pfam description=Trypsin
GTYNSFKPSLPISPSTTAGLGNFGSSNGFLASNTFGSTNGFSQASYGGQPIANYGVKPITENYQDQGYESFGASVGSYGSTGLYKKELNLNSVNNNYLQANYADKYQGVESARAENYDCICVPYDQCPSHDVIGRKDDLYLPLDPRNLKSDIEALSDEERVITDGNGTMTVVTVNKDTGLTGTNVTEVMKEGKRISKRDTSEVDAKVNQNGGDGKPEARQFYGGNNLIGRPQTCGPRHVCCKRPLRPQVPHPNRQCGTRHSQGINGRIKNPVYVYGDSEFGEYPWQVAILKKDSKESVYVCGGTLIDPLHILTAAHCVKTYTGFDLRARLGEWDVNHDVEFYPYIERDVVSVHVHPEFYAGTLYNDIAILRMDKPVDWSKSPHISPACLPHPQDDYTGARCWTTGWGKDAFGDFGKYQNILKEVDVPIVDSGICQRQLQQTRLGYDFKLHPGFICAGGEEGKDACKGDGGGPMVCERGGTWQVVGLVSWGIGCGQTGVPGVYVKVGYYLDWIRQITQRY

SEQ ID NO: 20419 - protein, 472 aa, Diabrotica virgifera
  misc_feature: Coding regions on vcDNA: vcDNA=SeqID_116; Strand=+; Position=46-1461
  misc_feature: Homolog annotation: Hit_ID=XP_308743.1; Match level="QueryCoverage =99%, HitCoverage=89%, E-value=8e-93, Identity=38%"; Hit description =ENSANGP00000015016 [Anopheles gambiae]
  misc_feature: Gene Ontology Annotation: Molecular function=UDP-glycosyltransferase activity; Cellular component=membrane fraction; Biological process =lipid metabolism
  misc_feature: Pfam annotation: Pfam_ID=UDPGT; Match level="Score=166.7, E-value =5.1e-47, Copies=1"; Pfam description=UDP-glucoronosyl and UDP -glucosyl tra
  misc_feature (415)..(415): Xaa can be any naturally occurring amino acid
MKLVAIVAIFMCSVALTRGYRILGVFSYCGHSHFSLGYRIASELAARGHDVTMITCNPQNKGVKNLKEVSVEGFKRHLESFNADLADFGQMSFWGQLEWIKGLGIAYTEYVLTAPEVKQLWNSNQEFDLVVMEHFINDAATIFHHRFNCPLVILAPGPMSMMNNYLVGNLAPPSYVPSILGNYDAEMSYWERLSNTYKFIMGEIFMHTKFIPAHNELLKRVFPDAPDLNTILYNASLILITSHVSLIDAMPLQQNIKEIGGYHVTDPEPLPKNLKDFLDSAKDGAIIFSMGSNLKSSDFEPEKKRAILKAFSKIKQKVLWKFETDLPEKSDNVMISSWLPQKDALAHPNVIGFIGHGGLLGTIEAIYHGVPILGMPIFWDQMKNIEEAVRKGYGVKLNFADLTEETFEKSLNELXHNPKYRECAKTRSKIMHDQPTKQIDEAMFWIEYVVRHKGAPHLRSQSVKLRWYQLYL

SEQ ID NO: 20420 - protein, 346 aa, Diabrotica virgifera
  misc_feature: Coding regions on vcDNA: vcDNA=SeqID_117; Strand=+; Position=56-1097
  misc_feature: Homolog annotation: Hit_ID=AAM97775.1; Match level="QueryCoverage =94%, HitCoverage=30%, E-value=2e-65, Identity=39%"; Hit description =Toll-related protein; AeToll1 [Aedes aegypti]
  misc_feature: Gene Ontology Annotation: Molecular function=antibacterial peptide activity; Cellular component=integral to plasma membrane; Biological process=activation of NF-kappaB-inducing kinase
  misc_feature: Pfam annotation: Pfam_ID=TIR; Match level="Score=96.0, E-value=9.7e -26, Copies=1"; Pfam description=TIR domain
  misc_feature (278)..(278): Xaa can be any naturally occurring amino acid
KCYGINLSNNRIHDLKWIPMGIEKLNLQHNSLTHIDSELFKIINSTKSLNKLELAYNPWSCGCSAFDLQQFLQNRHTIVNSTDVFCQKEKQYLVKKADLCKTSSALILSVVFPIVALLILTIVTLVLYIYYRQEVKVWLYAKNICLCLVTEEELDEDKEYDVFLSYAHQDEVFVLQNLLPALEPLRTCIHIRDWKPGETILTNVNDSVMNSRRTLVVLSNNFLDSVWGIQEFKTAHTQAIKEGRARVIVVKYGELDKSRLDVDIETYLKTNTYVEWGXPWFWNKFNYALPHRREKGCCNPFCKSNQKHDSIMLIDDKFELTNPPVNHAERLPPVTLRTKSSFLSKN

SEQ ID NO: 20421 - protein, 217 aa, Diabrotica virgifera
  misc_feature: Coding regions on vcDNA: vcDNA=SeqID_118; Strand=+; Position=23-676
  misc_feature: Homolog annotation: Hit_ID=AAC35245.1; Match level="QueryCoverage =91%, HitCoverage=91%, E-value=3e-47, Identity=43%"; Hit description =glutathione S-transferase isozyme 3 [Plutella xylostella]
  misc_feature: Gene Ontology Annotation: Molecular function=glutathione transferase activity; Cellular component=cellular_component unknown; Biological process=glutathione conjugation reaction
  misc_feature: Pfam annotation: Pfam_ID=GST_N; Match level="Score=50.6, E-value=4.6e- 12, Copies=1"; Pfam description=Glutathione S-transferase, N-terminal
MAPKLYKMNLSPPVRAVLLCSKIANIDLELIDVNLMAGEQMTQDYLKLNPQHTVPLLDDDGFILADSHAIMQYLIETYAEDSPLLPKDIKSRATLNHRLHFDTGILFARGLAITKLIIFESVKEVPEKYIALLDEAIGIVEKFLTQNEWIAGDQMTIADLSCVTNVTTFSYFIPITEERFPKISAWIKRFEDVPHFKEINEGVNDYINVIEAAMNRD

SEQ ID NO: 20422 - protein, 491 aa, Diabrotica virgifera
  misc_feature: Coding regions on vcDNA: vcDNA=SeqID_119; Strand=+; Position=203-1675
  misc_feature: Homolog annotation: Hit_ID=XP_397447.1; Match level="QueryCoverage =87%, HitCoverage=64%, E-value=0.0, Identity=75%"; Hit description =similar to ENSANGP00000004030 [Apis mellifera]
  misc_feature: Gene Ontology Annotation: Molecular function=monovalent inorganic cation transporter activity; Cellular component=late endosome; Biological process=cation transport
  misc_feature: Pfam annotation: Pfam_ID=Na_H_Exchanger; Match level="Score=170.3, E -value=4.2e-48, Copies=1"; Pfam description=Sodium/hydrogen exchanger family
  misc_feature (486)..(486): Xaa can be any naturally occurring amino acid
MDYKRRGYVICTIVFFVLFVNIASLQNVNQTIVSSEAPLTKETVTEANTKNQVDKATAVPSKDSQNVTVTTATTPNNVTNTTTEAPATVDKPDNASTVVKQTNTTSENVTTAQTADPVPVLPAKEAAEDEHNSSMAIFFVLCVLALGILLIHLMLQTHFQYVPESIVIVFLGALIGLIMNALSSRNISNWRKEEAFSPTAFFLILLPPIIFESGYNLHKGNFFQNIGSILVFAIFGTTISAFIIGFGIYFLGLADVVYRLGFVESFAFGSLISAVDPVATIAIFHALNVDPILNMLVFGESILNDAIAIVLTNAALESNNPDMNTGEAIVLGIERFCLMFFASALLGVVFALVSALLLKHVDLRKNPSLEFGMMLVFTYAPYVLAEGIHLSGIMAILFCGIVMSHYTHFNLSTVTQITMQQTLRTLAFIAETCVFAYLGLALFSFKHRVEPALIVWSIVLCLLGRACNIFPLAILVNKFREHQITXKMMFI

SEQ ID NO: 20423 - protein, 420 aa, Diabrotica virgifera
  misc_feature: Coding regions on vcDNA: vcDNA=SeqID_120; Strand=+; Position=1567-2829
  misc_feature: Homolog annotation: Hit_ID=EAL30445.1; Match level="QueryCoverage =80%, HitCoverage=82%, E-value=9e-50, Identity=31%"; Hit description =GA21796-PA [Drosophila pseudoobscura]
  misc_feature: Gene Ontology Annotation: Molecular function=acid phosphatase activity; Cellular component=integral to membrane; Biological process=regulation of cell cycle
  misc_feature: Pfam annotation: Pfam_ID=Acid_phosphat_A; Match level="Score=40.5, E -value=9.2e-10, Copies=1"; Pfam description=Histidine acid phosphatase
  misc_feature (251)..(251): Xaa can be any naturally occurring amino acid
  misc_feature (255)..(255): Xaa can be any naturally occurring amino acid
MRKREVIDLYKRSYDEVSKNNSVVDLERRNRQEVGTKVTTSSSNIDEDIKDLGLPSAAEETSFNRRKKVKSYIYDTDTLLLVTALFRHGNRTVERTQYERYPNDPYKDLDYFPTGIGQLTKNGRKRAFQIGRRLRKRYRQFLGDVFYPEIVAAQSTNLDRTKMTLELVLAGLFPPSKDDEISKELQGWQPISFNYLPLAQDPALMPYFCPKFKTEYKKAVQSPNNKLVFGRNNKIFKYISDNTGVNVTDFXDLDXIFLGFQAKEDLGLNLPDWLKSIYPDPMDKMSAKYYYQLTGTNELKKMFAGNFLQQVLENIKRKMAANDGKFGKKIYLYSAHEFNVAALLASLGVYNNHTPNYGSYIIIELHVKGGVPGIKLFWENWDGRGPTLLKLSGCQTLCPLTKFVELISNIVPEEGETACQ

SEQ ID NO: 20424 - protein, 320 aa, Diabrotica virgifera
  misc_feature: Coding regions on vcDNA: vcDNA=SeqID_121; Strand=+; Position=89-1046
  misc_feature: Homolog annotation: Hit_ID=XP_397430.1; Match level="QueryCoverage =95%, HitCoverage=40%, E-value=7e-67, Identity=37%"; Hit description =similar to sensory neuron membrane protein 1 [Apis mellifera]
  misc_feature: Pfam annotation: Pfam_ID=CD36; Match level="Score=-63.1, E-value=5.9e- 11, Copies=1"; Pfam description=CD36 family
  misc_feature (257)..(257): Xaa can be any naturally occurring amino acid
  misc_feature (282)..(283): Xaa can be any naturally occurring amino acid
  misc_feature (297)..(297): Xaa can be any naturally occurring amino acid
  misc_feature (315)..(315): Xaa can be any naturally occurring amino acid
SISLDYNTIKQTALRKRNEIRGIYLKIPFPLNFKIYFFNVTNPMEVHNGATPILQQVGPYYYDEYKEKINVVDNDAEDSLQYDAFDTYQFNKTLSGSLSDEDYVTIIHPLLVGMVNTVTATSPALLSIVNQAITHIFNEPKTIYLTDKVKNIMFNGMELNCQGSDFASKAVCTQIKSQMKGVKESPTQKNVLLFSLIGPRNATIADTIKIMRGIKNYRDLGRVLEVNGKKDIGLWGTEECNRFKGTDGWIIPPLLNXEEGIKCYTTHLCRNIALDYVRDDVXXGINVRRYERNLGDXANNPADKWYCPENQTCLXTGTFE

SEQ ID NO: 20425 - protein, 160 aa, Diabrotica virgifera
  misc_feature: Coding regions on vcDNA: vcDNA=SeqID_122; Strand=+; Position=377-856
  misc_feature: Homolog annotation: Hit_ID=EAL42027.1; Match level="QueryCoverage =26%, HitCoverage=11%, E-value=6e-09, Identity=65%"; Hit description =ENSANGP00000029512 [Anopheles gambiae str. PEST] ref|XP_565625.1| ENSANGP00000029512 [Anopheles gambiae st
MTTKNDSSQLIVLKDVNDSRMDQPTNITENLLMIPEKKLHQLNSPEIRCSPSPCVFDFDGNIIRRCGENTLYPNQSPSRTPSPASDCSPRLGRRGSNFRRSNSPSSPILGSRRGSTTGYETYQKSLLEVPICVDYGDPSSDDFSSQWDSDVPQTKRDVTT

SEQ ID NO: 20426 - protein, 88 aa, Diabrotica virgifera
  misc_feature: Coding regions on vcDNA: vcDNA=SeqID_123; Strand=+; Position=3-269
  misc_feature: Homolog annotation: Hit_ID=XP_391860.1; Match level="QueryCoverage =69%, HitCoverage=16%, E-value=4e-18, Identity=68%"; Hit description =similar to ENSANGP00000021579 [Apis mellifera]
  misc_feature: Gene Ontology Annotation: Molecular function=pre-mRNA splicing factor activity; Cellular component=nuclear speck; Biological process=mRNA splice site selection
  misc_feature: Pfam annotation: Pfam_ID=RRM_1; Match level="Score=50.9, E-value=3.7e- 12, Copies=1"; Pfam description=RNA recognition motif. (a.k.a. RRM, RB
RDENNCLLNFSNYLCNFAINRVKMATRVFVGGLTYKIRERDLEKFFRKYGRIKEVSMKNGYAFVEFDDHRDADDACYELNVCVSLRGQ

SEQ ID NO: 20427 - protein, 273 aa, Diabrotica virgifera
  misc_feature: Coding regions on vcDNA: vcDNA=SeqID_124; Strand=+; Position=3-824
  misc_feature: Homolog annotation: Hit_ID=XP_391860.1; Match level="QueryCoverage =90%, HitCoverage=73%, E-value=4e-86, Identity=62%"; Hit description =similar to ENSANGP00000021579 [Apis mellifera]
  misc_feature: Gene Ontology Annotation: Molecular function=pre-mRNA splicing factor activity; Cellular component=nuclear speck; Biological process=mRNA splice site selection
  misc_feature: Pfam annotation: Pfam_ID=RRM_1; Match level="Score=136.5, E-value =6.1e-38, Copies=2"; Pfam description=RNA recognition motif. (a.k.a. RRM, R
FSPRDRDENNCLLNFSNYLCNFAINRVKMATRVFVGGLTYKIRERDLEKFFRKYGRIKEVSMKNGYAFVEFDDHRDADDACYELNGKDLMGERITVERARGTPRGSDQWRGSGRDRGYSGYSGPRGRNDNSRARDKYGPPTRTEYRVIVENLSSRCSWQDLKDYMRKAGEVTFADAHKLVPNEGVVEFVSYSDMKNAIEKLDDTEINGRRIRVFEDRRGGRKNNRSVSRSRSRSRRRSKSRSASRNKSHSKSRSRSHSKDNKRRSNSRSEDRI

SEQ ID NO: 20428 - protein, 362 aa, Diabrotica virgifera
  misc_feature: Coding regions on vcDNA: vcDNA=SeqID_125; Strand=+; Position=179-1264
  misc_feature: Homolog annotation: Hit_ID=AAO21506.1; Match level="QueryCoverage =92%, HitCoverage=72%, E-value=4e-69, Identity=41%"; Hit description =serpin 3b [Manduca sexta] gb|AAO21505.1| serpin 3a [Manduca sexta]
  misc_feature: Gene Ontology Annotation: Molecular function=serine protease inhibitor activity; Cellular component=cytoplasm; Biological process= regulation of proteolysis and peptidolysis
  misc_feature: Pfam annotation: Pfam_ID=Serpin; Match level="Score=96.4, E-value =7.5e-26, Copies=1"; Pfam description=Serpin (serine protease inhibitor)
MLLGFFILGTCLLHVGHCNSSPTTNTVEDIDVYYPNINWSNIFDWRILKEYSPTYKNLLVSPISLRIILALLYQGSSGLTKREFESVMHFTDQQSAREEFRNILNKLQVAESPEYTLNLGTRVFLDIPVAPQQKFASIAKDFFKTELVLTNFTNKEEAGNTINSWAEQQTNGRIHKLIDPADLADALMVIANAVYFKGTWKYQFPFQTVDKFYVPDGNNFFSIQARFMAVEDKFYFHESPLLDAKILRLPYKGGRYSMFILLPNSKGGLPSLIKQININNLKSLLYLMDQRLVNVTIPKFRFDFQARFSRTLQEFGLLQMFQNTASFPGIARGDSTILRKLVVSDIVQKSGIEVNEYGSVVY

SEQ ID NO: 20429 - protein, 213 aa, Diabrotica virgifera
  misc_feature: Coding regions on vcDNA: vcDNA=SeqID_126; Strand=+; Position=266-907
  misc_feature: Homolog annotation: Hit_ID=AAH72151.1; Match level="QueryCoverage =91%, HitCoverage=90%, E-value=5e-37, Identity=45%"; Hit description =MGC80088 protein [Xenopus laevis]
MKMKPDYAEMVAAVAFGVLSAIFVSAFVILIVICRRHKMFYKTILFEDVAVRPEKHLIDSEPPELELGEVSADVEDLTDEQWIDDATGLIPHCLAILKTCRSLTERLTALAMSSTPASGDFRQIVESARRISSRVDDMVRSMYPPLDPRLLEARAAALTLAVTHLALLAKYECGSKERTLMWIDQSLRDMDSHLMFLRDASIQQKNMNKSRIL

SEQ ID NO: 20430 - protein, 492 aa, Diabrotica virgifera
  misc_feature: Coding regions on vcDNA: vcDNA=SeqID_127; Strand=+; Position=104-1578
  misc_feature: Homolog annotation: Hit_ID=XP_317094.1; Match level="QueryCoverage =91%, HitCoverage=68%, E-value=1e-113, Identity=43%"; Hit description= ENSANGP00000019502 [Anopheles gambiae]
  misc_feature: Gene Ontology Annotation: Molecular function=iodide transporter activity; Cellular component=integral to membrane; Biological process=transport
  misc_feature: Pfam annotation: Pfam_ID=SSF; Match level="Score=-8.9, E-value=1.2e -08, Copies=1"; Pfam description=Sodium:solute symporter family
  misc_feature (272)..(272): Xaa can be any naturally occurring amino acid
  misc_feature (463)..(463): Xaa can be any naturally occurring amino acid
MELTTIPTFLDNVANGLSTSTASYTSSIHKSAGIRFSWYDYLIFCFLILISLGIGIYFGCFGKKQNVKDYLLAGGNMKVFPVVVSLVASHTSGITLLALPAEVYSFGANYWLCVICLYIVPVITVYVFLPVFYKLQLTSTYEYLGIRFDKKTRKLASVLFTISVFCLVPIATYIPAMAFSSATGLNLHKVVPVICGTCIFYTAIGGLKALVWSDTLQFSATLGALLTILSLGLYKVGGIGKVMTLAYSTDRLDLFDFALDFTKRDSFWTIVXGFTFHWIAVMSINQGCMQKFLAVGTFRESKWVAFLYCSVGMTAVKSISIVSGLTMYTHYADCDPLKSHKIRHNNEIFPYFVLDVAGKIPGLSGLFIAGVFCASLSALSCNLNSLAGTIYEDFIKPKLSPKNQENAGYFLKGLVVIIGIIGTALVYIVEQLGGLLSLSVGLGGIAQGPLLGLFTLGMLFPRXNAKGAFWWSFGQCSISYWLFAYYLSQHII

SEQ ID NO: 20431 - protein, 116 aa, Diabrotica virgifera
  misc_feature: Coding regions on vcDNA: vcDNA=SeqID_128; Strand=+; Position=54-404
MNSSILVVLMCLCAAQFAFGSQHEIKDGKCSNASQDDLVFRDHINKASIPFIKRDEKVEWHGDTTIYCLQVTTDQDESKGATATVKEGGVGHSFVTVKVESGRGHSLDYYVKVYAK

SEQ ID NO: 20432 - protein, 286 aa, Diabrotica virgifera
  misc_feature: Coding regions on vcDNA: vcDNA=SeqID_129; Strand=+; Position=87-944
  misc_feature: Homolog annotation: Hit_ID=XP_312352.1; Match level="QueryCoverage =97%, HitCoverage=40%, E-value=1e-116, Identity=72%"; Hit description= ENSANGP00000012176 [Anopheles gambiae]
  misc_feature: Gene Ontology Annotation: Molecular function=glycogen (starch) synthase activity; Cellular component=cellular_component unknown; Biological process=glycogen metabolism
  misc_feature: Pfam annotation: Pfam_ID=Glycogen_syn; Match level="Score=38.8, E -value=1.7e-27, Copies=1"; Pfam description=Glycogen synthase
  misc_feature (271)..(271): Xaa can be any naturally occurring amino acid
  misc_feature (275)..(275): Xaa can be any naturally occurring amino acid
  misc_feature (277)..(277): Xaa can be any naturally occurring amino acid
MSRERANRRFYRVESTSNLLSCLDRGLAAEQENRWTFEIAWEAANKVGGIYTVIRSKAYVSTEELGDQYCLMGPYKEHCARTEVEEGPLGCEALNKAIEAVRNKGFRVITGRWLVDGNPQIILFDIGSAAWKLDEYKQELWEKTNVGVPHLDIEANDAIILGCMVAEFLGEFRRTSEDYGGGTPPRIVAHFHEWQAGVGLIMIRIRHINVATVFTTHATLLGRYLCAGNTDFYNNLSTFSVDEEAGKRQIYHRYCIERAASHLAHSFTTVXEITXVXAEHLLKRKL

SEQ ID NO: 20433 - protein, 689 aa, Diabrotica virgifera
  misc_feature: Coding regions on vcDNA: vcDNA=SeqID_130; Strand=+; Position=103-2172
  misc_feature: Homolog annotation: Hit_ID=XP_312352.1; Match level="QueryCoverage =98%, HitCoverage=98%, E-value=0.0, Identity=76%"; Hit description =ENSANGP00000012176 [Anopheles gambiae]
  misc_feature: Gene Ontology Annotation: Molecular function=glycogen (starch) synthase activity; Cellular component=cellular_component unknown; Biological process=glycogen metabolism
  misc_feature: Pfam annotation: Pfam_ID=Glycogen_syn; Match level="Score=1708.8, E -value=0, Copies=1"; Pfam description=Glycogen synthase
MSRERANRRFYRVESTSNLLSCLDRGLAAEQENRWTFEIAWEAANKVGGIYTVIRSKAYVSTEELGDQYCLMGPYKEHCARTEVEEGPLGCEALNKAIEAVRNKGFRVITGRWLVDGNPQIILFDIGSAAWKLDEYKQELWEKTNVGVPHLDIEANDAIILGCMVAEFLGEFRRTSEDYGGGTPPRIVAHFHEWQAGVGLIMIRIRHINVATVFTTHATLLGRYLCAGNTDFYNNLSTFSVDEEAGKRQIYHRYCIERAASHLAHSFTTVSEITGYEAEHLLKRKPDVITPNGLNVKKFSALHEFQNLHALSKDKIHEFVRGHFYGHYDFDLDKTLYFFIAGRYEFGNKGADIFIEALARLNHYLKSTHPDVTVVAFMIFPAKTNNFNVESLRGHAVTKALRDTINDIQNKIGKRMYECCLNGRLPNGNDMLEKEELVRLKRCIYSLQRDGLPPVTTHNVQDDWNDPVLNSVRRCSLFNTTHDRVKIVFHPEFLSSTNPLFGLDYEEFVRGCHLGVFPSYYEPWGYTPAECTVMGIPSITTNLSGFGCFMQEHIMDPMSYGIYIVDRRYIGLEDSVKQLAQFMYDFARLSRRQRIIQRNRTERLSDLLDWRNLGVYYRQARMKALHKVFPDYKEEMEYGLEFKYPRPISEPPSPSSSKVTTPAASVHGSDDEGDSVDSEAELEELRRAL

SEQ ID NO: 20434 - protein, 95 aa, Diabrotica virgifera
  misc_feature: Coding regions on vcDNA: vcDNA=SeqID_131; Strand=-; Position=536-823
NSVEIIKNQGAIQLLTEECSKAQLVVLRKVISASIKIECQELLIDVGSCMYGNSFFKRVVRPTVQILLLLDICMCQLCNNKENFCWSESKENETL

SEQ ID NO: 20435 - protein, 114 aa, Diabrotica virgifera
  misc_feature: Coding regions on vcDNA: vcDNA=SeqID_132; Strand=+; Position=3-347
  misc_feature: Homolog annotation: Hit_ID=XP_395531.1; Match level="QueryCoverage =97%, HitCoverage=32%, E-value=9e-39, Identity=69%"; Hit description =similar to ENSANGP00000010866 [Apis mellifera]
  misc_feature: Gene Ontology Annotation: Molecular function=pyruvate dehydrogenase (lipoamide) activity; Cellular component=extracellular space; Biological process=acetyl-CoA metabolism
ATYRYSGHSMSDPGTSYRTRDEIQEVRQTRDPITSFKEKIISSNLVTPDEIKKIDGEIRTQVDEATKQAKSDAELGLDELPADIYAVNLEGQIRNIDPWTTLTHKRIGPAVNLK

SEQ ID NO: 20436 - protein, 412 aa, Diabrotica virgifera
  misc_feature: Coding regions on vcDNA: vcDNA=SeqID_133; Strand=+; Position=123-1361
  misc_feature: Homolog annotation: Hit_ID=XP_318026.1; Match level="QueryCoverage =95%, HitCoverage=99%, E-value=1e-162, Identity=69%"; Hit description= ENSANGP00000010866 [Anopheles gambiae]
  misc_feature: Gene Ontology Annotation: Molecular function=pyruvate dehydrogenase activity; Cellular component=extracellular space; Biological process= acetyl-CoA metabolism
  misc_feature: Pfam annotation: Pfam_ID=E1_dh; Match level="Score=540.4, E-value =1.7e-159, Copies=1"; Pfam description=Dehydrogenase E1 component
NLLLNKRHLQSSHLSIRMLPNCVRTVCTKTVLPKKTLGAFSKNFATEASFETKPYRLHKLDESPATSVTLNKEDAINYYTQMHTIRRMETAAGNLYKDKIIRGFCHLYSGQEAVAVGIKAALRPYDGVITAYRAHGWTYLMGVPPVGVLSELCGRQKGCAKGKGGSMHMYTENFYGGNGIVGAQVPLGVGIALAAQYKGTDGVCIALYGDGAANQGQVFEVYNMAKLWNIPCIFVCENNGYGMGTSAERASASTTYYSRGDYVPGIWVDGMDVLAVRECFRYAVNYAGSGKGPLVIEAATYRYSGHSMSDPGTSYRTRDEIQEVRQTRDPITSFKEKIISSNLVTPDEIKKIDGEIRTQVDEATKQAKSDAELGLDELPADIYAVNLEGQIRNIDPWTTLTHKRIGPAVNLK

SEQ ID NO: 20437 - protein, 192 aa, Diabrotica virgifera
  misc_feature: Coding regions on vcDNA: vcDNA=SeqID_134; Strand=+; Position=203-781
  misc_feature: Homolog annotation: Hit_ID=XP_393591.1; Match level="QueryCoverage =96%, HitCoverage=98%, E-value=2e-34, Identity=42%"; Hit description =similar to CG30176-PA [Apis mellifera]
  misc_feature: Gene Ontology Annotation: Molecular function=molecular_function unknown; Cellular component=cellular_component unknown; Biological process=biological_process unknown
MSLANNNVVAENGEQYIPATQRPDGTWRKARRVKEGYVPQEEVPLYESKGKQILNRKNEPVVLASGQVAKKATIPGLYIVEDEVEKKKKPKKKMEEVEKLISNIKISEPPKQKSAKPAKKDPKPAQDTNAQEATTDPQKKLKNLKKRLREVESLEEKIKNGTLAKPEPEQLVKVKRKNDLIVLIHELEKMLQ

SEQ ID NO: 20438 - protein, 131 aa, Diabrotica virgifera
  misc_feature: Coding regions on vcDNA: vcDNA=SeqID_135; Strand=+; Position=83-478
  misc_feature: Homolog annotation: Hit_ID=NP_731509.1; Match level="QueryCoverage =99%, HitCoverage=99%, E-value=1e-55, Identity=80%"; Hit description =CG17136-PC, isoform C [Drosophila melanogaster] ref|NP_524307.1| CG17136-PA, isoform A [Drosophila
  misc_feature: Gene Ontology Annotation: Molecular function=pre-mRNA splicing factor activity; Cellular component=nuclear speck; Biological process =spliceosome assembly
  misc_feature: Pfam annotation: Pfam_ID=RRM_1; Match level="Score=76.1, E-value=9.3e- 20, Copies=1"; Pfam description=RNA recognition motif. (a.k.a. RRM, R
MSRHREWELSCKVYVGNLGSSASKHEIEAAFGKYGPLRNVWVARSPPGFAFVEFEDTRDAEDAVRGLDGTRCCGTRVRVEMSNGRSRRGGGGGRRGPSRYSRSRSPRRSRSPRSRSRSRDSRGRSDSRDRR

SEQ ID NO: 20439 - protein, 289 aa, Diabrotica virgifera
  misc_feature: Coding regions on vcDNA: vcDNA=SeqID_136; Strand=+; Position=143-1009
  misc_feature: Homolog annotation: Hit_ID=EAA08075.2; Match level="QueryCoverage =94%, HitCoverage=63%, E-value=1e-100, Identity=62%"; Hit description= ENSANGP00000002975 [Anopheles gambiae str. PEST] ref|XP_563592.1| ENSANGP00000002975 [Anopheles gambiae s
  misc_feature: Gene Ontology Annotation: Molecular function=molecular_function unknown; Cellular component=plasma membrane; Biological process =biological_process unknown
  misc_feature: Pfam annotation: Pfam_ID=TMS_TDE; Match level="Score=269.1, E-value =7.4e-78, Copies=1"; Pfam description=TMS membrane protein/tumour different
MGAVLGLCSAAQLACCCSSAACSLCCSACPSCRNSTSSRIMYALMLLVATVAACITLSPGLESALQKVPFCKNSSALVPDSVVFDCKQAVGYLAVYRICFILTCFFALMSLMMIGVKTSKDARAGIQNGFWGIKYLLVIGGIIGAFFIPEGSFGSVWMVFGMIGGFLFILIQLILIIDFAHSWAEAWVGNFEETGSKGWYVALIGMTMLNYILSITGIVLLYVFYTKANDCGLNKFFISINLIICLIVSVLSILPAVQDKLPRSGLLQSSVVTVYVVYLTLSAVSIQAK

SEQ ID NO: 20440 - protein, 390 aa, Diabrotica virgifera
  misc_feature: Coding regions on vcDNA: vcDNA=SeqID_137; Strand=+; Position=72-1241
  misc_feature: Homolog annotation: Hit_ID=XP_319310.1; Match level="QueryCoverage =100%, HitCoverage=20%, E-value=0.0, Identity=82%"; Hit description =ENSANGP00000024621 [Anopheles gambiae] gb|EAA43615.1| ENSANGP00000024621 [Anopheles gambiae
  misc_feature: Gene Ontology Annotation: Molecular function=structural constituent of muscle; Cellular component=muscle myosin; Biological process =striated muscle contraction
  misc_feature: Pfam annotation: Pfam_ID=Myosin_head; Match level="Score=68.3, E -value=8.5e-18, Copies=1"; Pfam description=Myosin head (motor domain)
  misc_feature (361)..(361): Xaa can be any naturally occurring amino acid
  misc_feature (375)..(375): Xaa can be any naturally occurring amino acid
MPKPQKQEGDDPDPTPYLFVSLEQKRIDQTKPYDAKKSCWVPDDKEGFLLGEIKGTKGDLVTVGLPGGEEKNFKKDQVTQVNPPKYEKAEDMSNLTYLNDASVLHNLKQRYYHKLIYTYSGLFCVAINPYKRFPVYTNRCAKLYRGKRRNEVPPHIFAISDGAYVNMLTNHENQSMLITGESGAGKTENTKKVIAYFATVGASTKKDADPNQKKGNLEDQVVQTNPVLEAFGNAKTVRNDNSSRFGKFIRIHFGPTGKLAGADIETYLLEKARVISQQPLERSYHIFYQIMSGSVPGVKEKCLLSNNINEYNFVAQGKTTIPGVDDAEECRLTDEAFDILGFTQEEKDNVYKITAAVMHMXCMKFKQRGREEQAXTDGTEEGERVSKLLG

SEQ ID NO: 20441 - protein, 411 aa, Diabrotica virgifera
  misc_feature: Coding regions on vcDNA: vcDNA=SeqID_138; Strand=+; Position=82-1313
  misc_feature: Homolog annotation: Hit_ID=XP_319310.1; Match level="QueryCoverage =99%, HitCoverage=21%, E-value=0.0, Identity=81%"; Hit description =ENSANGP00000024621 [Anopheles gambiae] gb|EAA43615.1| ENSANGP00000024621 [Anopheles gambiae
  misc_feature: Gene Ontology Annotation: Molecular function=structural constituent of muscle; Cellular component=muscle myosin; Biological process =striated muscle contraction
  misc_feature: Pfam annotation: Pfam_ID=Myosin_head; Match level="Score=404.1, E -value=1.8e-118, Copies=1"; Pfam description=Myosin head (motor domain)
  misc_feature (398)..(398): Xaa can be any naturally occurring amino acid
  misc_feature (404)..(404): Xaa can be any naturally occurring amino acid
FVQLEAFGNAKTVRNDNSSRFGKFIRIHFGPTGKLAGADIETYLLEKARVISQQPLERSYHIFYQIMSGSVPGVKEKCLLSNNINEYNFVAQGKTTIPGVDDAEECRLTDEAFDILGFTQEEKDNVYKITAAVMHMGCMKFKQRGREEQAEPDGTEEGERVSKLLGVEAPALYQALVKPRIKVGNEFVTQGRNVNQVSYSVGAMSKAMFDRVFKFLVKKCNETLDTKQKRQHFIGVLDIAGFEIFDFNGFEQLCINFTNEKLQQFFNHHMFVLEQEEYQREGIEWAFIDFGMDLAACIELIEKPMGILSILEEESMFPKATDKTFEEKLNTNHLGKSPNFQKPKPPKPGQQAAHFTLGHYAGNVPYNITGWLEKNKDPLNDTVVDLYKKGSNALVVEXFADHPXSSGGAAE

SEQ ID NO: 20442 - protein, 261 aa, Diabrotica virgifera
  misc_feature: Coding regions on vcDNA: vcDNA=SeqID_139; Strand=+; Position=81-866
  misc_feature: Homolog annotation: Hit_ID=NP_611243.1; Match level="QueryCoverage =88%, HitCoverage=88%, E-value=4e-69, Identity=53%"; Hit description =CG6459-PA [Drosophila melanogaster] gb|AAF57817.1| CG6459-PA [Drosophila melanogaster]
  misc_feature: Pfam annotation: Pfam_ID=MAM33; Match level="Score=71.2, E-value=2.8e- 18, Copies=1"; Pfam description=Mitochondrial glycoprotein
MNNILKVAQRLNGVRSLLNPIKNGISSSINQQRQIARSIWYMSNSQRNGIIKEVEHTQLCSCGCGSKRASHTKAEKELVEFLTEEIVAERKAQKIKTIPTELGGFKANLNGAEITLTKTAGDETIKLSFNVNHSVDSDVEPEVNENMDKPDIGELKSKPSFKVEIVRGNTTISLLCSYMNANEQDDGYNDIFGIDEISIYEGEWNENVYSVSGEVLDTYLYDLLLNYLEEKGISNDFVEKLSKYSTTYEHSAYIGLLYGLS

SEQ ID NO: 20443 - protein, 285 aa, Diabrotica virgifera
  misc_feature: Coding regions on vcDNA: vcDNA=SeqID_140; Strand=+; Position=283-1137
MALNDFVNTTIKCLTLPAAIITGIQAAIWFTLSLLAIFCYNNIIGRSDSLEKTSYGYIIYTYYLQPTDEIQEQYIVHPKALNIFMYVYLVLSFIWLVISISLAWVTIKKKWKAVSKVLICWAITTIIIAILDITLMSLLASDIQKARSNNQSLIRGQSYEMRQTEYTALGIVMSIVARGYILWILNVVFAIVLMVSVCRQRRKPRRSLLSPINAYQSGPAPFSLYDNVQIDNTFENRGFDSEESLFSPPSSELRRPSNGLNPLSNSAMNPLHPYEYGRPPSDESR

SEQ ID NO: 20444 - protein, 622 aa, Diabrotica virgifera
  misc_feature: Coding regions on vcDNA: vcDNA=SeqID_141; Strand=+; Position=96-1961
  misc_feature: Homolog annotation: Hit_ID=AAH84440.1; Match level="QueryCoverage =97%, HitCoverage=91%, E-value=1e-50, Identity=28%"; Hit description =Unknown (protein for MGC:86536) [Xenopus laevis]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=286.7, E-value =3.7e-83, Copies=12"; Pfam description=Zinc finger, C2H2 type
  misc_feature (586)..(586): Xaa can be any naturally occurring amino acid
MESLNTLDSILNDSAKDPTTTIGETLPPQKFETDYIQFMDNNQMLLTCRECAKMFTTLEGLRCHKRIHTGGMYKCKQCDKEYTRLNHLQRHEQSHNRRKVHVCRICSKTLTRMEHLKRHLVTHLREKPFSCKTCNRGFNRIEHLHNHAPRCKGDTVYPCDICNKAFNREDSLEVHRKMHDSTTPKLPTIENLDNIEDHYYQIDQDPSMDFSDHEHLSDVDDYFEPQVEVTETIEDDDKLKVAEEISTQQEEENQDDKSIHSDGSIGGGDIGVDIDNDNESDEEEDFDEDKEDNDADTSMEKGPKDLTGIDDEENEDQKSVKLEDEKPEIDIDEQMLKNVIAEVEGEVSDDDDSDKESNDSDYMPVKKSPPVKRGRGRPRKNADAPPKPPKKPGTGKRGRKPGSKNKNKIDREIKKEKDDDYGDYPCPVCNEMFNTMSKLDRHAKYKHEGAKIHKCNVCSKAFSRVNHLKRHITSHSTIKPFRCTVCTKSFNRRDHLNQHQKLHERTNDYECEICQKPFSRADHLAKHKASKHGIGERICVMGEKKFECPLCHKFFTTEKYRDVHVAGHNGTKEYSCRVCEKTFLSXSHLTEHMKFHNEHSKKFLCSECGQRFIRNDYLVIHM

SEQ ID NO: 20445 - protein, 60 aa, Diabrotica virgifera
  misc_feature: Coding regions on vcDNA: vcDNA=SeqID_142; Strand=+; Position=20-202
EKIINTISGATSPKALGLGILQIIDFFPSSLYCSSKGGIVRSCKSNIFILEMLKYLRYYI

SEQ ID NO: 20446 - protein, 454 aa, Diabrotica virgifera
  misc_feature: Coding regions on vcDNA: vcDNA=SeqID_143; Strand=+; Position=187-1546
  misc_feature: Homolog annotation: Hit_ID=NP_608819.1; Match level="QueryCoverage =97%, HitCoverage=74%, E-value=1e-135, Identity=52%"; Hit description= CG3702-PA [Drosophila melanogaster] gb|AAF51035.2| CG3702-PA [Drosophila melanogaster]
  misc_feature: Gene Ontology Annotation: Cellular component=integral to plasma membrane; Biological process=development
  misc_feature: Pfam annotation: Pfam_ID=CLPTM1; Match level="Score=432.7, E-value =4.3e-127, Copies=1"; Pfam description=Cleft lip and palate transmembrane pr
  misc_feature (418)..(418): Xaa can be any naturally occurring amino acid
  misc_feature (420)..(420): Xaa can be any naturally occurring amino acid
MSAAQKEVNGAPPGEITASNEEPGVAQNDAAQQRAPTKMESFLAVVKSLIIRAMIMYFIFSFFRSPQPQKPTNDQGVKLPQTAARNIFPDGTIMNLYIYLSENETMDNYSPSNVFWYKEGLKYGDWTSGKDKDGSYTIEKDVPITAHMKNNGSLFIHAYLVRSGYSPDPEAKNFAKNQMSSVMKQLNRYKKLKASGTKNLLTGETEKEIVEDGKIISHWHPNFTLNLVTDQTLWNYGGVPVPLDQFIRFTDDGKQYKPVLFANDFWNMARDYKPLNETYSLQITFQPLSLFKWQLYAAQHMRQSWNVWGDEQTQSDEEQDTLKETLMDTNPYLLGITIAVSIVHSVFELLAFKNDIQFWNNRNSLEGLSVRSVFFGVFQSLVVLLYVLDNETNTLIRVSCLVGLGIEIWKIWKVVDIXNXENGRLTFKDKSSYVQSSTKVYDKLALNTNPWVCF

SEQ ID NO: 20447 - protein, 291 aa, Diabrotica virgifera
  misc_feature: Coding regions on vcDNA: vcDNA=SeqID_144; Strand=+; Position=16-891
  misc_feature: Homolog annotation: Hit_ID=NP_732949.1; Match level="QueryCoverage =91%, HitCoverage=60%, E-value=2e-80, Identity=54%"; Hit description =CG5991-PC, isoform C [Drosophila melanogaster] ref|NP_732948.1| CG5991-PB, isoform B [Drosophila
  misc_feature: Gene Ontology Annotation: Molecular function=phosphatidylserine decarboxylase activity; Cellular component=mitochondrial inner membrane; Biological process=lipid metabolism
  misc_feature: Pfam annotation: Pfam_ID=PS_Dcarbxylase; Match level="Score=64.7, E -value=2.5e-16, Copies=1"; Pfam description=Phosphatidylserine decarboxylase
  misc_feature (249)..(249): Xaa can be any naturally occurring amino acid
  misc_feature (288)..(288): Xaa can be any naturally occurring amino acid
MDKVDFEVFYLVSYFFVEGGSEWQMIITRFLPVGICLVAVMQWRALRKRQKEGIASKWEINCYCLLPLRTVSRCWGYIADVTLPEVLRPPVYKMYSNAFGVNIAEAENEDLTSYPSLADFFARSLKSGVRQVDESSCLVSPCDGTVLHFGTVDTEQVEQVKGVTYSLKDFFGENTGKGQKYNGDFKTSLLHKPHEGNVLYQCVIYLAPGDYHRFHSPSEWKPTHRRHFSGQLLSVNPSIASWLPGLFTXHERAVYLGQWKYGFFSYTAVGATNVGTVKVYFDKTFATXQPF

SEQ ID NO: 20448 - protein, 238 aa, Diabrotica virgifera
  misc_feature: Coding regions on vcDNA: vcDNA=SeqID_145; Strand=+; Position=66-782
  misc_feature: Homolog annotation: Hit_ID=XP_321064.1; Match level="QueryCoverage =98%, HitCoverage=98%, E-value=1e-120, Identity=89%"; Hit description= ENSANGP00000011336 [Anopheles gambiae]
  misc_feature: Gene Ontology Annotation: Molecular function=endopeptidase activity; Cellular component=cytosol; Biological process=proteolysis and peptidolysis
  misc_feature: Pfam annotation: Pfam_ID=Proteasome; Match level="Score=246.0, E -value=7e-71, Copies=1"; Pfam description=Proteasome A-type and B-type
LQVIMASERYSFSLTTFSPSGKLVQIEYALAAVAAGAPSVGIKASNGVVIATENKHKSILYDEHSVHKVEMITKHIGMVYSGMGPDYRLLVRQARKMAQQYYLVYHEPIPTVQLVQRVATVMQEYTQSGGVRPFGVSLLICGWDNNRPYLFQCDPSGAYFAWKATAMGKNYVNGKTFLEKRYSEELELDDAVHTAILTLKESFEGQMTADNIEVGICDANGFRRFDPSTVKDFLANIP

SEQ ID NO: 20449 - protein, 520 aa, Diabrotica virgifera
  misc_feature: Coding regions on vcDNA: vcDNA=SeqID_146; Strand=+; Position=133-1698
  misc_feature: Homolog annotation: Hit_ID=EAA13062.2; Match level="QueryCoverage =97%, HitCoverage=67%, E-value=1e-70, Identity=30%"; Hit description =ENSANGP00000014382 [Anopheles gambiae str. PEST] ref|XP_554734.1| ENSANGP00000014382 [Anopheles gambiae st
  misc_feature (190)..(190): Xaa can be any naturally occurring amino acid
  misc_feature (193)..(193): Xaa can be any naturally occurring amino acid
  misc_feature (205)..(205): Xaa can be any naturally occurring amino acid
  misc_feature (213)..(214): Xaa can be any naturally occurring amino acid
  misc_feature (222)..(222): Xaa can be any naturally occurring amino acid
MRLKLNVEIIVLLALPVVIQCQLNAVKSEVLAICYNESAIPGITIANNRPPATLNVFLEILRRIEDANPAMGINNLAALLIQKLRQNGIEETRRAVNINIALPYAPTGQDALKGTIIFDEYLPTSQIRLSYGDLSMADVCAFHYMISNSINKTIRGDEDQTCIRSARYQMRRTRATSRKDVETIEKQSRXIVXSTGEPSLCPIEXGVVYNDYXXFKAGQVIXGLAAGLNPPIYLSIYGNSTQYRCTGDLCQAALIQMSPPFQLGGSGGWNSTTNPKYYFLQQNDNLDLTDQDIRGSLDGLYMALKINDIKGKTDVKISQVLDMYYSPQQKGVFNTSFRACNRNILYSELVDSKTLQKNINNLMSVMDDKGQYPGYIVPEKYPTLAEAAFNNFASYLPRLNVDLQCPQLDSGIERVRTDLLIFIDPNWEYRTIQPILSYILDNIDVNKFASRYSLFSGADASNITNSTSYLLEFHNSYNLSVHQRLPRSFDYSKVYEKLESVAKSKLKTHTYNWRVNHHTP

SEQ ID NO: 20450 - protein, 518 aa, Diabrotica virgifera
  misc_feature: Coding regions on vcDNA: vcDNA=SeqID_147; Strand=+; Position=88-1641
  misc_feature: Homolog annotation: Hit_ID=EAA13062.2; Match level="QueryCoverage =96%, HitCoverage=65%, E-value=8e-76, Identity=31%"; Hit description =ENSANGP00000014382 [Anopheles gambiae str. PEST] ref|XP_554734.1| ENSANGP00000014382 [Anopheles gambiae st
MRLKLNVEIIVLLALPVVIQCQLNAVKSEVLAICYNESAIPGITIANNRPPATLNVFLEILRRIEDANPAMGINNLAALLIQKLRQNGIEETRRAVNINIALPYAPTGQDALKGTIIFDEYLPTSQIRLSYGDLSMADVCAFHYMISNSINKTIRGDEDQTCIRSARYQMRRTRATSRKDVETIEKQSRQSFGSTGEPSLCPIEKGVVYNDYGPFKAGQVIQGLAAGLNQEVDPNNVDNRYAATLAGDLCQAALIQMSPPFQLGGSGGWNSTTNPKYYFLQQNDNLDLTDQDIRGSLDGLYMALKINDIKGKTDVKISQVLDMYYSPQQKGVFNTSFRACNRNILYSELVDSKTLQKNINNLMSVMDDKGQYPGYIVPEKYPTLAEAAFNNFASYLPRLNVDLQCPQLDSGIERVRTDLLIFIDPNWEYRTIQPILSYILDNIDVNKFASRYSLFSGADASNITNSTSYLLEFHNSYNLSVHQRLPRSFDYSKVYEKLESVAKSKLNNNTHWRHHHTP

SEQ ID NO: 20451 - protein, 355 aa, Diabrotica virgifera
  misc_feature: Coding regions on vcDNA: vcDNA=SeqID_148; Strand=+; Position=118-1182
  misc_feature: Homolog annotation: Hit_ID=EAA13062.2; Match level="QueryCoverage =97%, HitCoverage=43%, E-value=7e-35, Identity=27%"; Hit description =ENSANGP00000014382 [Anopheles gambiae str. PEST] ref|XP_554734.1| ENSANGP00000014382 [Anopheles gambiae st
MSVMDDKGQYPGYIVPEKYPTLAEAAVRNFASYLPRLNVDLQCPQLDSGIERVRTDLLIFIDPNWEYRTIQPILSYILDNIDVNKFASRYSLFSGADASNITNSTSYLLEFHNSYNLSVHQRLPRSFDYSKVYEKLESVAKSKLNNNTYNGGESTIILLITKNAPTGNQETFVKQRKEIIKQYLPDLSLLVLGEGSSTDYSSMLLNPSKDFISLSSTTNDDNLKNIGQNVVDAIKRIPRAIVNPACGSSFVGSASATSYSDSVDLYGTNYYKISPYYFATGSNGRSLRITEPSTGSITVCISRDNDRPTSLNGNCQTLQSSVKSYDLSNYLWHYARDWSPIYLSIYGKFYTVSLY

SEQ ID NO: 20452 - protein, 74 aa, Diabrotica virgifera
  misc_feature: Coding regions on vcDNA: vcDNA=SeqID_149; Strand=+; Position=2-226
  misc_feature (41)..(41): Xaa can be any naturally occurring amino acid
VLREIINVTLHVCFGVNSVNTSDSTRNHHWEHFKGNHGKAXKHPFEETSRLSVLQSTQKLISAHSAIYEQRIVG

SEQ ID NO: 20453 - protein, 260 aa, Diabrotica virgifera
  misc_feature: Coding regions on vcDNA: vcDNA=SeqID_150; Strand=+; Position=224-1006
  misc_feature: Homolog annotation: Hit_ID=NP_727758.1; Match level="QueryCoverage =96%, HitCoverage=92%, E-value=7e-17, Identity=33%"; Hit description =CG32603-PA [Drosophila melanogaster] gb|AAN09580.1| CG32603-PA [Drosophila melanogaster]
MFKLVVLFALVALTVAKPSGVYLESPLVETYSLPVVSSGVSHTYRKDVISEPAVVAYSAPAVVSAPVVQEVVAPVVTKVASPVLAVPSAVSHTYRKDVISEPVVAVHSAPAVVASPVVEQVVAKVAVPSAVSHTYRKDVISEPVVAVHSAPAVVASPVVEQVVAKVAVPSAVSHSYRKDVISEPVVAVHSAPVVAEVASPVVAAHYSAPVALSSAVSHSYRSDLHQPIVASYSLPAVEYSHVGHVAPVAYSAHVPAVQAW

SEQ ID NO: 20454 - protein, 296 aa, Diabrotica virgifera
  misc_feature: Coding regions on vcDNA: vcDNA=SeqID_151; Strand=+; Position=133-1023
  misc_feature: Homolog annotation: Hit_ID=EAA05284.2; Match level="QueryCoverage =99%, HitCoverage=100%, E-value=1e-113, Identity=70%"; Hit description=ENSANGP00000011203 [Anopheles gambiae str. PEST] ref|XP _564287.1| ENSANGP00000011203 [Anopheles gambiae
  misc_feature: Gene Ontology Annotation: Molecular function=3'-5' exoribonuclease activity; Cellular component=nucleus; Biological process=rRNA processing
MPQKIQIRLATHRVNPSVAPNKRYPKIFTPGEVITAQDEFMRGHGTYEENGELKASVAGVREQVNNLISVRPLKSRYNGEIGDVVVGRITEVQQKRWKVDTNSRLDSALLLSSVNLPGGELRRRSVEDEHMMRQFLQEGDLISAEVQNVFSDGALSLHTRSLRYGKLGQGVLVKVFPSLIKRSKTHFHTLPIGASIILGNNGFIWISPIIVNSEDSVGGFIQNLEEVIPRQEREIIGRLRNCVLALTQSKMMLYDTSILYAYEESLKYSVAELLIPEAMVDVAFLTQHRLSMLGIE

SEQ ID NO: 20455 - protein, 367 aa, Diabrotica virgifera
  misc_feature: Coding regions on vcDNA: vcDNA=SeqID_152; Strand=+; Position=144-1247
  misc_feature: Homolog annotation: Hit_ID=XP_321170.1; Match level="QueryCoverage =82%, HitCoverage=69%, E-value=7e-16, Identity=21%"; Hit description =ENSANGP00000020151 [Anopheles gambiae]
  misc_feature: Pfam annotation: Pfam_ID=Arrestin_N; Match level="Score=31.6, E-value= 2e-07, Copies=1"; Pfam description=Arrestin (or S-antigen), N -terminal d
MNIDIILTDPDGTYKPDDIIRGTVTLDLTSTQNIQNILCKFVGNEETSWATSESLYDERTNTMRSGIVHYKGEHNIISCEEQLAKDLILPIGRHDFPFAITVPKRIPSSYSSNNGWIKFGLAVTIQNDLVLYEKEIPIHVKAPINFNDIRGEIQLEPIVYQNEEIIWHCCYAGDPVTMDLILEREAYTVNEPITFKLEVNNKSDREISEIDVTLTLVVETTAAAPRRSRKYYEKLLTGAKARGLAHGQQELYSFRFQVPDVIDIPNFIGSTLFRQKCVLKAECKIQDSDTKLDVQTELKLGHIPVERSRRITHPHGPVRRVHSSGAINRPLGFNFFNTSDNASAPPADYQPTAPRTTDDIDNLPPSL

SEQ ID NO: 20456 - protein, 335 aa, Diabrotica virgifera
  misc_feature: Coding regions on vcDNA: vcDNA=SeqID_153; Strand=+; Position=61-1065
  misc_feature: Homolog annotation: Hit_ID=AAH60415.1; Match level="QueryCoverage =97%, HitCoverage=50%, E-value=1e-101, Identity=57%"; Hit description= MGC68677 protein [Xenopus laevis]
  misc_feature: Gene Ontology Annotation: Molecular function=adenylylsulfate kinase activity; Cellular component=cell; Biological process=nucleotide metabolism
  misc_feature: Pfam annotation: Pfam_ID=APS_kinase; Match level="Score=393.8, E -value=2.2e-115, Copies=1"; Pfam description=Adenylylsulphate kinase
  misc_feature (292)..(292): Xaa can be any naturally occurring amino acid
  misc_feature (303)..(303): Xaa can be any naturally occurring amino acid
MGKGGLLSTEWNIPKATNIKPESHHVTREKRSQILGSTNEKKFRGCTIWFTGLSGAGKTSISFALEERLVSSGVPSYSLDGDNIRYGLNRNLGFSEEDRKENIRRVAEVARLFADAGHICLCSFISPQTADRNIARQIHENNNLPFFEVFVDTPLEICEQRDVKGLYKKARAGKIKGFTGIDQAYEKPENPELVLKTVNASVETAVDIVWELLQKHGILPKLVPDSHLHCNGNENISTAQSVTVPELFVPKNKLQATLAEAKNLPRLDIGVVDLQWLQVLSEGWAYPLKGFXEEDELLQVLHXHTIELNGDKISQSIPIVLAISSEDKNRLPSHK

SEQ ID NO: 20457 - protein, 228 aa, Diabrotica virgifera
  misc_feature: Coding regions on vcDNA: vcDNA=SeqID_154; Strand=+; Position=274-960
  misc_feature: Homolog annotation: Hit_ID=AAM21563.1; Match level="QueryCoverage =90%, HitCoverage=94%, E-value=3e-49, Identity=47%"; Hit description =glutathione S-transferase [Nilaparvata lugens]
  misc_feature: Gene Ontology Annotation: Molecular function=glutathione transferase activity; Cellular component=cellular_component unknown; Biological process=glutathione conjugation reaction
  misc_feature: Pfam annotation: Pfam_ID=GST_N; Match level="Score=54.8, E-value=2.5e- 13, Copies=1"; Pfam description=Glutathione S-transferase, N-terminal
MKPILYHLPPSGNSRGALLAAKVAGVDVDIQIVDIMKREQFTEAFLKINPQHTLPTLVDGDLTLWDSHAIAGYLATQYSKDDNLYPKDPKKRALVDQRLYFDCGTLYPRLRAICFPIIHKGETKIYDEHRASLEEALGFLDGFLEGNDFVTGKHLTIADCSLVGSVSSIVAIGWDVSAHSNIANWITRCALAIPDYEEANQKGADAFGQLVGSKLAPGHCKHCGILYF

SEQ ID NO: 20458 - protein, 431 aa, Diabrotica virgifera
  misc_feature: Coding regions on vcDNA: vcDNA=SeqID_155; Strand=+; Position=209-1503
  misc_feature: Homolog annotation: Hit_ID=XP_318652.1; Match level="QueryCoverage =92%, HitCoverage=92%, E-value=0.0, Identity=84%"; Hit description =ENSANGP00000020847 [Anopheles gambiae]
  misc_feature: Gene Ontology Annotation: Molecular function=alpha-N -acetylgalactosaminidase activity; Cellular component=lysosome; Biological process=carbohydrate metabolism
  misc_feature: Pfam annotation: Pfam_ID=Melibiase; Match level="Score=-140.9, E -value=6.7e-08, Copies=1"; Pfam description=Melibiase
  misc_feature (400)..(400): Xaa can be any naturally occurring amino acid
  misc_feature (403)..(403): Xaa can be any naturally occurring amino acid
  misc_feature (410)..(410): Xaa can be any naturally occurring amino acid
MYKIWFVLAVVVFYLGIDVTPLENGLARTPPMGWLAWERFRCNTDCKNDPENCISENLFRTMADILVNEGYASVGYEYINVDDCWLEKDRSVYGELVPDRVRFPRGMKSLADYVHSKGLKFGIYEDYGNYTCAGYPGVLGSLQRDAETFASWDVDYVKLDGCYAHPRDMDRGYPEFGFHLNRTGRAMIYSCSWPVYQIYAGMSPNFSAIIEHCNMWRNFDDIQDSWTSVESIIDYYGNNQDVLIANAGPGHWNDPDMLIIGNFGLSYEQSKTQMAIWAILAAPLLMSVDLRTIRPEYKAILQNRKIIAVDQDPLGIQGRRIYKHKGIEIWSRPITPLYQSYFSYAIAFVNRRTDGTPSDVAVTLKELGLTSPTGYRVEDLYEDVDYGVLSPQTKIKVKVXPSXVVILRAXCQADFNRRIPFFTTRPVSSSL

SEQ ID NO: 20459 - protein, 314 aa, Diabrotica virgifera
  misc_feature: Coding regions on vcDNA: vcDNA=SeqID_156; Strand=+; Position=40-981
  misc_feature: Homolog annotation: Hit_ID=XP_395079.1; Match level="QueryCoverage =62%, HitCoverage=32%, E-value=5e-30, Identity=41%"; Hit description =similar to ENSANGP00000016599 [Apis mellifera]
  misc_feature: Gene Ontology Annotation: Molecular function=phospholipase A1 activity; Cellular component=extracellular space; Biological process= phosphatidylserine metabolism
  misc_feature: Pfam annotation: Pfam_ID=Lipase; Match level="Score=78.3, E-value=2e -20, Copies=1"; Pfam description=Lipase
MKLQYLSLLVLVTLTGTKCDSGDDLTTPVNFNDANLNTSEVVFETYKVLDRGMKSTDRKGSHFDLYPTRILIHGHGENGQSSWVLTARNAYLGLREPHNVVIVDWATGAAPYETAAANTKPLGELIGKYILDNELELEKLQLIGVGMGAHAAGQAGKYITRVSLHHIGRITGLDVAGPKFELDSVPAEGKLQKTDAFFVDTVHTNVQKFGYKCPIGHVDWYVNGGNVQPGCPVLDSPDLDVCSELRAPDLYVESITYQAPSYECTVTIQNGSSVVTKVPFGRQVVFGENVNLSARGNYSIDTNSVPKYLPHYNL

SEQ ID NO: 20460 - protein, 60 aa, Diabrotica virgifera
  misc_feature: Coding regions on vcDNA: vcDNA=SeqID_157; Strand=+; Position=68-250
LEVFCQRYLFFLLTCRTLMSTMKSIYVCTFTKFRLKISLHLVKEFLERYNMLKYNKKLMG

SEQ ID NO: 20461 - protein, 220 aa, Diabrotica virgifera
  misc_feature: Coding regions on vcDNA: vcDNA=SeqID_158; Strand=+; Position=241-903
MVKRKTVSDSEDEQKPSKKSKASTSEALNPNTPFKPLIIKKEIQEDETTIQPKATPKVKKKKKEHVSSSDSDQEKEKQSTIESILNETKRLVLSTKKPKKPKKSQKQNDASKLNESFTTKNLKTEALDSFENSNVQDEEESGDNLSNEVEPVNNVLNGEKSPRISISDKNEDDNLMEKIENKVQILQNIHVSPTKTKSSQESLKDLYPNIKTSPIKTNLS

SEQ ID NO: 20462 - protein, 316 aa, Diabrotica virgifera
  misc_feature: Coding regions on vcDNA: vcDNA=SeqID_159; Strand=+; Position=433-1383
  misc_feature: Homolog annotation: Hit_ID=CAG02360.1; Match level="QueryCoverage =94%, HitCoverage=87%, E-value=7e-76, Identity=53%"; Hit description =unnamed protein product [Tetraodon nigroviridis]
  misc_feature: Gene Ontology Annotation: Molecular function=electron transporter activity; Cellular component=nucleus; Biological process=induction of apoptosis
  misc_feature: Pfam annotation: Pfam_ID=adh_short; Match level="Score=87.8, E-value =2.8e-23, Copies=1"; Pfam description=short chain dehydrogenase
MGIIFSAKCTSTNRLDGKTAIITGANTGIGKETAKDFYERGAKVILACRNLEKAKAAVADIQKQCTVKSNLGELKVVELDLCSLESVRKCAKELLESEERINLLINNAGVMMCPYSKTKDGFETQFGTNHLAHFLFTLLLLPKICKSMPARIVNVSSIAHTAPFGPMDFTDLNFEKRKYNPVHAYQQSKLANILFTKELARRLTEKDITDVHVYSLHPGVIRTELGRHYDSMFPGLTWVYDNIFGLFIKTPTQGAQTQIYCAVDDNCASETGLYYAECAVTSCSREAENAETARKLWDISMELVGLDKMTTYLKIV

SEQ ID NO: 20463 - protein, 297 aa, Diabrotica virgifera
  misc_feature: Coding regions on vcDNA: vcDNA=SeqID_160; Strand=+; Position=108-998
  misc_feature: Homolog annotation: Hit_ID=CAG09487.1; Match level="QueryCoverage =99%, HitCoverage=38%, E-value=3e-36, Identity=31%"; Hit description =unnamed protein product [Tetraodon nigroviridis]
  misc_feature: Gene Ontology Annotation: Molecular function=3',5'-cyclic-nucleotide phosphodiesterase activity; Cellular component=cellular_component unknown; Biological process=biological_process unknown
  misc_feature (282)..(283): Xaa can be any naturally occurring amino acid
MVTEEQVSAFLAENSKFLEDYIMNKIEIEQIERWIIRKSKISDKTPGTTVQTRKTSLSKWKFCVHADKRQMLKNLTQSLQAKPTQGHVLWELATCISSAVKADGFRLYVIDKENPSQLLLYLATEEDANHSPKLRVIKNNVSIPAYVAKTHEAVRFSRGKSDSRFPDTVVKELQNNIAHIQCQPITQSDGKMVGVIEMWRIDSNNPFYEEDEEIANSYLVWGGIALHYAQLYLNMNQQKKLNEFLLAVVKSIFQDMVSIDSLVIKIMNFAHRLVDADRASLXXCDSKRKELYATIFD

SEQ ID NO: 20464 - protein, 54 aa, Diabrotica virgifera
  misc_feature: Coding regions on vcDNA: vcDNA=SeqID_161; Strand=-; Position=651-815
DVPPRLYSTPGISVPPPPPPPPPFSHIYFSTQTKCSVLVYYSINVSNFARSLFR

SEQ ID NO: 20465 - protein, 99 aa, Diabrotica virgifera
  misc_feature: Coding regions on vcDNA: vcDNA=SeqID_162; Strand=-; Position=730-1029
AHKALCRNQFQNSLVFHQRMHMLLSPNHVAVTYVHAWGSSSSVLLWAYSAKNRIAAIWLQTSLLPAIRIQCAFAMSSELAITPPKPFSRLALAFWKCFT

SEQ ID NO: 20466 - protein, 239 aa, Diabrotica virgifera
  misc_feature: Coding regions on vcDNA: vcDNA=SeqID_163; Strand=+; Position=299-1015
  misc_feature: Homolog annotation: Hit_ID=XP_418537.1; Match level="QueryCoverage =95%, HitCoverage=42%, E-value=2e-66, Identity=55%"; Hit description =PREDICTED: similar to xylulokinase homolog; xylulokinase (H. influenzae) homolog
  misc_feature: Gene Ontology Annotation: Molecular function=xylulokinase activity; Cellular component=cellular_component unknown; Biological process =energy pathways
  misc_feature: Pfam annotation: Pfam_ID=FGGY_N; Match level="Score=-60.3, E-value=3e- 06, Copies=1"; Pfam description=FGGY family of carbohydrate kinases,
  misc_feature (210)..(210): Xaa can be any naturally occurring amino acid
MGDQGDNLYLGLDLSTQQLKAAVVNEKLEIVAEQIVIYDSDLPEFRTQGGAIIDKINNAYITSPTLMWVKALDIVLDKLTVAGINFSKIAAISGSGQQHGSVYWQRGASQTLANLNPGEFLHQQLAHSFAVANSPIWMDSSTTKQCQLLEQAVGGPMKLAEITGSRAYERFTGSQICKINQTRPDAYKSSERISLVSSFVCSLFAGKIAXIDISDGSGMNLMTSKTKNGMKNVLAVCGS

SEQ ID NO: 20467 - protein, 328 aa, Diabrotica virgifera
  misc_feature: Coding regions on vcDNA: vcDNA=SeqID_164; Strand=-; Position=1-984
MKEFAANVDANNKKYEEVIAQQKAEIKELNTEIRRMSEKMDARFDELIALQKQLAKKPEKKNPEKTDKKPPVEQPATKKMTTEQTRPPSQKATTSTKEASTQQRKKRKEEFPPLVTHLPLTDEEDAAWTSDQEKAMKLAPQVQLPLPEEPVPSTSTDRDALAASSQTDTVSMETNQNEEDAEEAVLPENQVTPYRKPPVIKLQSVSETGAILTIAQGKGIITTNKISRSGRETLIQAKSPDDYRKMTRIVEEYAEAYAAKEKKRLQWIAFPLDEDRKPKLVLRGLPTNTTEKAIQEDMANQYGITCHTARNMSTRVGKRRPLPMPTRP

SEQ ID NO: 20468 - protein, 73 aa, Diabrotica virgifera
  misc_feature: Coding regions on vcDNA: vcDNA=SeqID_165; Strand=-; Position=374-595
NNNDEYSTHGFYNSCECRLHRKGTFISRNNHETEVTSFGSILRNILENKILRRCWLNTYRLNFTHCILWTSKN

SEQ ID NO: 20469 - protein, 310 aa, Diabrotica virgifera
  misc_feature: Coding regions on vcDNA: vcDNA=SeqID_166; Strand=+; Position=59-988
  misc_feature: Homolog annotation: Hit_ID=XP_394073.1; Match level="QueryCoverage =99%, HitCoverage=80%, E-value=1e-106, Identity=60%"; Hit description= similar to ENSANGP00000021271 [Apis mellifera]
  misc_feature: Gene Ontology Annotation: Cellular component=ubiquitin ligase complex; Biological process=cell organization and biogenesis
MEACQAVEREIDKVCSKFGNINEHAKRVLSDLVNQIQNLKEEYDNSGSEHVLTELQVDILKQNMVKIKETISKLATDHRDLHSTVSKVGKAIDRNFTADFAATSREEMFNNPDKINLINKVICQHFYRQGMHDVADQLAQESSITPETHEKEPFTEINHILERLKMKDLEPALAWATVHHENLEAQNSSLEFMLHRLKYIEILRKGPVYQTDAICYARLHFSKFMYRHEKEIQTLMGMLLYVPNGINSSPYSCLLDQELWIEICELFLREACQLLGVCVNSPLTTCINAGCTAIPALLNIKQGMMQRQVT

SEQ ID NO: 20470 - protein, 67 aa, Diabrotica virgifera
  misc_feature: Coding regions on vcDNA: vcDNA=SeqID_167; Strand=+; Position=52-255
ITFQMSRHTTSVLIYKEKIDYVITPRWIAVTGAIYVSRVIIGKSNFCILHFFSSSVNKAVCRGVKIW

SEQ ID NO: 20471 - protein, 337 aa, Diabrotica virgifera
  misc_feature: Coding regions on vcDNA: vcDNA=SeqID_168; Strand=+; Position=68-1079
  misc_feature: Homolog annotation: Hit_ID=XP_317529.1; Match level="QueryCoverage =83%, HitCoverage=67%, E-value=4e-30, Identity=30%"; Hit description =ENSANGP00000009979 [Anopheles gambiae]
  misc_feature: Gene Ontology Annotation: Molecular function=molecular_function unknown
  misc_feature: Pfam annotation: Pfam_ID=DUF227; Match level="Score=39.7, E-value =8.8e-09, Copies=1"; Pfam description=Domain of unknown function (DUF227)
  misc_feature (302)..(302): Xaa can be any naturally occurring amino acid
MDIIEKTLSYNNKLIEPPPDNIVVQNEDNEEVHYVNIHEVHVNKVIEKKLGTNHFVLLNYELKPITDRLGLLGDHSILFVTFLNNIGSKEHLQFFVKYFPFTESQAQFADGIGAFEKEALVYKLFKEFYKQGITQASNVVPYCYVVAPKKYFILNDLTLESYQILNKHICLEYDVVVVVLQALAQLHSGSIAYEEKLKKNLLDLYGKDLDETFFNDRKGFPNVEGVESCIKCIVDEIKLFNFPNKLASGKVFTEVADTVCRKIYQAVKPSKTVRNVLTHGDIWTNNILIKYDKKSNKPIGCXWVDFQAGRYAPPAQDVLWLFLYLNTRRDFRKKYLY

SEQ ID NO: 20472 - protein, 302 aa, Diabrotica virgifera
  misc_feature: Coding regions on vcDNA: vcDNA=SeqID_169; Strand=+; Position=2-907
  misc_feature: Homolog annotation: Hit_ID=AAU81605.1; Match level="QueryCoverage =86%, HitCoverage=45%, E-value=1e-48, Identity=43%"; Hit description =juvenile hormone esterase [Apis mellifera] dbj|BAC54130.1| esterase [Apis mellifera]
  misc_feature: Gene Ontology Annotation: Molecular function=carboxylesterase activity
  misc_feature: Pfam annotation: Pfam_ID=COesterase; Match level="Score=5.0, E-value =2.4e-11, Copies=1"; Pfam description=Carboxylesterase
LLVKLFFIVFVFYQTVETKASLLDVSNLDEDELIVTLLKPSSKIRGHRLMTRLGQDYYAFQDIPYAQAPIGKNRFKPAIASEGWPDILDATSNKKKCFQPGSPVPFDTLIETEDCLLVNVYTPVKPGTRPYLPVYFWIHGGGFNTGNGAIGTLDPRNFMDYDVIVVTINYRLGVLGFLSTDDESIPGNLGLKDQQFALKWTYDNIKAFGGDPKKITIGGESAGASSVSYHLLHTGNKDLIKGIIQESGSALNTFAYQINCTENAFTYARLLDTFTSNSSQDLLELLQKTPAETLNRTQSNMH

SEQ ID NO: 20473 - protein, 291 aa, Diabrotica virgifera
  misc_feature: Coding regions on vcDNA: vcDNA=SeqID_170; Strand=+; Position=73-944
  misc_feature: Homolog annotation: Hit_ID=XP_394516.1; Match level="QueryCoverage =100%, HitCoverage=45%, E-value=1e-103, Identity=67%"; Hit description=similar to ENSANGP00000021505 [Apis mellifera]
  misc_feature: Gene Ontology Annotation: Biological process=cell growth and/or maintenance
  misc_feature (266)..(266): Xaa can be any naturally occurring amino acid
MSYSVNISVEAPIENQIQEITYDGTEIYQPPLTLSESLAKYAQKIDFSKTSELEIKKEETNEDAKSDTDSKDAFQSSLWPWDSVRNKLRNALTEVCVLADVLAIAKDKRYLVLDPVQQESLDTKPMVQIYARKKALAGAASVLLAGAEKMKNSQNEAARSRTTLDFHIELLRLRQNWRLKKVSNTIIGDLSYRTTGSKYLQTGTFEVTKAEDEEKTNSPPSSPLPGGPAPVKPTSALRVSIPSELQGVAYIEVLCQKDQEDLCTAXLTLLGSGPPPSNPDMHWAQKLEAAQ

SEQ ID NO: 20474 - protein, 286 aa, Diabrotica virgifera
  misc_feature: Coding regions on vcDNA: vcDNA=SeqID_171; Strand=+; Position=127-987
  misc_feature: Homolog annotation: Hit_ID=XP_317201.1; Match level="QueryCoverage =98%, HitCoverage=72%, E-value=1e-131, Identity=79%"; Hit description= ENSANGP00000006742 [Anopheles gambiae]
  misc_feature: Gene Ontology Annotation: Molecular function=molecular_function unknown; Cellular component=cellular_component unknown; Biological process=protein biosynthesis
  misc_feature: Pfam annotation: Pfam_ID=eRF1_2; Match level="Score=176.8, E-value =4.7e-50, Copies=1"; Pfam description=eRF1 domain 2
  misc_feature (245)..(245): Xaa can be any naturally occurring amino acid
  misc_feature (262)..(262): Xaa can be any naturally occurring amino acid
MKLISQDVDKNGEGTVALIPEEPEDMWHAYNLISEGDSVKSTTIRKVQSESSTGSSTSSRVRTTLTISVENIDFDTQACMLRLKGRNIEENQYVKMGAYHTLDLELNRKFSLRKPEWDSVSLERIDMACDPTKSADVAAVIMQEGLAHVCLITSSMTLVRAKIDVNIPRKRKGFVQQHEKGLAKFYDTVMQAILRHINFDIVKCILVASPGFVKDQFYEYMFQTAVKTDNKILLENKSKFMLIHXSSGFKHSLQEILQDPSXINKISDTKAAGEVKSWETFTRCFI

SEQ ID NO: 20475 - protein, 133 aa, Diabrotica virgifera
  misc_feature: Coding regions on vcDNA: vcDNA=SeqID_172; Strand=-; Position=137-538
LSSRASAKLLSLLFILQQLFEMCAAIENLASCEVRTVLRFLLTKNSKSIEIYREICAAYRNNVITEGGVRQWCIKFKNSRTNVHYEEQSEPWFPTYHLFRAMKTLLVTQCFDNDAKLWDGVKHLVKVSGGRIL

SEQ ID NO: 20476 - protein, 270 aa, Diabrotica virgifera
  misc_feature: Coding regions on vcDNA: vcDNA=SeqID_173; Strand=+; Position=225-1037
  misc_feature: Homolog annotation: Hit_ID=XP_391957.1; Match level="QueryCoverage =87%, HitCoverage=20%, E-value=5e-49, Identity=41%"; Hit description =similar to CG6621-PA [Apis mellifera]
METVNSQLLTKAINFHGQQLQKLWEGEFGENDLTRKNVKDLNYNVYSQRQKNLSFQDRGKRLKLQQFLIKKANFIYSLEPTKQKNNEKAITEDMYAVMPPFETYTSVDKQKRVAFFMENVKVGNLILGTIVSRQQSGMMLKVLCTTGNGNTCLYAADINVKAFCPVANVINAVDKKGVSRNYMMNDYVCCEVLEIMPDTDKLICGMMGVTRKSSDPEHRPPLGLISTEDFPLIYKHFVLPKIQKNTIKAMSKYCVKVVKLGMFSTVAICI

SEQ ID NO: 20477 - protein, 296 aa, Diabrotica virgifera
  misc_feature: Coding regions on vcDNA: vcDNA=SeqID_174; Strand=+; Position=149-1039
  misc_feature: Homolog annotation: Hit_ID=AAU84922.1; Match level="QueryCoverage =90%, HitCoverage=80%, E-value=4e-49, Identity=40%"; Hit description =putative cathepsin L [Toxoptera citricida]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=130.5, E -value=4e-36, Copies=1"; Pfam description=Papain family cysteine protease
MKYTGFILLVALLIVCECRNDSTKEEWKRFKLQFNKTYATNKEDLKRYKVFKENLKNIHKHNKRFEKGKETYLQEMNRFGDLTDKEFGEIYGLAENENVIKYDDDTKAKEKKSGNTSTSQSKDEFLDWSKTGAVTPAKDQGTCGSCWIFSAVGALESYNFRKTGKLISFSEQNIVDCFSNDTCEGGVPEYAAKYIYNHGIHLESDYPYTAGQDACKILIKPTIRIPFNDTSFTKGTDEDLKQGVKEHGPLSVCLYVTANWRFYGRGVWYHNKCSYESNHCVLLVGYGKKKATIIEI

SEQ ID NO: 20478 - protein, 378 aa, Diabrotica virgifera
  misc_feature: Coding regions on vcDNA: vcDNA=SeqID_175; Strand=+; Position=1-1136
  misc_feature: Homolog annotation: Hit_ID=EAL26872.1; Match level="QueryCoverage =99%, HitCoverage=41%, E-value=4e-74, Identity=36%"; Hit description =GA11295-PA [Drosophila pseudoobscura]
  misc_feature: Gene Ontology Annotation: Molecular function=receptor activity; Cellular component=integral to plasma membrane; Biological process =pathogenesis
  misc_feature (16)..(16): Xaa can be any naturally occurring amino acid
  misc_feature (43)..(43): Xaa can be any naturally occurring amino acid
  misc_feature (62)..(62): Xaa can be any naturally occurring amino acid
  misc_feature (72)..(72): Xaa can be any naturally occurring amino acid
  misc_feature (84)..(84): Xaa can be any naturally occurring amino acid
MEDYFDTKFPLPKLDXLAIPNFGKTATENRGIISFRKSSVLFXPNSTSIKTRSYILAKIRAXELVHQWFGNXVTMEWWSDLSVXNKGFATFISEIAITTLRPKWHAYSSIKVRDTYNTLNDDSLKSARSMQREIITNSEIEEVFNPIIYRKGSSILKMLNATLSHEHFKKGLQDFIKKFAYKSVTQDDLWSIYTNTAQNQSLIPDTVTVKDLMNSWSMQSGYPCVTINRDYFTGVATINQTKMTEDANLTSDALWYIPITYITKGHSEIKEIWLENVRETSLNMSGIGNGSWILLNIDETGFYRVNYDTHNWKLLIYQLRTGSNQIPVTTRGQLIDDSFVLAEVGLINYTIAFDLVKYLYITEPNYIPWVQCFKKYKN

SEQ ID NO: 20479 - protein, 77 aa, Diabrotica virgifera
  misc_feature: Coding regions on vcDNA: vcDNA=SeqID_176; Strand=+; Position=1-234
  misc_feature: Homolog annotation: Hit_ID=NP_609382.1; Match level="QueryCoverage =94%, HitCoverage=18%, E-value=3e-20, Identity=63%"; Hit description =CG5037-PA [Drosophila melanogaster] gb|AAF52915.1| CG5037-PA [Drosophila melanogaster]
DTTNWWFLLETTPLNVYFIYLAYKFYKESSSATSRKLFRFSLIHLPLIMVLFLINKKKWFLFDDQKTETNRTELVSA

SEQ ID NO: 20480 - protein, 356 aa, Diabrotica virgifera
  misc_feature: Coding regions on vcDNA: vcDNA=SeqID_177; Strand=+; Position=5-1075
  misc_feature: Homolog annotation: Hit_ID=NP_788649.1; Match level="QueryCoverage =94%, HitCoverage=61%, E-value=1e-58, Identity=30%"; Hit description =CG3359-PK, isoform K [Drosophila melanogaster] ref|NP_788648.1| CG3359-PI, isoform I [Drosophila
  misc_feature: Pfam annotation: Pfam_ID=Fasciclin; Match level="Score=231.4, E-value= 1.7e-66, Copies=2"; Pfam description=Fasciclin domain
PQLGNATTHNVEGDLLNLERTVDDELILERKAKLVGTDIIATNGVIHLIDAVIVPDAGLYIGNVLKHQNYTKFQELIQKAELEEQINELQNATVFVPSNQAFESPEGKKLLSEIENDKEKLKEIVRYHTLQGQLQSGDMNNNEKLVTYDNGRELRLNLYSTLPLFTNIVNRATVNCARLIGFDEKACGSTIHEVNQILVPPTRNILEVIENDARYSTLKTLLKDTELEKILQENNRSLTLLAPTDETFAALDEKDREALLNDKKKAEQILKHHVLTEVLCCSGVGPHSWGFSSFISTLANTQIEVARTGSRIRVNRAVVTSCDNLATNGVVHTVNKVLLPRQPPVSSIGGFFLFDL

SEQ ID NO: 20481 - protein, 510 aa, Diabrotica virgifera
  misc_feature: Coding regions on vcDNA: vcDNA=SeqID_178; Strand=+; Position=106-1635
  misc_feature: Homolog annotation: Hit_ID=AAT38514.1; Match level="QueryCoverage =96%, HitCoverage=98%, E-value=2e-92, Identity=35%"; Hit description =antennae-rich cytochrome P450 [Phyllopertha diversa]
  misc_feature: Gene Ontology Annotation: Molecular function=cytochrome P450 activity; Cellular component=membrane; Biological process=electron transport
  misc_feature: Pfam annotation: Pfam_ID=p450; Match level="Score=164.9, E-value=1.8e- 46, Copies=1"; Pfam description=Cytochrome P450
MLLTSSWVIDSIIFLIFFVVLIYKYLTRNADFWKKRNIPFAKPTLFFGNFYEVFTLKTTIHEQIKKLYDKIDAPYFGIFIFDEPLLVLKDPKLIKDVLIKDAVIFANRRPATPTHPLMEHSVFFLKFPFWKKMRTKLTPLFTTVMLKTMHNDLSEVCKSMTGFLQNHKDVIDGGHIGELFTTEFIFKWFFGANLDCFAENPPLLGKLVKQTNEFSFRNSIIQNLFFIKPAWVTNLKLNFISDNTLRFFGDIFKKGMAARQEYDGKPQNYVDFANRAVRDKQNGKEDAMDLEMSTSSAIFFLIAGKDALNTLLAFTLYELSLNENIQNRLREEIRENVQKFNGITYDGLQENKYLEWCVNEIIRKYPPIPFIDRMPLSDYTFEGTDLKVQKDMTVIVPFYALHRDEKHFPNPDVFNPDRFAEELEEGVYIPFGGGPRNCIGKRLGMLGLSVAVSYVVLNFEIEKCANTPINLEFDPKSFALNSKTGLPMKITPIKTKNICIKNKKNIKSFT

SEQ ID NO: 20482 - protein, 137 aa, Diabrotica virgifera
  misc_feature: Coding regions on vcDNA: vcDNA=SeqID_179; Strand=+; Position=26-439
  misc_feature: Pfam annotation: Pfam_ID=PBP_GOBP; Match level="Score=21.1, E-value =0.00017, Copies=1"; Pfam description=PBP/GOBP family
MKYLVVLACVVVAAVASHLPNLPENERLKLAQVHRDCQADPKTYVDEDKLRKLPNFVEDKQVGIHMRCMAVKSGLMKQNGDLDIPSITQKFGLVIKDHSKVNGFVQQCAKKADTPEKTAILLTLCCVKNDIQYYHKL

SEQ ID NO: 20483 - protein, 415 aa, Diabrotica virgifera
  misc_feature: Coding regions on vcDNA: vcDNA=SeqID_180; Strand=+; Position=67-1313
  misc_feature: Homolog annotation: Hit_ID=NP_649139.1; Match level="QueryCoverage =92%, HitCoverage=88%, E-value=1e-164, Identity=73%"; Hit description= CG8782-PA [Drosophila melanogaster] gb|AAF49127.1| CG8782-PA [Drosophila melanogaster]
  misc_feature: Gene Ontology Annotation: Molecular function=ornithine-oxo-acid aminotransferase activity; Cellular component=mitochondrial matrix; Biological process=ornithine metabolism
  misc_feature: Pfam annotation: Pfam_ID=Aminotran_3; Match level="Score=541.8, E -value=6e-160, Copies=1"; Pfam description=Aminotransferase class-III
  misc_feature (269)..(269): Xaa can be any naturally occurring amino acid
MIPSRHAPRLLENAKSCINLSKKALSTEKVIHKEEKYAAHNYHPLPVALAKGQGVFVWDVEGKRYFDYLSGYSANNFGHCHPKIVKALQDQSAVLHHTSRAFFSDQLGEYAEVLTKLFGYDKVLPMNTGVEADDTACKLARKWGYRKKGIPKNQAKIIFAQDNFWGRSLAAVSASTDPTSYEDYGPFMPGFKIIPYDDLKALEEELKDPNVCAYMVEPIQGEAGIRVPSPGYLKGVRELCTKYNVLWIADEIQTGLGRTGKRLAVDYEXVKPDILVLGKALGGGVYPVSACLANDDVMLVIEPGTHGSTFGGNPLGSRVAIVSLGVLEDENIAENAFNMGEIFRRELQSKLNKDIVTEVRGKGLLNAVVINRGVADAWDVCLKMKDNGLIAKHTHEDIIRFAPPLVINKEHSKIY

SEQ ID NO: 20484 - protein, 251 aa, Diabrotica virgifera
  misc_feature: Coding regions on vcDNA: vcDNA=SeqID_181; Strand=+; Position=99-851
  misc_feature: Homolog annotation: Hit_ID=XP_313784.1; Match level="QueryCoverage =97%, HitCoverage=56%, E-value=2e-98, Identity=68%"; Hit description =ENSANGP00000012224 [Anopheles gambiae]
  misc_feature: Gene Ontology Annotation: Molecular function=molecular_function unknown; Cellular component=membrane; Biological process=lipid metabolism
  misc_feature: Pfam annotation: Pfam_ID=HlyIII; Match level="Score=-11.8, E-value =3.1e-05, Copies=1"; Pfam description=Haemolysin-III related
MSHYSDAEESIKDIQDLDLGLRKRRVIGWDPETESIASEIKDLLEEDVNSLEEEDCIGCPLPSTPEDEGLLDSEMSDVLKAAVLGDDLDITALAHNAATQAEHVVRKMIQAGWSVCHFRNLPAWLQDNDFLHHCHRPPLPSFRACFKSIFRLHTETANIWTHLLGCVAFIGIAIYFLMRPNTEIEIQEKVVFGAFFAGAIICLGMSFMFHTVNCHSQFIGKLFSKLDYCGIALLIMGSFVPWLYYGFYCHF

SEQ ID NO: 20485 - protein, 80 aa, Diabrotica virgifera
  misc_feature: Coding regions on vcDNA: vcDNA=SeqID_182; Strand=+; Position=558-800
KQIFVVLQLKMSRIPHVMAIEHHTVGKQQTLASTAQSCPQIRCGSINLCDTSCLSLLVVHIRFGSVLYTTLLCFDSLRFH

SEQ ID NO: 20486 - protein, 309 aa, Diabrotica virgifera
  misc_feature: Coding regions on vcDNA: vcDNA=SeqID_183; Strand=+; Position=79-1008
  misc_feature: Homolog annotation: Hit_ID=NP_610922.1; Match level="QueryCoverage =84%, HitCoverage=77%, E-value=3e-97, Identity=67%"; Hit description =CG8067-PA [Drosophila melanogaster] gb|AAF58305.1| CG8067-PA [Drosophila melanogaster]
MNSIRCFLFSKQFFSTTNQSKVFINYKNLSTSSTFHKIETGFVHIFDRKTKSLQRKRAAIADDVNVYNYLKDEIGYRLADRLFDIKRKFKLAADIGCSRGYVSRHISPDSVEELILCDISESNLNAAVVQDGIKTTKQILDEEHIEFKPNSLDIVISCLSLHWVNDLPKAFKRILLSLKEDGVFLASVFGGDTLYELRSSLQLAELERRGGISPHISPFTEVRDIGSLLTRAGFTMLTIDTDEIIVRYPSMFELMIDLKGMAESNAALNRSLHLHRDTQFAAAALYQQLYGAPDPESGEMPVPATLSNK

SEQ ID NO: 20487 - protein, 372 aa, Diabrotica virgifera
  misc_feature: Coding regions on vcDNA: vcDNA=SeqID_184; Strand=+; Position=106-1224
  misc_feature: Homolog annotation: Hit_ID=XP_393373.1; Match level="QueryCoverage =98%, HitCoverage=47%, E-value=1e-146, Identity=70%"; Hit description= similar to CG16941-PA [Apis mellifera]
  misc_feature: Gene Ontology Annotation: Molecular function=pre-mRNA splicing factor activity; Cellular component=nucleus; Biological process=mRNA splicing
  misc_feature: Pfam annotation: Pfam_ID=Surp; Match level="Score=140.9, E-value=2.9e- 39, Copies=2"; Pfam description=Surp module
MAPLESTNNNNNEEPGPINPIVGIIYPPPEVRNIVDKTASFVARNGPEFEARIRQNELGNPKFNFLNSGDPYHSYYQHKVKDFREGKGQDPTPGLTQAVSKLSVTASAQQKQQEILKQVEQPFIPKETPSEFEFIADPPSISALDLDIVKLTAQFVARNGRAFLTQLMNREQRNLQFDFLRPQHSLFQYFTKLLEQYTKVLIPPKSMHESLRNEANSPKNVLEQVKYRAEWLKYQEQQKAKEEELLERERVAYAQIDWHEFVVVETVDYQPFEIGNFPAPTTPEEVGARILIQERIEEGEDIEMQLESDEEEPPVMEAGLSSMQDKTNRKTRDDTRIQDMEEESSDEEKEEEEELALPPPPPSIQPPLPPIP

SEQ ID NO: 20488 - protein, 526 aa, Diabrotica virgifera
  misc_feature: Coding regions on vcDNA: vcDNA=SeqID_185; Strand=+; Position=74-1649
  misc_feature: Homolog annotation: Hit_ID=AAN85117.1; Match level="QueryCoverage =98%, HitCoverage=80%, E-value=0.0, Identity=89%"; Hit description =HSP70 [Chironomus tentans]
  misc_feature: Gene Ontology Annotation: Molecular function=protein binding; Biological process=reproduction
  misc_feature: Pfam annotation: Pfam_ID=HSP70; Match level="Score=1084.9, E-value=0, Copies=1"; Pfam description=Hsp70 protein
  misc_feature (509)..(510): Xaa can be any naturally occurring amino acid
MGKVAAIGIDLGTTYSCVGVWQHGKVEIIANDQGNRTTPSYVAFTDSERLIGDAAKNQVAMNPKNTVFDAKRLIGRKFDDPKIQADMKHWTFNVVNDCGKPKIQVEYKGEVKTFAPEEVSSMVLTKMKEIAETYLGGKVTDAVVTVPAYFNDSQRQATKDAGAIAGLNVLRIINEPTAAALAYGLDKNLKGEKNVLIFDLGGGTFDVSILAIDEGSLFEVKSTAGDTHLGGEDFDNRLVNHFVEEFKRKHKKDLSNNTRALRRLRTACERAKRTLSSSTEASIEIDALHEGVDFYSKVTRARFEELCMDLFRSTLQPVEKSLTDAKLDKGAIHDVVLVGGSTRIPKIQKMLQDFFCGKALNLSINPDEAVAYGAAVQAAILSGDTSSQIQDVLLVDVAPLSLGIETAGGVMTKIVERNSRIPCKQQQTFTTYADNQNAVTIQVFEGERAMTKDNNLLGTFNLAGIPPAPRGIPKIEVTFDLDANGILNVSARDSSTGKQEKITIYHDKXXRLSKAEIDKMLSDAEN

SEQ ID NO: 20489 - protein, 242 aa, Diabrotica virgifera
  misc_feature: Coding regions on vcDNA: vcDNA=SeqID_186; Strand=+; Position=84-812
  misc_feature: Homolog annotation: Hit_ID=XP_393949.1; Match level="QueryCoverage =91%, HitCoverage=85%, E-value=6e-57, Identity=49%"; Hit description =similar to ENSANGP00000020947 [Apis mellifera]
  misc_feature: Gene Ontology Annotation: Molecular function=signal recognition particle binding; Cellular component=signal recognition particle; Biological process=protein targeting
  misc_feature: Pfam annotation: Pfam_ID=Arf; Match level="Score=-52.9, E-value=9.2e -06, Copies=1"; Pfam description=ADP-ribosylation factor family
MADKVPIKLGGTDYTQVFIAVFVIVITLVLIALYKRRKSSRQGILLTGICDSGKTLIFSQLIHNKHIQTHTSIKENVANYISNNEVLRIIDIPGHERLRDKFFEQYKEITKGIVYVVDSNTITQDIRDAAEFLYNMLVDPVVIKNKPKLLILCNKQDYTFAKGGSAVKAIFEKELNTLRITKSNQLESVDPKMKKTALLGDPEEDFDFAALPLKVDIAESYAYHKNGTVDIDGLKKWLAHHV

SEQ ID NO: 20490 - protein, 312 aa, Diabrotica virgifera
  misc_feature: Coding regions on vcDNA: vcDNA=SeqID_187; Strand=+; Position=191-1129
  misc_feature: Homolog annotation: Hit_ID=XP_541576.1; Match level="QueryCoverage =98%, HitCoverage=85%, E-value=4e-62, Identity=42%"; Hit description =PREDICTED: similar to Zinc finger protein 226 [Canis familiaris]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=229.5, E-value =6.2e-66, Copies=8"; Pfam description=Zinc finger, C2H2 type
  misc_feature (279)..(279): Xaa can be any naturally occurring amino acid
MEVKVEKEEFADYDQKDLENQLSTSIDLQDFKEEPKENQPGCLQKNNIHSSRNEEDVGRHDQETIKNKNIKVKIGKGSHKCEICFKQFSQTNHLRNHMMSHNRKKSYKCELCFKQFTLAGSLKVHMMIHTGEKPYKCDICLKQFIARSNLKSHIMTHTREKPYKCEICLKQFKQASNLKTHLMAHTGVYPHKCEICLKKFTSAATLKQHTMIHTGEKPHKCEICLQQFAASNTLKLHMRTHTGYKPYKCEFCFKQFTQSSVFKYHLRRHTRENLYKCEXCFKEFTQAGLLKSHMMTHTCEKLNNVKNCSTVC

SEQ ID NO: 20491 - protein, 380 aa, Diabrotica virgifera
  misc_feature: Coding regions on vcDNA: vcDNA=SeqID_188; Strand=+; Position=31-1173
  misc_feature: Homolog annotation: Hit_ID=EAL30481.1; Match level="QueryCoverage =100%, HitCoverage=100%, E-value=1e-156, Identity=70%"; Hit description=GA11203-PA [Drosophila pseudoobscura]
  misc_feature: Gene Ontology Annotation: Biological process=tyrosine catabolism
  misc_feature: Pfam annotation: Pfam_ID=Glyoxalase; Match level="Score=48.9, E-value= 1.5e-11, Copies=2"; Pfam description=Glyoxalase/Bleomycin resistance prote
MTSYSDKGPVPTNGKFLNFHHLTFYVGNAKQAASYYISRLGFQPVCYKGLETGDRNYVQHVVRQNNIFLLLTSPYNPGEQVLNGHLIRHGDGVKDIAFEVENLEGIVERAKSQGAKILRDIWEEADFEGIVRYALIQTYGDTTHTLIDKSLYRGQFLPGYSPCQPDPLGKVLPATNLDFIDHIVGNQDDKEMESVAKWYEDVLQFHRFWSVDDSQIHTEYSALRSIVMANWEENIKMPINEPAPGKKKSQIQEYVEYYGGAGVQHIALNTQDIITSVKNLKARGVEFMEIPDSYYTILKEQLKSSRTKIAEDLDVLQKLKILIDYDENGYLLQIFTKCLEDRPTVFLEIIQRRNHNGFGAGNFKSLFEAIEMEQDKRGNL

SEQ ID NO: 20492 - protein, 282 aa, Diabrotica virgifera
  misc_feature: Coding regions on vcDNA: vcDNA=SeqID_189; Strand=+; Position=19-867
MSPASAGNLEVERYIGACLISQNRAKSKPQRQEHYSSAHRDVVPDIYHQKHVNFRLQRCHSGDGWAGGMPLISFAQHQRKIHHQEDSSSLAKLAVHTQGAPLILTKSYNHRKNKVHRHNGATKIFENSNNKKNVKCQNSVDTVSVTSDESSGSANSETCLPRIIKPRKRRKKDRKPPLLGRPLSQDGFSTDSASPDIDNTQPNYLSISPFNLFNFNPYGALIFPETSKLVDHLHILNDISETPKLHHAFEDIEEPEDIDINGNQPPVSVSAEYCESSGQIGT

SEQ ID NO: 20493 - protein, 254 aa, Diabrotica virgifera
  misc_feature: Coding regions on vcDNA: vcDNA=SeqID_190; Strand=+; Position=250-1014
  misc_feature: Homolog annotation: Hit_ID=EAL39276.1; Match level="QueryCoverage =98%, HitCoverage=89%, E-value=1e-88, Identity=64%"; Hit description =ENSANGP00000028309 [Anopheles gambiae str. PEST] ref|XP_554016.1| ENSANGP00000028309 [Anopheles gambiae st
  misc_feature: Gene Ontology Annotation: Molecular function=dodecenoyl-CoA delta -isomerase activity; Cellular component=mitochondrion; Biological process=fatty acid beta-oxidation
  misc_feature: Pfam annotation: Pfam_ID=ECH; Match level="Score=155.2, E-value=1.5e -43, Copies=1"; Pfam description=Enoyl-CoA hydratase/isomerase family
YVTVNDKNGVATVEMQRPPVNSLNYELLSQLSSTLTDLEKNKSRGLILTSKNDGVFSAGLDILEMYKPDQDRMKAFWTALQDTWIKLYGSSYPTVALINGHAPAGGCLLSLCCEYRVMFKNRTIGLNETQLGIVAPKWFIASMTNVIGNRKTELALTGGVMYTTDEALNMGMIDEIIETKAEGMARAEAFITRFAKISPVARGLTKKYIRGNTIEDMVKNRKEDLDNFVMFSNQPAVQEGLGLYIQSLKKKSKA

SEQ ID NO: 20494 - protein, 130 aa, Diabrotica virgifera
  misc_feature: Coding regions on vcDNA: vcDNA=SeqID_191; Strand=+; Position=1-390
  misc_feature: Homolog annotation: Hit_ID=NP_730179.2; Match level="QueryCoverage =88%, HitCoverage=13%, E-value=2e-10, Identity=32%"; Hit description =CG4118-PB, isoform B [Drosophila melanogaster] ref|NP_524111.3| CG4118-PA, isoform A [Drosophila
  misc_feature: Pfam annotation: Pfam_ID=LRR_1; Match level="Score=17.8, E-value =0.033, Copies=3"; Pfam description=Leucine Rich Repeat
TRPINWIAKWDPKEVILSNNYISDLTHFILLSKGVTSLDLDNNLIRDVESLKVLGFFKKLTALDLRGNPVCDNFDYAWQYKLEIRKICPNLTVLDGADVYENVNFDYKKNFVCCDDAGELTSVFLEHFFT

SEQ ID NO: 20495 - protein, 63 aa, Diabrotica virgifera
  misc_feature: Coding regions on vcDNA: vcDNA=SeqID_192; Strand=+; Position=298-489
NAFSAYKAPDDDGLFSLCMGNANSIIDYGTIKGQPPYVNKSVFNFFKNHRNVKLMFLVHPQAV

SEQ ID NO: 20496 - protein, 113 aa, Diabrotica virgifera
  misc_feature: Coding regions on vcDNA: vcDNA=SeqID_193; Strand=-; Position=189-530
ATAIKLRLTQRGTERSVFALLLCFTYLLYSLYFCISSGDWVFGGFFIYIIFFSSINLLVSSVIFTLCRVVLLFYSVYYVLVCFFDVSKTEFPDKFPLVKSKSLKFHTYSSHHI

SEQ ID NO: 20497 - protein, 122 aa, Diabrotica virgifera
  misc_feature: Coding regions on vcDNA: vcDNA=SeqID_194; Strand=+; Position=78-446
  misc_feature: Homolog annotation: Hit_ID=XP_392820.1; Match level="QueryCoverage =70%, HitCoverage=88%, E-value=2e-24, Identity=63%"; Hit description =similar to ENSANGP00000010386 [Apis mellifera]
  misc_feature: Gene Ontology Annotation: Molecular function=translation repressor activity; Cellular component=eukaryotic translation initiation factor 4F complex; Biological process=antibacterial humoral response (sensu Invertebrata)
  misc_feature: Pfam annotation: Pfam_ID=eIF_4EBP; Match level="Score=126.7, E-value =5.6e-35, Copies=1"; Pfam description=Eukaryotic translation initiation fac
MSASPMARQAVESKAIPIRRVLINDHSELPAHYSSTPGGTLFSTTPGGTKIVYEKSVLLNLRNSPISKTPPQFEIPDTILGGSAKNVVRKQNHSRPLPPSPRKSQPEINNHNTSEDQFDMEL

SEQ ID NO: 20498 - protein, 280 aa, Diabrotica virgifera
  misc_feature: Coding regions on vcDNA: vcDNA=SeqID_195; Strand=+; Position=102-941
  misc_feature: Homolog annotation: Hit_ID=XP_143000.4; Match level="QueryCoverage =51%, HitCoverage=79%, E-value=3e-34, Identity=45%"; Hit description =similar to zinc finger protein 347; zinc finger 1111 [Mus musculus]
  misc_feature: Gene Ontology Annotation: Molecular function=protein binding; Cellular component=nucleus; Biological process=photoreceptor fate commitment (sensu Drosophila)
  misc_feature: Pfam annotation: Pfam_ID=zf-C2H2; Match level="Score=111.2, E-value =2.6e-30, Copies=4"; Pfam description=Zinc finger, C2H2 type
MEVKQEQDILPVEGCEMKTEFIDFPNVSFHSSVKTEIKEDHYVAVADSLNNDTKTYFVNDSNRLNMDISVGGIKVEEEEEEDKAELVQIENVMELKREIKQEEITVEDVKDESPEGEDSSGFQEKNKMEIIKTLPGFTRNSERCLSQPSEKLLCGICNKQFSRKEALKKHLQKHSKPISCHICFKSFSHDCSLKVHMRVHTGEKPYQCEICFKSFTQHSSINKHRRLHTGEKTHQCEICHKSFSELYSLNEHMRVHTGEKPHQCEICFKSFLPKGFFEVH

SEQ ID NO: 20499 - protein, 303 aa, Diabrotica virgifera
  misc_feature: Coding regions on vcDNA: vcDNA=SeqID_196; Strand=+; Position=71-982
  misc_feature: Homolog annotation: Hit_ID=NP_572508.1; Match level="QueryCoverage =97%, HitCoverage=96%, E-value=3e-90, Identity=51%"; Hit description =CG10648-PA [Drosophila melanogaster] gb|AAF46420.1| CG10648-PA [Drosophila melanogaster]
  misc_feature: Gene Ontology Annotation: Molecular function=molecular_function unknown; Cellular component=nucleolus; Biological process =embryogenesis and morphogenesis
  misc_feature: Pfam annotation: Pfam_ID=Mak16; Match level="Score=452.0, E-value =6.6e-133, Copies=1"; Pfam description=Mak16 protein
MQHDDVVWSIINKTHCSYKTQTKTQKFCRNEYNLTGLCNRSACPLANSQYATIREENGIIYLFMKTAERSAFPNKTWEKVKLSRNFEKAIHQINENLLYWSGFIKSKCKQRFVKITQYLIRMRKLKLRRQKLLVPIQSKVERRERRREDKALIAARIEKGVEKTLLDRLKQGVYQDLYNISPQTFDEAEQERELESEEEVEQEMEMENEMEEELDTPEFVAADSDDDSDVESESGNPEEVDLDSSFESSDGSDIEDIRPSTSKKSQTPVNKKGTPKPGSSKKKRRSRVEIEYEHEPAQRLSVS

SEQ ID NO: 20500 - protein, 512 aa, Diabrotica virgifera
  misc_feature: Coding regions on vcDNA: vcDNA=SeqID_197; Strand=+; Position=90-1628
  misc_feature: Homolog annotation: Hit_ID=XP_394104.1; Match level="QueryCoverage =98%, HitCoverage=98%, E-value=1e-149, Identity=55%"; Hit description= similar to ENSANGP00000013547 [Apis mellifera]
  misc_feature: Pfam annotation: Pfam_ID=Peptidase_M17; Match level="Score=31.7, E -value=1.6e-20, Copies=1"; Pfam description=Cytosol aminopeptidase family, cataly
MNLKGPPETKLVVETSIESPEYDGILLVAAPDQKVKNSKLNSLVQDALSFDQSLKTEIGVLQTDLPARRVVYSPTGPIDTDYDDVRIFKNSAAAGVKRALKAGVKKLLVVLEEYPAFESTELVTLLGVLDALYTPIQVREHDPSKTNKVDLVGVYTENPDKTKAIVGQAQVLEISRRVACDIGDSDPERMTPARAEEYVRNLFQGTSIKLSVVSDEEEFNKGYPLFAAVNRAASLNARHRGRIIYLEYNPPQAVKETLFIVGKGVTMDTGGIDVKIGGAMMGMSRDKCGAAAAAGFMTVVNLLQPKHLKVVAAMSMVRNSIGSNGYTSDEVITARSGARVRIINTDAEGRMIMADVLCKLKEDAVNAVNPHLYTIATLTGHAHRTVGEGYSIAMDNGPAKKTQNAEKLQAAGDKIGDMFEISRIRRDDFKHHKGECEGDDLIQSAAKPSTLVSRGHQGPGAFLMVASGLDKHGSASDVPLRYTHLDIAGSAGTFPLPGTGAPVLALAQAYLL

SEQ ID NO: 20501 - protein, 264 aa, Diabrotica virgifera
  misc_feature: Coding regions on vcDNA: vcDNA=SeqID_198; Strand=+; Position=40-829
  misc_feature: Homolog annotation: Hit_ID=EAA06347.2; Match level="QueryCoverage =98%, HitCoverage=48%, E-value=2e-55, Identity=39%"; Hit description =ENSANGP00000012761 [Anopheles gambiae str. PEST] ref|XP_566184.1| ENSANGP00000012761 [Anopheles gambiae st
  misc_feature: Gene Ontology Annotation: Molecular function=triacylglycerol lipase activity; Cellular component=extracellular; Biological process =triacylglycerol metabolism
  misc_feature: Pfam annotation: Pfam_ID=Lipase; Match level="Score=-26.1, E-value =1.4e-10, Copies=1"; Pfam description=Lipase
  misc_feature (170)..(170): Xaa can be any naturally occurring amino acid
MVAIDKNSSVFMQTLFYLMNQSNIVQDTSYNYYFMQIGQDHVIESKASKCYGIYGCFELGSPWTSENRPIAYYPEELEKIEPQYLLLTRDNPVTPITMELNDFDYEDSLDFDPEKNIYIVTHGYMEGGTIKWIHEIADALLAQEDCNIIIIDWQRGSGPPYTQAVANIRXLVGAMTAYLLADISKFTGDLKLNHVHAIGHSLGAHLCGYIGYTLQKEFQLTLGRITGMDPAEPHFSKAKPPVRLDRSAAHYVDIIHTDGTQFIR

SEQ ID NO: 20502 - protein, 324 aa, Diabrotica virgifera
  misc_feature: Coding regions on vcDNA: vcDNA=SeqID_199; Strand=+; Position=103-1073
  misc_feature: Homolog annotation: Hit_ID=CAC12665.1; Match level="QueryCoverage =99%, HitCoverage=75%, E-value=9e-79, Identity=48%"; Hit description =prophenoloxidase activating factor [Holotrichia diomphalia]
  misc_feature: Gene Ontology Annotation: Molecular function=serine-type endopeptidase activity; Cellular component=extracellular; Biological process=cytoskeleton organization and biogenesis
  misc_feature: Pfam annotation: Pfam_ID=Trypsin; Match level="Score=7.1, E-value =0.00015, Copies=1"; Pfam description=Trypsin
  misc_feature (316)..(316): Xaa can be any naturally occurring amino acid
MRLSILCISLIIGVFGQNEEIIDEDTRKKIDEIFPMSNNNFPTDLEEVTESTNGSYTAIEQCGEGSTRGLKRCVVYSKCDPKTNTIVEEDVTYGFGQIDIRFGKKPCEDTLDVCCKINPNTPTPDPVSPTPVTPEPVTTPPIVKPSFCGIRNPKGIDFTITGNHDNEAEYGEFPWMVAILNKNYLLQGLDKPLACGGSLITPNVVLTGAHCVYRNKTFDLTVRAGEWDTQTTKERLPYQERNVNQIIFHEEFVPGILHNDVALLILDEAVNKADHIGTICLPPQNLKINSKNCFVTGWGQKDFGRKGKFQAILKKXELPTIDKR

SEQ ID NO: 20503 - protein, 154 aa, Diabrotica virgifera
  misc_feature: Coding regions on vcDNA: vcDNA=SeqID_200; Strand=+; Position=2-466
  misc_feature: Homolog annotation: Hit_ID=XP_392339.1; Match level="QueryCoverage =99%, HitCoverage=16%, E-value=2e-70, Identity=85%"; Hit description =similar to CG31140-PC [Apis mellifera]
  misc_feature: Gene Ontology Annotation: Molecular function=electron carrier activity; Biological process=electron transport
  misc_feature: Pfam annotation: Pfam_ID=DAGK_acc; Match level="Score=78.1, E-value =2.4e-20, Copies=1"; Pfam description=Diacylglycerol kinase accessory domai
PKMCKDLHKEVRLEVDGKLVELPQVEGIIILNILSWGSGANPWGPEKDDQFSKPNHWDGMLEVVGVTGVVHLGQIQSGLRSAMRIAQGGHIKIHLNSDIPVQVGGEPWVQSPCDVVVLKSALKATMLKKNKFKRRPTEPNILPANGEGGKSTDE

SEQ ID NO: 20504 - protein, 188 aa, Diabrotica virgifera
  misc_feature: Coding regions on vcDNA: vcDNA=SeqID_201; Strand=+; Position=139-705
  misc_feature: Homolog annotation: Hit_ID=XP_395041.1; Match level="QueryCoverage =92%, HitCoverage=74%, E-value=9e-58, Identity=62%"; Hit description =similar to CG4893-PA [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=p25-alpha; Match level="Score=230.9, E-value= 2.3e-66, Copies=1"; Pfam description=p25-alpha
MTDKDLEKPTTDLNALKIDESPAASPTPGSNSSLLTFETNFKNFAKFGDPKSDGKQITLSNSDKWMKQAKIIDGKKITTTDTGIHFKKLKSLKVGIVQYKQFLEDLAKAKGMGVDEIKDKLVSCGPPATPGGSSTTAKAAAAVDRLTDTSKYTGTHKQRFDDTGKGKGISGRKDMGDSSGYVTGFQHK

SEQ ID NO: 20505 - protein, 212 aa, Diabrotica virgifera
  misc_feature: Coding regions on vcDNA: vcDNA=SeqID_202; Strand=+; Position=3-641
  misc_feature: Homolog annotation: Hit_ID=XP_392136.1; Match level="QueryCoverage =90%, HitCoverage=7%, E-value=1e-59, Identity=58%"; Hit description =similar to CG18214-PA [Apis mellifera]
  misc_feature: Gene Ontology Annotation: Molecular function=guanyl-nucleotide exchange factor activity; Cellular component=nucleus; Biological process=transmembrane receptor protein tyrosine phosphatase signaling pathway
  misc_feature: Pfam annotation: Pfam_ID=Pkinase; Match level="Score=50.9, E-value =3.7e-12, Copies=1"; Pfam description=Protein kinase domain
LLAGMQHPNIIRSLALFDNAPLPGIDTIILELVKGPLLFKYISDKETYSESDVRNYTCQLISALKWLHQKSIAHLDVKPENVMIDITVPIPLLKLVDFGDSVNTSKNVILPPACLEFASPEPVLGQPVGVHTDCWAVGVFLYVMLSGVSPFLDDSVEETTANILKCDFCFPDEYFGDVSQEAKDLTKSLLVLVPAQRLNMEKSLQWCLDKRG

SEQ ID NO: 20506 - protein, 62 aa, Diabrotica virgifera
  misc_feature: Coding regions on vcDNA: vcDNA=SeqID_203; Strand=+; Position=260-448
VYEIKPLSSSRYHPLLNMGLLQVSPCLPVLSYHHPVPSLFTSSRQRVGGRSASLVRPRPPFQ

SEQ ID NO: 20507 - protein, 84 aa, Diabrotica virgifera
  misc_feature: Coding regions on vcDNA: vcDNA=SeqID_204; Strand=+; Position=124-378
RRVLILCFLFVIVLINNVKIYQMEKKTKYCLRVYHIVLSSDQWYSRDSNIKVNRLTITFILPWTTGFAFYNLASSGLGYSKIKC

SEQ ID NO: 20508 - protein, 83 aa, Diabrotica virgifera
  misc_feature: Coding regions on vcDNA: vcDNA=SeqID_205; Strand=-; Position=905-1156
GGCVGYPRRRFPGGGEGWFCFKPIFRELSARAPNLRQKLFLYFFRKLKYLLSYSWLKIGHFPWNQYDPFQTVFCEYLLNYASN

SEQ ID NO: 20509 - protein, 341 aa, Diabrotica virgifera
  misc_feature: Coding regions on vcDNA: vcDNA=SeqID_206; Strand=+; Position=71-1093
  misc_feature: Homolog annotation: Hit_ID=XP_308942.1; Match level="QueryCoverage =98%, HitCoverage=61%, E-value=1e-126, Identity=61%"; Hit description= ENSANGP00000013430 [Anopheles gambiae]
  misc_feature: Gene Ontology Annotation: Molecular function=RNA lariat debranching enzyme activity; Cellular component=nucleus; Biological process=mRNA splicing
  misc_feature: Pfam annotation: Pfam_ID=DBR1; Match level="Score=49.7, E-value=8.2e -12, Copies=1"; Pfam description=Lariat debranching enzyme, C-terminal
MKIAVEPTRPGDLENIYDTIYVLEQKEGIKVDLLICCGDFQSSRNNDDLTCMAVPPKYRNICTFYKYYSGEKVAPILTIFIGGNHEASNYLQELPYGGWVAPNIYYMGYAGVINVGGLRIAGISGIYKGQDYWKGHYEKPPYTDESKRSVYHVRNLEIFRLKQLSGKIDVMISHDWPNEITKYGNVKQLIKKKPHFKEDIEKNQLGSQPNSDLLFHLKPAYWFAAHLHCKFSAVVMHKDDSMTRFLALDKCLPKRKFLQVLEVPHNEDSKIEIAYDLEWLSILYLTNHLLSVKSTKNYMPGPGSTERYEFTPTDQEKIIVMNRFKDNLVVPRIFLNSCRYS

SEQ ID NO: 20510 - protein, 118 aa, Diabrotica virgifera
  misc_feature: Coding regions on vcDNA: vcDNA=SeqID_207; Strand=-; Position=207-563
HSLSLALSLSLSLSFFLLHRVVLFLRNFLSVFHFSLFLALCLTSLHISPILSLSLVTILQLLFNLPFLLSPAWYSSACLVILFWSFLSVCQSIFLLIVTVILSYFVFFFQISSVPDCL

SEQ ID NO: 20511 - protein, 325 aa, Diabrotica virgifera
  misc_feature: Coding regions on vcDNA: vcDNA=SeqID_208; Strand=+; Position=83-1058
  misc_feature: Homolog annotation: Hit_ID=NP_729053.2; Match level="QueryCoverage =99%, HitCoverage=69%, E-value=1e-95, Identity=49%"; Hit description =CG10671-PB, isoform B [Drosophila melanogaster] gb|AAN12239.2| CG10671-PB, isoform B [Drosophila
  misc_feature: Gene Ontology Annotation: Biological process=positive regulation of growth rate
  misc_feature (290)..(290): Xaa can be any naturally occurring amino acid
  misc_feature (307)..(307): Xaa can be any naturally occurring amino acid
MVSKRRPVHATNLNFRPNINNSNNIEQKGTKPTSEPTSVKEILTLMVLYLCKKSLFFDTNLKVGIYLACLFLISLIADVLMIPKTYLARSDNIFNKVFVKFAWGWNLTLIVPFLILTSVVYCCGNKQKILKQHFPRILIATFFWWLWTTVFNVIEASLGRCATPGFNSKVVCLHEGHVWNGFDLSGHSFILIYGSLLLIEETRCIVNWDTIKDYIRLEEHQRLARDANEKPNPLRNLSDLELKEMKTNYEKFTPYIRLLFIVIAVIQILWDIMLISTMLYYHIMIEKSLXEGLVLLLRGFFIYKGGXSHPSLLPRLPGEREFKKT

SEQ ID NO: 20512 - protein, 241 aa, Diabrotica virgifera
  misc_feature: Coding regions on vcDNA: vcDNA=SeqID_209; Strand=+; Position=77-802
  misc_feature: Homolog annotation: Hit_ID=EAA11089.2; Match level="QueryCoverage =82%, HitCoverage=98%, E-value=6e-38, Identity=40%"; Hit description =ENSANGP00000019736 [Anopheles gambiae str. PEST] ref|XP_556800.1| ENSANGP00000019736 [Anopheles gambiae st
MAGYGFKQEYPTHNCEQCQRNVTNYPSQPATCPHHSHNRPPSGYPSYPAPPAYNPYYNGNSAPMYPQPPTYPQPPTYPQPPTNSNWPPTHHGPSHSSYAIWVDCYLHSPMPNSAVRGGTDIDGQPIYVGRAFHEGDWLPAKVIPGRRCCYISYDGKEYAKTNFQVLSHTSAHWVPGFGGQVPHNAIEGGRTVNGEKLYIGRVMHQHSQTVGKIHPSHRNCYIPFDGREIAYAAYDVLVSRN

SEQ ID NO: 20513 - protein, 553 aa, Diabrotica virgifera
  misc_feature: Coding regions on vcDNA: vcDNA=SeqID_210; Strand=+; Position=90-1751
  misc_feature: Homolog annotation: Hit_ID=XP_315718.1; Match level="QueryCoverage =82%, HitCoverage=56%, E-value=5e-59, Identity=28%"; Hit description =ENSANGP00000004354 [Anopheles gambiae]
  misc_feature: Gene Ontology Annotation: Cellular component=integral to plasma membrane
  misc_feature: Pfam annotation: Pfam_ID=Prominin; Match level="Score=-250.6, E-value= 0.025, Copies=1"; Pfam description=Prominin
MAADMSVFDNLKAQLPDYDNYTHTNQYTAASITFSPGGMKGLYDMTRSFVDSLLPANFLSEDLFSWDDDNNPSLNTSYADLAMQYAGLIAFFGFILLLLVLIPVCGLIFACCRCCGLCGAKARVSEKKQDLCLKIIFGILLVICCAVLLFGIASAFATTHRMKTGVNQLRENGRKVYNDSVGYIEDVKDHVHFLLEADYDKFSGTFKQTLKDSTQDILNNLPLWNDVTIITTISTFADKLTYLKTDLDNLQRKTDQLKTTGSNLTSEMADIQKGLKDTLEKCGPSCADAEKMVNDLKIIDVKDIPAIPDIFNGVPIGDIQKAATSANDLVQKVPDTINSQIQTVTAQVDTEIDKAGATIKDNTKTMDDLVDKVKEHMKSVYSSFGDRNDYLEKYYPYFYYVGIVVSCVLLLILVFLFFGLVFGLFGNRPDKYKSYCCSKGTGSVFLMTAVALIFIITVIICIMTLVMSVGGIAADRIICYPLRNPDKSSIITVIDKYIDKHIKDDNEFSFNITTILDKCYNNKSIYEVLDLKTKSQFDIDKTIGQFNITQKYR

SEQ ID NO: 20514 - protein, 97 aa, Diabrotica virgifera
  misc_feature: Coding regions on vcDNA: vcDNA=SeqID_211; Strand=-; Position=1-291
  misc_feature: Homolog annotation: Hit_ID=BAA36466.1; Match level="QueryCoverage =100%, HitCoverage=9%, E-value=7e-46, Identity=92%"; Hit description =serine protease homologue [Pseudomonas fluorescens]
EQLGAGNPVYESILRSDSVAAAQQGFQQLSGEIYPAIDTMLINDSRQLRDAVGERLRHTPVTGESNVWVKALGSWGKTDSRSDTAGYTTSLGGMLAG

SEQ ID NO: 20515 - protein, 235 aa, Diabrotica virgifera
  misc_feature: Coding regions on vcDNA: vcDNA=SeqID_212; Strand=+; Position=606-1313
  misc_feature: Homolog annotation: Hit_ID=BAA36225.1; Match level="QueryCoverage =65%, HitCoverage=19%, E-value=1e-17, Identity=37%"; Hit description =transposase [Ipomoea purpurea]
CLKYSGASIQILIEGGKHKKQNSLLPNFSFFFFRSCYIVSDTYDFIQRWVFIQKKSYRSPEYQNDLIDVYSSRLLKNIITKGNQVEFFAIMADETKDTAETKSEQLAILIRYVDAEGTKIYERAIGLHHLKDCGAESIANAIQSMLSDKRLDIENCVGQCYDGANVISGVQARIKNLAPHATYFHCEADRLNLVVVDVLGNIDKVRLFSTVQTLSIHFQHCYSPSAFCKNTTEDE

SEQ ID NO: 20516 - protein, 631 aa, Diabrotica virgifera
  misc_feature: Coding regions on vcDNA: vcDNA=SeqID_213; Strand=+; Position=439-2331
  misc_feature: Homolog annotation: Hit_ID=EAL31885.1; Match level="QueryCoverage =100%, HitCoverage=94%, E-value=0.0, Identity=75%"; Hit description =GA20422-PA [Drosophila pseudoobscura]
  misc_feature: Gene Ontology Annotation: Molecular function=G-protein coupled receptor activity; Cellular component=integral to plasma membrane; Biological process=G-protein coupled receptor protein signaling pathway
  misc_feature: Pfam annotation: Pfam_ID=EXS; Match level="Score=344.8, E-value=1.3e -100, Copies=1"; Pfam description=EXS family
MKFAEHLSAHITPEWRKQYISYEEMKSMLYLTVEEAPSAESVEPEIVTRHLANFEEQFFLYCDKELKKINTFYSEKMAEATRKFASLHSELKDSLNNMNLGKKKSGNRRMVPTRKLQELKLAFSEFYLSLILLQNYQTLNHTGFRKILKKHDKLLSTDVGAKWRQEHVETSHFFTNKDIDKLINDTENSVTNELEGGDRQKAMKRLRVPPLGEQQSPWTTFKVGLFSGSFIVLLIAAVLSAVFHEGTTENLKIAFRLYRGPLLVRELLFLIGVNIYGWRSSGVNHVLIFELDPRNHVSEQHLMELAAIFGVVWAVSLLNFLYSATLSIPPYVNPLVLTVIMIVFLVNPLKIFRHDARFWFLRICGRMFGAPFFRVEFADFWLADQLNSLAAAFLDFQFLTCFYFTNGDWLVAGDTAQCMERNFTIRPIVNCIPAWLRFAQCLRRYYDSKDAFPHLVNAGKYSTTFLVVIFGTLKSVYKDDYATPSDNPYMFLWIAAQILSSTYAYTWDIKMDWGLFDKSAGENTFLREETVYSSKVFYYFAIIEDLILRFAWAVSLYLTENGYVSGDLMTSILAPLEVFRRFVWNFFRLENEHINNCGQFRAVRDISVAPIDSSDQIQIIRMMDKEDGVTN

SEQ ID NO: 20517 - protein, 254 aa, Diabrotica virgifera
  misc_feature: Coding regions on vcDNA: vcDNA=SeqID_214; Strand=+; Position=181-942
  misc_feature: Homolog annotation: Hit_ID=XP_394724.1; Match level="QueryCoverage =79%, HitCoverage=35%, E-value=4e-32, Identity=35%"; Hit description =similar to CG7219-PA [Apis mellifera]
  misc_feature: Gene Ontology Annotation: Molecular function=serpin; Cellular component=cytosol; Biological process=regulation of proteolysis and peptidolysis
  misc_feature: Pfam annotation: Pfam_ID=Serpin; Match level="Score=-157.4, E-value =0.0005, Copies=1"; Pfam description=Serpin (serine protease inhibitor)
MARLTPAIILLSLSTLVAAQLDSSIHFPGDSSFPASSLQQAVGSPYENYVDLVIARGINKLCLEINQKYQETNGLIKVDNTVFSPINIAGALALLLLGSNGQTFKELATVLGLATGLDIENNSERVHEHLGQILRRIEERPYSVGEDEQQINFANAIFVQESFPIRKIYKETADSLYKFEIFNLNFEREPVKAQKYVNAWVSDRTVGKIKDILSEPPLPSTKIILASAMYFKAKWEIPFFGEGVTQRRRFYPNG

SEQ ID NO: 20518 - protein, 311 aa, Diabrotica virgifera
  misc_feature: Coding regions on vcDNA: vcDNA=SeqID_215; Strand=+; Position=17-952
  misc_feature: Homolog annotation: Hit_ID=AAH83021.1; Match level="QueryCoverage =57%, HitCoverage=39%, E-value=1e-41, Identity=45%"; Hit description =Unknown (protein for MGC:98936) [Xenopus laevis]
  misc_feature: Gene Ontology Annotation: Molecular function=molecular_function unknown; Cellular component=extracellular space; Biological process =cell adhesion
  misc_feature: Pfam annotation: Pfam_ID=Fibrinogen_C; Match level="Score=154.3, E -value=2.7e-43, Copies=1"; Pfam description=Fibrinogen beta and gamma chains, C-t
  misc_feature (261)..(261): Xaa can be any naturally occurring amino acid
  misc_feature (300)..(300): Xaa can be any naturally occurring amino acid
MIAVVTFLLFFVHFSENAVYVGNIHELHNDVNNLKFTKLLNAKLENRPDPWKTDINSLIQPENEENNIGKTDNYVEIPIKFSFAVDKEKDRNDGNKNFILNMFRGCDALVGTSKIQLCRLDKAQESLDIKKTYPRSCREILESGINKSGIYEIKPRTSSKPFSVLCDMETKGGGWTHIQKRFDGSQDFYLGWRDYKFGFGDLNGEFWMGLENIYHMTAFETNELLIELTDRDKKNAYAQYTSFSIGPEKDGYPLMCLKDFXGDAGDALTPHLNAKFTTHDVDQDTNPPKCAQMYHGGFGXTSCHASNLNGK

SEQ ID NO: 20519 - protein, 225 aa, Diabrotica virgifera
  misc_feature: Coding regions on vcDNA: vcDNA=SeqID_216; Strand=+; Position=202-876
  misc_feature: Homolog annotation: Hit_ID=XP_391821.1; Match level="QueryCoverage =74%, HitCoverage=10%, E-value=4e-36, Identity=44%"; Hit description =similar to RIKEN cDNA 2810426N06 [Apis mellifera]
  misc_feature: Pfam annotation: Pfam_ID=IPK; Match level="Score=-56.9, E-value=7.7e -05, Copies=1"; Pfam description=Inositol polyphosphate kinase
MGKSEVQSLPIHRPEPNLICVPAPCKILQNNCVNGLEKLDLGEELENVVEEEDKTVAIPEGYEIYKHQMAGHMDKGDNIGILKEDGMILKPVIKPENGEREITFYQNLSNTLDKTILELRNFVPKYYGTRCLAVNGKTYEFIVLEDLIRDFKEPCVMDIKIGRRTWDPTSTYEKICSEERKYQDCKRDLGFCIPWFQVYKLANSPLIKYDKEFGKGLNKERAEDA

SEQ ID NO: 20520 - protein, 444 aa, Diabrotica virgifera
  misc_feature: Coding regions on vcDNA: vcDNA=SeqID_217; Strand=+; Position=2-1333
  misc_feature: Homolog annotation: Hit_ID=CAH64510.1; Match level="QueryCoverage =99%, HitCoverage=83%, E-value=1e-105, Identity=47%"; Hit description= putative esterase [Tribolium castaneum]
  misc_feature: Gene Ontology Annotation: Molecular function=carboxylesterase activity
  misc_feature: Pfam annotation: Pfam_ID=COesterase; Match level="Score=336.2, E -value=4.9e-98, Copies=1"; Pfam description=Carboxylesterase
  misc_feature (397)..(397): Xaa can be any naturally occurring amino acid
  misc_feature (414)..(414): Xaa can be any naturally occurring amino acid
  misc_feature (418)..(418): Xaa can be any naturally occurring amino acid
  misc_feature (420)..(420): Xaa can be any naturally occurring amino acid
  misc_feature (422)..(422): Xaa can be any naturally occurring amino acid
AHVVQLAEGKISGGTRTDLNGDKFHSFLCIPYGKAPVGDLRFKAPLPTEPWEGVKQVITEDKTPFQKNIVLKEYTGEEDCLSLHVFTKKLPHEESKLKPVMVYIHGGGFIIGSHETTMYGPEYLMTEDIVLVSITYRIGLLGFLSIEDESLDVPGNAGLKDQVLALKWVQRNIRNFNGDPNNITIFGESAGGASVEFLLLSPSAKGLFHKAILQSGSTLNPWTLKNSPATEFAEFTKLHNLSDIDLLKSLRRMTVRELYDQQNQYIKSKKLFVDFGLITPVIEKPNPTAFLTEKPIDIIQSGKYNNVPVIMGYTDSEGLLLDFLSALGMNGAKEGEDIPIEQILPYETNLTDAQQVKRLVEKLRNFYRPEADPVGRINLSTDALFCAGIITSAKNQXKVSKNPVYFYRFSLDAXLNMXEXMXNDTRPGACHGDELGYLFKNLLT

SEQ ID NO: 20521 - protein, 206 aa, Diabrotica virgifera
  misc_feature: Coding regions on vcDNA: vcDNA=SeqID_218; Strand=+; Position=129-749
  misc_feature: Homolog annotation: Hit_ID=XP_392162.1; Match level="QueryCoverage =98%, HitCoverage=89%, E-value=8e-45, Identity=46%"; Hit description =similar to ENSANGP00000021592 [Apis mellifera]
  misc_feature: Gene Ontology Annotation: Molecular function=purine nucleotide binding; Cellular component=cytoplasm; Biological process=biological_ process unknown
  misc_feature (38)..(38): Xaa can be any naturally occurring amino acid
  misc_feature (71)..(71): Xaa can be any naturally occurring amino acid
DNDASMYVLERIVFPLTDSPTKRFNCIANTRILVNGGXYLGFDRRDGSFAAHNVPAGSYIEEGLHPEFAFXPAIEKRYSKGKFRGTKGTRVRISEVIIVPYPLRMKALGKTRYFQLREQWRITDLLFNPMIMMMVLPLLLVMVLPKMMNDPETKKEMEQIQNMAKFEMSDRFSNYLAGSTTPAQTDKDKNQAVNKKSQKTRKRIEK

SEQ ID NO: 20522 - protein, 76 aa, Diabrotica virgifera
  misc_feature: Coding regions on vcDNA: vcDNA=SeqID_219; Strand=-; Position=61-291
IQNYSVVVKKYDTSMSQIVNVLTSNTDRKTVKWKSKIISGLNTFKSGDTTRVFTVFNQVPPTRLPCSRCVGFPMTV

SEQ ID NO: 20523 - protein, 336 aa, Diabrotica virgifera
  misc_feature: Coding regions on vcDNA: vcDNA=SeqID_220; Strand=+; Position=184-1191
  misc_feature: Homolog annotation: Hit_ID=XP_315374.1; Match level="QueryCoverage =88%, HitCoverage=58%, E-value=8e-78, Identity=48%"; Hit description =ENSANGP00000020996 [Anopheles gambiae]
MPSVQQILACMFMGKLKKIYGGPVEKLYEPNSLEHISDKCLNSLYVIWKLGIYTSPIVVGLLYQRGYFEPDGLLLLTKFITTAGVIVVMSFCLRGYGRATNPTYVKYFKAVKTAERDMTPGAKQELMKYDFDFKSWPVEYKCTSDAREMVQQIPKQPKYSGLINWLWQLPFKIIAYFAIHTFGIRLIYPGTIGFLQIILDQSLMQGRSKLVELYRGERYKLQTADGNHIDTMFVDRRKTTSIGNTLVVCCEGNAGFYEIGVMSTPIEAGYSVLGWNHPGFANSTGKPYPSQEQNAIHAVMQFAEQKLNFKREDIILFRWENGGYAPPCAGGGGNII

SEQ ID NO: 20524 - protein, 435 aa, Diabrotica virgifera
  misc_feature: Coding regions on vcDNA: vcDNA=SeqID_221; Strand=+; Position=3-1307
  misc_feature: Homolog annotation: Hit_ID=XP_320688.1; Match level="QueryCoverage =97%, HitCoverage=87%, E-value=0.0, Identity=75%"; Hit description =ENSANGP00000020177 [Anopheles gambiae]
  misc_feature: Gene Ontology Annotation: Molecular function=enoyl-CoA hydratase activity; Cellular component=mitochondrial membrane; Biological process=fatty acid beta-oxidation
  misc_feature: Pfam annotation: Pfam_ID=Thiolase_N; Match level="Score=336.6, E -value=3.6e-98, Copies=1"; Pfam description=Thiolase, N-terminal domain
NGQNIVLVDGVRTPFLLSGTDYAKLMPHELAKQALSGILKKTGVPKEIIDYVIYGTVMQEVRTSNIAREAALVAGYSDKTPAHTVTMACISSNVAMTTAIGLINSGIYETIVCGGVEFMSDIPIRHSRKMRNLLLKANKAKNLQQRLSLLASIRPDYFVPDLPSIAEFSSGETMGHSADRLAAAFGANRKEQDEFALRSHTRAQEAADKGYLTDIVPFQVPGVAKQVEKDNGIRVSSPEKLASLKPAFIKPHGTVTAANASFLTDGASACLITTEAKCKQLGLKPKAYLRNFLYVSQDPIDQLLLGPAYGTPQVLERAGLTPKEIDVWEFHEAFAGQILANLKALDSDWFAQKYMNRQNRVGAPDLNKFNAWGGSLSIGHPFAATGVRLAMHTANRLVREDGQFGLVAACAAGGQGGAMILERHPDDYPQLECKL

SEQ ID NO: 20525 - protein, 317 aa, Diabrotica virgifera
  misc_feature: Coding regions on vcDNA: vcDNA=SeqID_222; Strand=+; Position=113-1063
  misc_feature: Homolog annotation: Hit_ID=XP_320688.1; Match level="QueryCoverage =85%, HitCoverage=55%, E-value=1e-107, Identity=69%"; Hit description= ENSANGP00000020177 [Anopheles gambiae]
  misc_feature: Gene Ontology Annotation: Molecular function=enoyl-CoA hydratase activity; Cellular component=mitochondrial membrane; Biological process=fatty acid beta-oxidation
  misc_feature: Pfam annotation: Pfam_ID=Thiolase_N; Match level="Score=247.1, E -value=3.1e-71, Copies=1"; Pfam description=Thiolase, N-terminal domain
MALSSARNIVKNQVTLGLIKQQGNALRTFSLGIHNNQKKSLAPKNGQNIVLVDGVRTPFLLSGTDYAKLMPHELAKQALSGILKKTGVPKEIIDYVIYGTVMQEVRTSNIAREAALVAGYSDKTPAHTVTMACISSNVAMTTAIGLINSGIYETIVCGGVEFMSDIPIRHSRKMRNLLLKANKAKNLQQRLSLLASIRPDYFVPDLPSIAEFSSGETMGHSADRLAAAFGANRKEQDEFALRSHTRAQEAADKGYLTDIVPFQVPGVAKQVEKDNGIRVSSPEKLASLKPAFIKPHWKRPWSKKFLFFWEGGLLFFP

SEQ ID NO: 20526 - protein, 83 aa, Diabrotica virgifera
  misc_feature: Coding regions on vcDNA: vcDNA=SeqID_223; Strand=+; Position=1023-1274
KVLKHGLIRLHALIILYEGHPWKRVTCAAEKVSYINSPSLLPHQFRLTAFLSVDLAVFEDGGPGGCYLQCEIHAVIRFLNAVF

SEQ ID NO: 20527 - protein, 226 aa, Diabrotica virgifera
  misc_feature: Coding regions on vcDNA: vcDNA=SeqID_224; Strand=-; Position=76-756
  misc_feature: Homolog annotation: Hit_ID=AAL05409.1; Match level="QueryCoverage =95%, HitCoverage=98%, E-value=1e-17, Identity=28%"; Hit description =peritrophin [Aedes aegypti]
  misc_feature: Pfam annotation: Pfam_ID=CBM_14; Match level="Score=137.0, E-value =4.5e-38, Copies=3"; Pfam description=Chitin binding Peritrophin-A domain
MHCSSIIFVAVLFVGGTIAQDPDCEKQQYWPDVYDCTKYYECNTQGEKVEMSCPSGLYWNPLLLTCDRPENVDCSWTVGPTESTAPPTPAPTTANPTGTTIPPWLRCDVNGEYFPDTTNCQAFYECINNVKQHMICPDPLLWNVHLPGCTESSDCSQIETSTTPASCTNGDMKADVNSCHYFYICESNQWEGPIQCPVELYWSASKRGCVKIEDSDCPGHTTVGYH

SEQ ID NO: 20528 - protein, 433 aa, Diabrotica virgifera
  misc_feature: Coding regions on vcDNA: vcDNA=SeqID_225; Strand=+; Position=155-1456
  misc_feature: Homolog annotation: Hit_ID=AAU95200.1; Match level="QueryCoverage =99%, HitCoverage=99%, E-value=0.0, Identity=83%"; Hit description =enolase [Oncometopia nigricans]
  misc_feature: Gene Ontology Annotation: Molecular function=phosphopyruvate hydratase activity; Cellular component=soluble fraction; Biological process=gluconeogenesis
  misc_feature: Pfam annotation: Pfam_ID=Enolase_C; Match level="Score=725.6, E-value= 2.9e-215, Copies=1"; Pfam description=Enolase, C-terminal TIM barrel domain
MPIKSILARQIFDSRGNPTVEVDLVTELGLFRAAVPSGASTGIYEALELRDNVKGEYHAKGVKTAINNINSIIAPELIKSGLEVTAQTDVDNFMLKLDGTENKSKLGANAILGVSLAVAKAGAAKKGVPLYRHLADLSGNKDIILPVPAFNVINGGSHAGNKLAMQEFMILPTGAANFTEAMRMGSEVYHHLKKVIKDRFGLDATAVGDEGGFAPNILNNKDGLELIKVAIANAGYTGKIEIGMDVAASEFYKEGKYDLDFKNPNSDKSKWITPDQLLDLYQEFIKEYPIVSIEDPFDQDDWPAWSKITAATSIQIVGDDLTVTNPKRIQTAVEKKACNCLLLKVNQIGTVTESIQAHNLAKANGWGTMVSHRSGETEDTFIADLVVGLSTGQIKTGAPCRSERLAKYNQILRIEEELGSAAKYAGKSFRKPQ

SEQ ID NO: 20529 - protein, 281 aa, Diabrotica virgifera
  misc_feature: Coding regions on vcDNA: vcDNA=SeqID_226; Strand=+; Position=2-844
  misc_feature: Homolog annotation: Hit_ID=XP_394436.1; Match level="QueryCoverage =97%, HitCoverage=25%, E-value=4e-69, Identity=51%"; Hit description =similar to ENSANGP00000014167 [Apis mellifera]
  misc_feature: Gene Ontology Annotation: Cellular component=myosin I; Biological process=transport
  misc_feature: Pfam annotation: Pfam_ID=Myosin_tail_2; Match level="Score=69.4, E -value=9.9e-18, Copies=1"; Pfam description=Myosin tail
YIRRLLAKRLAEKRKKAAFAIRRFIKGFITRNGPPTDENKSFLSMAKVQWLKRLAKTLPKQILYRRWPPCPFVCREASKHLEKMHGAHLSRVYRLALTPEMKRQFELKVLAESLFKDKKKSYKDSVPHLFEPDRVQEINIPMKELYASQLNGDKEIYSTNVIKFDRHGYKPRERLMVIGSKNLHLLECKGSLKPKHCLPLNRLTFTITPENDKMLLVQIPEDLIKKDKGDLILEVPNLIEALTYVMDTLKDKSVLKIISQSHIEHNMKGKHGTIDIHMEMP

SEQ ID NO: 20530 - protein, 334 aa, Diabrotica virgifera
  misc_feature: Coding regions on vcDNA: vcDNA=SeqID_227; Strand=+; Position=2-1006
  misc_feature: Homolog annotation: Hit_ID=CAF96690.1; Match level="QueryCoverage =98%, HitCoverage=64%, E-value=9e-44, Identity=37%"; Hit description =unnamed protein product [Tetraodon nigroviridis]
  misc_feature: Gene Ontology Annotation: Molecular function=translation initiation factor activity; Cellular component=eukaryotic translation initiation factor 4 complex; Biological process=regulation of translational initiation
  misc_feature: Pfam annotation: Pfam_ID=RRM_1; Match level="Score=44.0, E-value=4.3e- 10, Copies=1"; Pfam description=RNA recognition motif. (a.k.a. RRM, R
NMASGKKGKKTKGKTFALTDFLQETTGSIPVQPIRKSNINWADEVEDYDDTRKAVNVVLPTAPKASRDYDDISNTVPMEPPFWAYLSNLPYDVDEDELSAFFNNMRIANMRIPKDDRGGESKSKGYGYIEFEDRDSLLEALFLRDTTLKSRRMRIEVASNMDNDRRRGRMDMNRDRQPDRSDSFGDWRSGPRASSDSMDNRRTGFNRDRDGGGGGGGFTREGMRDRDDKSFTREGMRDRDYGRDRDNRDFGRDRDSNRDFNRDRDSNRDRKDIDDRPGGWRDGDRQNKDGDRDRDRGFNRDRGNFRDSDRGNRYDDDRRGGGFGGRRFDDKREG

SEQ ID NO: 20531 - protein, 296 aa, Diabrotica virgifera
  misc_feature: Coding regions on vcDNA: vcDNA=SeqID_228; Strand=+; Position=84-974
  misc_feature: Homolog annotation: Hit_ID=AAH76959.1; Match level="QueryCoverage =92%, HitCoverage=49%, E-value=3e-35, Identity=33%"; Hit description =MGC89384 protein [Xenopus tropicalis] ref|NP_001005064.1| MGC89384 protein [Xenopus tropicalis]
  misc_feature: Gene Ontology Annotation: Molecular function=pre-mRNA splicing factor activity; Cellular component=nucleus; Biological process=mRNA splicing
MRDYGRDRDNRDFGRDRDSNRDFNRDRDSNRDRKDIDDRPGGWRDGDRQNKDGDRDRDRGFNRDRGNFRDSDRGNRYDDDRRGGGFGGRRFDDRRDDKDRDRRDGFSRRDDRDTESSEPRERPKLMLAPRTKPVEVVPVNTTESVPSASIFGSAKPVDTAQREREIEEKIAREADKPRESSKDRDENRKHENSERKNVDRIERSRPPPRRIDDSPQRDKDHRDGPKKNYDDRKLPPKNDHKSPDRLDNRHKHDKSEKPKREEKRDRYEKDMPKLTEPEPPNFAANNKFAFLPTDSD

SEQ ID NO: 20532 - protein, 668 aa, Diabrotica virgifera
  misc_feature: Coding regions on vcDNA: vcDNA=SeqID_229; Strand=+; Position=207-2213
  misc_feature: Homolog annotation: Hit_ID=AAK73654.1; Match level="QueryCoverage =99%, HitCoverage=89%, E-value=0.0, Identity=44%"; Hit description =lysosomal alpha-N-acetyl glucosaminidase [Dromaius novaehollandiae]
  misc_feature: Gene Ontology Annotation: Molecular function=alpha-N -acetylglucosaminidase activity; Cellular component=lysosome; Biological process=neurogenesis
  misc_feature: Pfam annotation: Pfam_ID=NAGLU; Match level="Score=1038.4, E-value=0, Copies=1"; Pfam description=Alpha-N-acetylglucosaminidase (NAGLU)
  misc_feature (156)..(156): Xaa can be any naturally occurring amino acid
  misc_feature (173)..(173): Xaa can be any naturally occurring amino acid
IVDPTFIQNNKDTFEVSKEKGVINIVGTSGVAAATGFHHYLKYFCNAHISWEASQLNLPEDLPDVNVTITLNDRFRYYQNTCTTSYSFVWWNWQEWEKHIDWMALNSFNLVLAFNGQEAIWERVYKKLNFTKQDIDEHFTGPAFLSWLRMGNMRGXGGPLSASWHERSILLQXKILERMRSLGIIPVLPAFAGHLPRAVTRIYPNVNVTKMETWNSFNDSYCCPYFLDPTEELFKVIGKLFIEEQTKEFGTDHIYNCDSFNENDPTTTNTTYIGNVGKSIYAAMTAADPDAIWVMQGWLFYNNEYWHNLDRAKALITSVPTGKMIILDLQSEEFPQYDALDQYFGQPYIWCMLHDFGGTLGMFGSANIINMRVIQARHSINSTMIGTGLTPEGINQNYVIYDLMTEQAWRKESANLTTWFENYALRRYGKSNAKINEAWQLLKNTVYDFSGLHKLRGKYAITWTPTLKLDVWTWYNYSEVFDAWDIFVRNADDLKNSPGFLHDLVDLTRQVLQIYGDIYYPKIVTAFRDDDYTNFSQHATVFMEIFDDLELILSTNKAFLLGPWIEAAKSCGNNSQESNLFEYNARNQITLWGPEGEIINYANKQWSGIVANYYKPRWEIFINRMNYSLLHNTWFSETAARREMFRKAEEPFTFDRTVFPVEPTGNTI

SEQ ID NO: 20533 - protein, 240 aa, Diabrotica virgifera
  misc_feature: Coding regions on vcDNA: vcDNA=SeqID_230; Strand=-; Position=1384-2107
  misc_feature: Homolog annotation: Hit_ID=EAL32280.1; Match level="QueryCoverage =96%, HitCoverage=45%, E-value=5e-58, Identity=50%"; Hit description =GA17510-PA [Drosophila pseudoobscura]
  misc_feature: Gene Ontology Annotation: Molecular function=monooxygenase activity; Cellular component=extracellular space; Biological process =leukotriene metabolism
  misc_feature: Pfam annotation: Pfam_ID=p450; Match level="Score=-32.2, E-value=7.9e- 10, Copies=1"; Pfam description=Cytochrome P450
  misc_feature (204)..(204): Xaa can be any naturally occurring amino acid
KLDQKQNSDDSGIKNRVGLLDMLLQAKENGEDIPDEDIRAEVDTFMFEGHDTTSSGIAYTLYALAENPDVQKKLYNEIVDTLGSDKNMDLTISNLNDLKYLDIVVKEAFRKYPPVPMIERKIVEDMDLDATTVPKGTDVSIFLYGMNHDPKVFPNPDKFEPERFLPESISSRHTFAYLPFSAGPRNCIGQKFAVYEVKLSVIKXVLKFELIQDPNFIPQHGLTSVLKSKNGLKVKLRLRD

SEQ ID NO: 20534 - protein, 499 aa, Diabrotica virgifera
  misc_feature: Coding regions on vcDNA: vcDNA=SeqID_231; Strand=+; Position=2-1498
  misc_feature: Homolog annotation: Hit_ID=EAL42084.1; Match level="QueryCoverage =99%, HitCoverage=100%, E-value=2e-74, Identity=34%"; Hit description= ENSANGP00000025790 [Anopheles gambiae str. PEST] ref|XP_560555.1| ENSANGP00000025790 [Anopheles gambiae s
  misc_feature: Gene Ontology Annotation: Molecular function=signal transducer activity; Cellular component=basement membrane; Biological process =invasive growth
  misc_feature (475)..(475): Xaa can be any naturally occurring amino acid
  misc_feature (491)..(491): Xaa can be any naturally occurring amino acid
  misc_feature (495)..(495): Xaa can be any naturally occurring amino acid
GRVGVTTEENISSSTTGDVEETSADNRTTDEGTTENYTDVPSTSDSRTETTTGDNVTDNVTTEENISSSTTGDMEETSTDNRTTDEGTTENNTDVPSTTDSQTETTTGDNVTDNVTTEENISSSTTGDVEETSTDNKTTDEGTTENKPDVSSTTESQTETATDDNVTDNVTTEKNISSSTTGDLEETSADNRTTDEGTTENNTDVPSTTDSQTQTSTDDNVTDNVTTEENISSSTTGDVEETSADNRTTDEDTTENNTDVPSTSDSQTQTTTDDNVTDNVTTEENISSSTTSDVEETSADSRTTDEDTTENNTDVPSTTDTQTEISTDDNVTDNVTTEDNISSSTTGDVEETSADNKTTDESTTENNTDVPSTTNSQTEISTDDNVTDNVTTEENISSSTRGDVEETSADNRTTDEGTTENYTDVPNTTDSQTETTTGDNVTDNVTTEENISSSTTVDVEETSADNRTTDGGTTXNYTDVPSTTNSQTETXTGDXETDS

SEQ ID NO: 20535 - protein, 960 aa, Diabrotica virgifera
  misc_feature: Coding regions on vcDNA: vcDNA=SeqID_232; Strand=+; Position=2-2884
  misc_feature: Homolog annotation: Hit_ID=XP_453995.1; Match level="QueryCoverage =94%, HitCoverage=88%, E-value=4e-99, Identity=28%"; Hit description =unnamed protein product [Kluyveromyces lactis] emb|CAG99082.1| unnamed protein product
  misc_feature: Gene Ontology Annotation: Molecular function=signal transducer activity; Cellular component=plasma membrane; Biological process =invasive growth
  misc_feature: Pfam annotation: Pfam_ID=CBM_14; Match level="Score=60.5, E-value =4.9e-15, Copies=1"; Pfam description=Chitin binding Peritrophin-A domain
HDVVCPEVDGPVSVYARLPDCTKFCQCSNGVPYLHHCPLGLHFNPSLNVCDWPEDAGCNNVIDVTESTSKEGSTSTATTEYNEVTTKNNTTNESTDSTDVPNTTESQTKTTTGENVTDNVTTEDNISSSTTGDVDETSADNRTTDEGTTENNTDVPSTMESETETATGDNVTDNVTTEENISSSTTGDVEETSADNKTTDEGTTENDTDVTSTTDSQTETSTGDNVTDNVTTEDNISSSTTGDVEETSADNRTTDEGTTENNTDVSSTTESQTETATGGNVTDTVTTEENISSSTTSDMEETSADNRTTDEGITEKNTDVPSTTDSQTETSTGNNETDNVTTEENISSSTTGDVEETSADNRTTHEGTTENNTDVPSTSDSQTQTTTDDNVTDNVTTEENISSSTTSDVEETSADSRTTDEGTTENNTDVPSTTDSQTETSTGDNKTDNVTTEENISSSTTGDVEETSADNRTTDEGTTENNTDVPSTSDSQTQTTTDDNVTDNVTTEENISSSTTSDVEETSADNRTTDEDTTENNTDVPSTTDTQTEISTDDNVTDNPRVRDNISSSTTGDVEETSADNKTTDESTTENNTDVPSTTNSQTEISTDDNVTDNVTTEDNISSSTTGDVEETSADNRTTDEGTTENYADVPSTTESQTETTTGDNVTDNVTTEENISSSTRGDVEETSADNRTTDEGTTENYTDVPNTTDSQTETTTGDNVTDNVTTEENISSSTTVDVEETSADNRTTDGGTTENYTDVPSTTNSQTETTTGDNETDSVTTEENISSSTTADVEDTSADNRTMDEGTTENYTDVPSTTDSQTETTTGDNVTDNVTTQENISSSTTGDVEETSADNRTTDEGTTENYTDVPSTAKTTTENNIDEKTTSAANSTEESSNTDVTTTEAIGTSTDNTNDDANNTTTLAPENGTAICLRNNVVLPCNRWTRFMVRVLYTDCTKF

SEQ ID NO: 20536 - protein, 68 aa, Diabrotica virgifera
  misc_feature: Coding regions on vcDNA: vcDNA=SeqID_233; Strand=+; Position=107-313
  misc_feature: Homolog annotation: Hit_ID=Q7Z1B8; Match level="QueryCoverage=100%, HitCoverage=100%, E-value=9e-31, Identity=91%"; Hit description =Protein transport protein SEC61 gamma subunit gb|AAP47228.1| Sec61p gamma subunit [Gryllotalpa
  misc_feature: Pfam annotation: Pfam_ID=SecE; Match level="Score=78.0, E-value=2.6e -20, Copies=1"; Pfam description=SecE/Sec61-gamma subunits of protein t
MDQIAKFVEPGKQFAKDSIRLVKRCTKPDRREFQKIAIATAIGFCIMGFIGFFVKLIHIPINNIIVGS

SEQ ID NO: 20537 - protein, 134 aa, Diabrotica virgifera
  misc_feature: Coding regions on vcDNA: vcDNA=SeqID_234; Strand=+; Position=44-448
  misc_feature: Homolog annotation: Hit_ID=AAO18183.1; Match level="QueryCoverage =82%, HitCoverage=92%, E-value=2e-16, Identity=38%"; Hit description =13 kDa hemolymph protein a precursor [Tenebrio molitor]
  misc_feature: Pfam annotation: Pfam_ID=PBP_GOBP; Match level="Score=92.2, E-value =1.3e-24, Copies=1"; Pfam description=PBP/GOBP family
MKFLVFSLVFAVYYANAAITPEQAEKIKSFHKECLPESGVNPELVQKARQGDFANDDKLKAHIFCVSKKIGFQNDAGEIQVEVLKAKVGAALEDPALAAQLIGTCAKQQANGPETAFETIKCYHEKTPIHLSII

SEQ ID NO: 20538 - protein, 289 aa, Diabrotica virgifera
  misc_feature: Coding regions on vcDNA: vcDNA=SeqID_235; Strand=+; Position=132-998
  misc_feature: Homolog annotation: Hit_ID=XP_311994.1; Match level="QueryCoverage =92%, HitCoverage=54%, E-value=1e-127, Identity=86%"; Hit description= ENSANGP00000018558 [Anopheles gambiae]
  misc_feature: Gene Ontology Annotation: Molecular function=pre-mRNA splicing factor activity; Cellular component=nucleus; Biological process=mRNA processing
  misc_feature: Pfam annotation: Pfam_ID=RRM_1; Match level="Score=73.8, E-value=4.7e- 19, Copies=2"; Pfam description=RNA recognition motif. (a.k.a. RRM, R
MGEEKDSKERDRSRERNEKDRRKRSRSREHRRRSRSRSRGRRRSRSPSPRNNKHSSGYSRRRKPSLYWDVPPPGFEHITPLQYKAMQAAGQIPANIVADTPQAAVPVVGSTITRQARRLYVGNIPFGVTEEEMMEYFNQQMHLSGLAQAAGNPVLACQINLDKNFAFLEFRSIDETTQAMAFDGINFKGQSLKIRRPHDYQPMPGMSENSISVPAGVISTVVPDSPHKIFIGGLPNYLNEDQVKELLMSFGQLRAFHLVKDTAFGLSKGYAFAEYIDITMTDQAIAGLN

SEQ ID NO: 20539 - protein, 358 aa, Diabrotica virgifera
  misc_feature: Coding regions on vcDNA: vcDNA=SeqID_236; Strand=+; Position=51-1127
  misc_feature: Homolog annotation: Hit_ID=EAL39479.1; Match level="QueryCoverage =79%, HitCoverage=31%, E-value=7e-74, Identity=44%"; Hit description =ENSANGP00000025541 [Anopheles gambiae str. PEST] ref|XP_554755.1| ENSANGP00000025541 [Anopheles gambiae st
  misc_feature: Gene Ontology Annotation: Molecular function=intracellular cGMP activated cation channel activity; Cellular component=plasma membrane; Biological process=cyclic nucleotide metabolism
  misc_feature (327)..(327): Xaa can be any naturally occurring amino acid
MENICRFKKRMVYPEQLNLDQVVHKSAQKASSWCSEPLEETSNNVNVQETQTNGSVNEKVDNNSYKNGGIHQTTANKQFIQDRIRHLVDAFSTRAQAARERIETPATPSSVSSRETIDQQPPIPMKQKLSISFSDKHIEESFEEKDESMGLKQRFERKIIDPNGRFYVIWMSIAAMSVFYNAWVIPMRSTFPYQTKENRVVWMVFDYIADFIYITDVFCIQPRVKYLHEGFWVTDIKLLRSNYMKSKRFKLDLLSLLPLDFLYIIWGPEFVILRLPKFFKVHTFWEFFSLVDKLLSNPYVIRISRTLMYMMYLIHLNACAYYSFSAXEGIGSNNFVFNGKGNAYIMCFYFVTHTVTSI

SEQ ID NO: 20540 - protein, 654 aa, Diabrotica virgifera
  misc_feature: Coding regions on vcDNA: vcDNA=SeqID_237; Strand=+; Position=24-1988
  misc_feature: Homolog annotation: Hit_ID=XP_316832.1; Match level="QueryCoverage =92%, HitCoverage=60%, E-value=1e-154, Identity=44%"; Hit description= ENSANGP00000010269 [Anopheles gambiae]
  misc_feature: Gene Ontology Annotation: Molecular function=protein binding; Cellular component=alpha-glucosidase complex; Biological process =protein modification
  misc_feature: Pfam annotation: Pfam_ID=Glyco_hydro_31; Match level="Score=615.7, E -value=3.5e-182, Copies=1"; Pfam description=Glycosyl hydrolases family 31
  misc_feature (600)..(600): Xaa can be any naturally occurring amino acid
MDPYRNRNADNDHYEVGSPMAVYGSVPVVYGHSENQTSGIFLHNAAEQWVDIWYDEESTSGWSYFMVESGTLDLFVLLGNQPKNVVRQFTKLTGVAHMPQLWTLGYHQCRWSYKTQEDTKFVVAEMNANNFPMDAIWLDIDYTDGKRYFTWDPETYSDPEELQRNLSSTNKKLVVILDPHIKVDEDYPVYTGAKGKYFVKKPNGEDFKGDCWPGLSSYIDFLDPEARDYYASWYSYEKFKKSTPVLAGVWNDMNEPSVFDDELEKTLPFDVLHHGNVPHRDIHNIYGFLQTMATHQGLMQRDNGTKRPFILTRSHFAGSQRYTAMWTGDNTADWPFLQVSYSECILSNIMGLVFCGADVGGFFHNPETELVQRWYQAGVWLPFYRGHAENNTDRREPYIYSTEVQDVIRNALRLRYKHIPVWYTLFYEHTRTGDPVVRPIFYDYPGSVDQDYHILLGSNILARPVMEKGARSVTVNFPGSEDNQWYRVDDGSFKIYNGQSSAILPVTILTSPYFYKAGSIITRRDEERSSTAEMQDDPFVLYVNVDKENTASGNLYVDDYTSFEYQNNQRYFYANLAYQSNQIDISIVDGNFSGMTVTLXQVIVHQQSDKDEKRYTRTVYTHLADGTPLKKYNIVEKLKRNNMVSLKYKIMKFV

SEQ ID NO: 20541 - protein, 370 aa, Diabrotica virgifera
  misc_feature: Coding regions on vcDNA: vcDNA=SeqID_238; Strand=+; Position=56-1165
  misc_feature: Homolog annotation: Hit_ID=CAE63660.1; Match level="QueryCoverage =84%, HitCoverage=39%, E-value=2e-25, Identity=28%"; Hit description =Hypothetical protein CBG08162 [Caenorhabditis briggsae]
  misc_feature: Gene Ontology Annotation: Molecular function=alpha-glucosidase activity; Cellular component=endoplasmic reticulum; Biological process=protein modification
MERSDKMLRPLLLLALIASYVSCANHTIYKDCSRIPFCKKLRTIENHSKFTAQLDKLSQTGNVISIPLTNSDSQELILQISLLVHETARIKIAEKGSKRYQLADVLAEEPQTLEISAKTSEREVSIAPTNASYSYKVVVTTGTSFKVEFYYDDNTKEIALNGEQLVFDKEDNSFAFATEFINAKRLYGLHHHPVKLELPSTRDVDGKVLMDPYRNRNADNDHYEVGSPMAVYGSVPVVYGHSENQTSGIFLHNAAEQWVDIWYDEESTSGWSYFMVESGTLDLFILLGNQPKNVVRQFTKLTGVAHMPHYGLWGTPQCRWSHKKPQKKTPNFLPRPKIKAPPFSRRGCSFGCGNLVNKPHGRKRKIFILG

SEQ ID NO: 20542 - protein, 496 aa, Diabrotica virgifera
  misc_feature: Coding regions on vcDNA: vcDNA=SeqID_239; Strand=+; Position=118-1602
  misc_feature: Homolog annotation: Hit_ID=XP_318117.1; Match level="QueryCoverage =99%, HitCoverage=80%, E-value=0.0, Identity=77%"; Hit description =ENSANGP00000017814 [Anopheles gambiae]
  misc_feature: Gene Ontology Annotation: Molecular function=RNA helicase activity; Cellular component=bud neck; Biological process=mRNA splicing
  misc_feature: Pfam annotation: Pfam_ID=DEAD; Match level="Score=180.5, E-value=3.6e- 51, Copies=1"; Pfam description=DEAD/DEAH box helicase
  misc_feature (458)..(458): Xaa can be any naturally occurring amino acid
  misc_feature (478)..(478): Xaa can be any naturally occurring amino acid
MTDSGPSVKRYRREENSNSDSDDNYVPYVPVKERKKQQLLKLGRLGQLKETEQNKPKSSSENETNEDEEEDEIWGRKNNIPLLDQHTELRKLAEAKKVSAVEKQLKKEEEILEIVAEKKALMGVSELAKGIQYRDPIKTSWHPPRYILQKPPQAHEKLRMSLRILVEGDEIPPPLKTFKEMKLHEGIIAGLKEKHIKKPTPIQIQGIPTVLSGRDMIGIAFTGLGKTLVFVLPLIMFCLEQEVKLPFIKNEGPYGLIICPSRELAKQTYDIIQHYSNSLNKHGMPLIRSCLAIGGVPVTEALEVIQKGVHIMVATPGRLMDMLEKKIVKLTVCRYLCMDEADRMIDLGFEEDVRTIFSYFNGQRQTLLFSATMPKKIQNFARSALVKPITINVGRAGAASMNVVQEVEYVKQEAKIVYLLECLQKTPPPVLIFAEKKQDVDAIHEYLLLKGVEAVAIXHGGKDQEERSRSVEAFRKRXKDVLVATDVASKGLDFPD

SEQ ID NO: 20543 - protein, 283 aa, Diabrotica virgifera
  misc_feature: Coding regions on vcDNA: vcDNA=SeqID_240; Strand=+; Position=288-1137
  misc_feature: Homolog annotation: Hit_ID=EAL32124.1; Match level="QueryCoverage =100%, HitCoverage=48%, E-value=1e-118, Identity=72%"; Hit description=GA22166-PA [Drosophila pseudoobscura]
  misc_feature: Pfam annotation: Pfam_ID=TH1; Match level="Score=272.0, E-value=1e -78, Copies=1"; Pfam description=TH1 protein
  misc_feature (278)..(278): Xaa can be any naturally occurring amino acid
MEEDYDDRPWDGGDRHDDSDAGDEPENPEQVLAECAEKFSTPDYIMEPGIFSQLKRYFQSGGNPLQVIEELSQNYTAVAQMANLIAEWLIIGGVKVTDVQAMVENHLKEMILKTFDPKKADTIFTEEGETPAWLTQLIEHPTWRSLIYRLAEEYPDCLMLNFTIKLISDAGFQGEITSISTAAQQLEVFSRVLKTSITSFLSNPEEWQNTSKECAKMVCHGQHTYVYSQVIIHILARESKGGSSMKRLSQEITKCAQKNGNDVTPITMALNGASGYPXACQAL

SEQ ID NO: 20544 - protein, 279 aa, Diabrotica virgifera
  misc_feature: Coding regions on vcDNA: vcDNA=SeqID_241; Strand=+; Position=111-950
  misc_feature: Homolog annotation: Hit_ID=NP_523429.1; Match level="QueryCoverage =92%, HitCoverage=34%, E-value=3e-38, Identity=36%"; Hit description =CG1685-PA [Drosophila melanogaster] gb|AAF50828.1| CG1685-PA [Drosophila melanogaster]
  misc_feature: Gene Ontology Annotation: Molecular function=molecular_function unknown; Cellular component=cellular_component unknown; Biological process=nucleobase, nucleoside, nucleotide and nucleic acid metabolism
MTTKNANSEPIVGPPKKKFKKDGTTDKSKKIKKSVEGSTKHSKTDKPAPKKDFTKPNSKFVSNNNFRDKKTGKFDKDKNKPEIFENWNEFKKKKKELKLKRRQNKDGFDVIVKAKRIGEELRKKSLNGGEQKRVQLINELHSLLKGGGHYPKFVLAHDTARIVQWLLKYASDLVINQISKELIPVSVNMLQSKYGIHCVKRLLKYGKNEIRSQVIDAMVGHAVKLSTRNISAPVVEYAFSTWATPLQSRNLVAEFYGDLYRSNQDNNVKHLRDTEPVYP

SEQ ID NO: 20545 - protein, 419 aa, Diabrotica virgifera
  misc_feature: Coding regions on vcDNA: vcDNA=SeqID_242; Strand=+; Position=388-1646
  misc_feature: Homolog annotation: Hit_ID=EAL26502.1; Match level="QueryCoverage =94%, HitCoverage=87%, E-value=9e-42, Identity=34%"; Hit description =GA21771-PA [Drosophila pseudoobscura]
  misc_feature: Pfam annotation: Pfam_ID=bZIP_2; Match level="Score=57.1, E-value =4.8e-14, Copies=1"; Pfam description=Basic region leucine zipper
  misc_feature (153)..(153): Xaa can be any naturally occurring amino acid
MTTTVSSILKFLENADKNFAMDTDADIPKSKKRKLDHLTWEEKLQRKKLKNRVAAQTSRDRKKAKMEQMEQALQQLFVKNESLLVECKNLKLANQKLQQENTELYNRLQAPCLSCAQAQNRSVGCESLNGSTASLLLPKGRVTHPAAALSKQXDNGLVENRTDLPSLPDLLDELEADVDLNSLEQLTQSLLEDIARDLEATAQKTSNEESGSNGSSYGEMVGTTSTELESSGCTTNTKSLESDISEYLLLHHNYAAKPPLDDTLKTKSPINRNRKLKTIKPKRKIVTTKPVVPESDVVYGTLDEVSNVVTIIVDSNGVPMTEEALQRLENREEETQLTVPLPPVTQGELVTPLPVAESNRSTSSSVAESHLTVPTAMLECLSPMSCSDSDRGYESLDSPISLPEDLWDQSISELFPSLL

SEQ ID NO: 20546 - protein, 100 aa, Diabrotica virgifera
  misc_feature: Coding regions on vcDNA: vcDNA=SeqID_243; Strand=-; Position=1110-1412
DSASCGIINPGSVFVCLDMSSHSDLSCGLVMHRYMFMVVRSSSTSFSHLVLSLSFLRLHICFHRNICCAAFAASVWLRLFLFSRLITYYTLQVIITFIYY

SEQ ID NO: 20547 - protein, 239 aa, Diabrotica virgifera
  misc_feature: Coding regions on vcDNA: vcDNA=SeqID_244; Strand=+; Position=418-1137
  misc_feature: Homolog annotation: Hit_ID=AAU44973.1; Match level="QueryCoverage =89%, HitCoverage=89%, E-value=3e-65, Identity=53%"; Hit description =cellulase I [Apriona germari]
  misc_feature: Pfam annotation: Pfam_ID=Glyco_hydro_45; Match level="Score=279.1, E -value=7.2e-81, Copies=1"; Pfam description=Glycosyl hydrolase family 45
MIFIIFSLLAFVGLAPSIDALELTPVEGGLSGNGSTSRYWDCCKPACAWPSNVPHSPRPVTSCKADGITPINPDAMSGCENGTAYTCTNQQPFIVNQTYGYGFAAAYLIGGPSTNNFCCACFLLNFTDQIKYKHMVVQVTNSGTNFDKNEFVIALPGSGVGDHPEGCHDQWNAPWTGWGDQYGGVHMRSECVTLLPEELQEGCKFRFDFMETAANPLVSFQQVVCPDELVKISGCRIPE

SEQ ID NO: 20548 - protein, 288 aa, Diabrotica virgifera
  misc_feature: Coding regions on vcDNA: vcDNA=SeqID_245; Strand=+; Position=92-955
  misc_feature: Homolog annotation: Hit_ID=NP_001002055.1; Match level="QueryCoverage= 99%, HitCoverage=64%, E-value=1e-106, Identity=65%"; Hit description =zgc:86624 [Danio rerio] gb|AAH71320.1| Zgc:86624 [Danio rerio] sp|Q6IQT4|CSN2_BRARE COP9
  misc_feature: Gene Ontology Annotation: Molecular function=signal transducer activity; Cellular component=signalosome complex; Biological process= signal transduction
MDDDFFYENENDYDYEYSEESTSEPDVDLENQYYLAKNLKEEHIEQSVNAFQKVLELQGEHKGEWGFKSLKQLVKVHFRLKNYDAMIKMYKDLLGYINNAVTKNQGEKAINSILDYTSALKDVQLLQDLYEITLSTLKHARNDRLWFKTNTKLGKVYLERGDFGKMASTLRQLKATLTPDSHEYDPHKGTQLLEIYALEIQMYTQQKNYKQLKELYERSLKVRSAIPHPLIMSIIRECGGKMHLRSGDYEKAYTDFFEAFKNYDEAGNPRRINCLKYLILTSMLLVSA

SEQ ID NO: 20549 - protein, 462 aa, Diabrotica virgifera
  misc_feature: Coding regions on vcDNA: vcDNA=SeqID_246; Strand=+; Position=158-1542
  misc_feature: Homolog annotation: Hit_ID=XP_392150.1; Match level="QueryCoverage =94%, HitCoverage=78%, E-value=7e-92, Identity=41%"; Hit description =similar to ENSANGP00000005196 [Apis mellifera]
  misc_feature (444)..(444): Xaa can be any naturally occurring amino acid
  misc_feature (447)..(447): Xaa can be any naturally occurring amino acid
MSSAVNQEVYKKFKNARKLLSTDSTDSTVQVDVREDEEQLIKLQEIIDILVAAGYFRARIKGLSAFDKVVGGMVWCIESCNVELDVDLLFRENLSIGQKIALTEKIVAVLPKIKCPRSIEPHQIQGLDFIHIFPVIQWLVKRSLECREEVAAFVRACAIEQFNKKFHSPDQNQENVNLLKNMKLLSEVYRPRRYYKKKNSAPTSTLSQIQSTLLEYGHSDGGIGDYSMFTAKDKEGSDDQEFVDLDDEHKEQLMKHYTSLQFELTSGAGVQSRDQLLIASLEEKKQLFTEKCKEFKINKASLDSDIKSKAKVLQELESKQKEAEVALKELSQEELESSKVKEIEELIMLNDDLKTQETQFKEQCKKELSNLNNQIQNVKNAKVNIPVENPSVVMSELNELSEKNASMRMKLAKVNRDVAILHRQIDDIPKRAELAQYQKRFVEXYYXSAVKHRNQAVYTLYN

SEQ ID NO: 20550 - protein, 325 aa, Diabrotica virgifera
  misc_feature: Coding regions on vcDNA: vcDNA=SeqID_247; Strand=+; Position=1-978
  misc_feature: Homolog annotation: Hit_ID=NP_649413.3; Match level="QueryCoverage =94%, HitCoverage=60%, E-value=1e-110, Identity=59%"; Hit description= CG11241-PA [Drosophila melanogaster] gb|AAF51855.3| CG11241-PA [Drosophila melanogaster]
  misc_feature: Pfam annotation: Pfam_ID=Aminotran_3; Match level="Score=84.9, E -value=2.1e-22, Copies=1"; Pfam description=Aminotransferase class-III
PLALHQGYKQWLFDIDGNRYLDMYGGVCTVSVGHCHPKITSAMKDQMDTLGHSTNIYYQTKIHEYAKKLADKLPGNLECIYFVNSGSEANDLALLMARSYTEKFDVMSLKNCYHGLTYQVMGMTSNNFYKYPVPGAAGMFKTMNPDIYQGIWGGNKCRDSLVQTDRHCDCTGECEAGLKYLEQFEYELNHDIPKTGLAAFWAESIQGLGGVVQYPKNFIKGVYDRVRSQGGLYVADEVQSGFGRTGDHFWGFESHGIVPDIVTMAKGIGNGYPLAAVATTKEIATALTKAVHFNTFGGNPVACAGGNISIFRDYKKKKDYPKIVK

SEQ ID NO: 20551 - protein, 200 aa, Diabrotica virgifera
  misc_feature: Coding regions on vcDNA: vcDNA=SeqID_248; Strand=+; Position=107-709
  misc_feature: Homolog annotation: Hit_ID=XP_313411.1; Match level="QueryCoverage =99%, HitCoverage=94%, E-value=2e-61, Identity=60%"; Hit description =ENSANGP00000011326 [Anopheles gambiae]
  misc_feature: Gene Ontology Annotation: Cellular component=mitochondrion
  misc_feature: Pfam annotation: Pfam_ID=Ribosomal_S11; Match level="Score=84.7, E -value=2.4e-22, Copies=1"; Pfam description=Ribosomal protein S11
MAINQVNILFKNLLLQSHKAVHARSLFTSTLNLRDVVDRKEMLRSMPAIDEGTHGEKSIDIDSAITKRDLFPTIDTPNKLFNGIPFKDLPIFNIRVTRNNTILCLTDAKGTPKLTRSCGVEGFKNTKKGTNIAAQATAISAGTKALDQGHKIVRVRVRGLGPGRMASIKGLQMSGLDIVSITDSTKVSWNGPRPRKQRKL

SEQ ID NO: 20552 - protein, 396 aa, Diabrotica virgifera
  misc_feature: Coding regions on vcDNA: vcDNA=SeqID_249; Strand=+; Position=20-1208
  misc_feature: Homolog annotation: Hit_ID=XP_392376.1; Match level="QueryCoverage =89%, HitCoverage=14%, E-value=1e-106, Identity=53%"; Hit description= similar to ENSANGP00000002892 [Apis mellifera]
  misc_feature (353)..(353): Xaa can be any naturally occurring amino acid
MEKLKQALGVTSQQIKSESIKKEKLQGHSQEQHHPQPTSSHSHSPRKLTKQVALESPNNSEFEDNGHFKSLKMDNQRDLMVNHRQRIRKAGPFAMNSYSLHDPRKPGAWMSPQLSLKLEGIDLKQSSFRTGEECVAERCTECGLVKEEYSDEEIGLCIVTLGTFIHREPALAAPMLPDILSIVAKVATNAMYPWQTESNIHLPGGAISVAHQFLRCVLHQLAPNGIFTQMFQTNAPENIRIQFFKSVIQALIDFNELNPVAPIQLLLETLNSKKTLPVDILPTILQNMACYLNCLPLEVALGASTPMWGTVLQQVEILYRKLLFLLNTMDDIIPLLKIMSSLFKIPLISQFKXILEPFSKVLSYAIQTQTMNLWCLIEFCYFVYKAFTKERDKLIL

SEQ ID NO: 20553 - protein, 261 aa, Diabrotica virgifera
  misc_feature: Coding regions on vcDNA: vcDNA=SeqID_250; Strand=+; Position=146-928
  misc_feature: Homolog annotation: Hit_ID=XP_392618.1; Match level="QueryCoverage =99%, HitCoverage=38%, E-value=1e-41, Identity=41%"; Hit description =similar to ENSANGP00000016679 [Apis mellifera]
MAQWIGYMVSIKCSNDSTYQGEILTATTTNITLTKAFCNGFPCERNEVKIRADSILDLKLIEKQKDNLDERSTITIAKPIAKRAGRTHSTSEPHSSANKFAASSSLHNRSKPIDIEIKQTQEAVNNSFKNSTPNKKEKNNRKWTKGWRDEECFGSPMEQSNIGKDFDFEKNLALFNKQAIWDEINAQKPDVVKHIDARKPTKYRHDENIISTIPTSYRQITVPKQDFCEYVTDDRLIIPSISRALRKRLWEVAERVGLTWE

SEQ ID NO: 20554 - protein, 538 aa, Diabrotica virgifera
  misc_feature: Coding regions on vcDNA: vcDNA=SeqID_251; Strand=+; Position=51-1667
  misc_feature: Homolog annotation: Hit_ID=EAA43934.2; Match level="QueryCoverage =98%, HitCoverage=38%, E-value=0.0, Identity=58%"; Hit description =ENSANGP00000025172 [Anopheles gambiae str. PEST] ref|XP_555577.1| ENSANGP00000025172 [Anopheles gambiae str.
  misc_feature: Gene Ontology Annotation: Molecular function=electron carrier activity; Biological process=reproduction
  misc_feature: Pfam annotation: Pfam_ID=FAD_binding_5; Match level="Score=293.3, E -value=3.8e-85, Copies=1"; Pfam description=FAD binding domain in molybdopterin d
  misc_feature (496)..(496): Xaa can be any naturally occurring amino acid
MVMQVDSNSTLVFYVNGKKIVEENVDPEWTLLYYLRNQLRLCGTKLGCGEGGCGACTVMVSKFDREKNKVVHLPVNACLAPICSMHGLAVTTVEGIGSTKTKLHPVQERIAKSHGSQCGFCTPGIVMSMYTLLRNSPKPSMKDLEVAFQGNLCRCTGYRPIIEGYKTFTEEWELIQTGNKLNGVNGTNGCGMGDKCCKLQKGINGKHEDDEVLFNPSEFTPYHPSQEPIFPPELKLNDTYDKQNLVFKGANTTWYRPTKLSELLDLKQKFPNAKLVVGNTEVGVEVKFKHMVYPDIIQPVQIPELTSIEQTPKGVKIGASATLVDIENYLQKQINEQQEHKTKIFKAVIQMMNWFAGKQIRSVGALGSNIMTGSPISDMIPILMAAKAKLELFSNDGSRTVTLDNNFFVGYRKSIVKPEEILLSILIPYTQENQYFEAYKQARRREDDIAIVNEAVNVTFKPQTDIIKDISFGIGGMSFKTVSAPKTEAKLIGLSXDKTMLDTAFNSLLEDLPLDAGAPAGMISYRKALPMSSFFKRT

SEQ ID NO: 20555 - protein, 279 aa, Diabrotica virgifera
  misc_feature: Coding regions on vcDNA: vcDNA=SeqID_252; Strand=+; Position=118-957
  misc_feature: Homolog annotation: Hit_ID=XP_395349.1; Match level="QueryCoverage =95%, HitCoverage=91%, E-value=1e-74, Identity=53%"; Hit description =similar to CG17556-PA [Apis mellifera]
  misc_feature: Pfam annotation: Pfam_ID=TPR_2; Match level="Score=40.1, E-value=6.7e- 09, Copies=4"; Pfam description=Tetratricopeptide repeat
MGNFRRDLEELKQFRDSNDRKSREVVNIWNSSIHSNVDKLGKEKHVVLEQVCMAALDSFNLKIAEICIKELYEEFPNSCRVQILESMLHEADENFDRALLILKNIIKLDATNSSARKRKIAILKSLGRNSEAIKELTEYLKVFMADIEAWQELSELYLTEFDYNKAAFCVEELILHNPHNHLLHQRYADIKYTQGGLENIEVARTYYYQALKLNPNNMRAMYGIYLTTSALLNTQKAVTGKKKDAVNKLLEWILKEIKQRYVEKQQIDALKEAVSALEI

SEQ ID NO: 20556 - protein, 171 aa, Diabrotica virgifera
  misc_feature: Coding regions on vcDNA: vcDNA=SeqID_253; Strand=+; Position=2-517
  misc_feature: Homolog annotation: Hit_ID=NP_036124.1; Match level="QueryCoverage =95%, HitCoverage=21%, E-value=1e-44, Identity=57%"; Hit description =ATP-binding cassette, sub-family D, member 2 [Mus musculus] gb|AAH19187.1| ATP-binding cassette,
  misc_feature: Gene Ontology Annotation: Molecular function=ATP-binding cassette (ABC) transporter activity; Cellular component=integral to plasma membrane; Biological process=transport
  misc_feature: Pfam annotation: Pfam_ID=ABC_tran; Match level="Score=-50.1, E-value =0.033, Copies=1"; Pfam description=ABC transporter
  misc_feature (10)..(10): Xaa can be any naturally occurring amino acid
  misc_feature (50)..(50): Xaa can be any naturally occurring amino acid
  misc_feature (78)..(78): Xaa can be any naturally occurring amino acid
FYIPQRPYIXIGNLRDQVIYPDTYTDTVKKGITEENLLENNRLSVHLDHXIVERDGFYRNRKIGLDILSGGEKQRIGXARLFYHKPKYALFGRMHFSQSPFDVESFIYQSAIDMGITLLTITHRPTLWKFHTHILQFDGTGSWEFSQLNHTSRLTLKKEKEDLLKAENNEE

SEQ ID NO: 20557 - protein, 408 aa, Diabrotica virgifera
  misc_feature: Coding regions on vcDNA: vcDNA=SeqID_254; Strand=+; Position=2-1228
  misc_feature: Homolog annotation: Hit_ID=CAI13670.1; Match level="QueryCoverage =97%, HitCoverage=39%, E-value=1e-115, Identity=52%"; Hit description= insulin-degrading enzyme [Homo sapiens]
  misc_feature: Gene Ontology Annotation: Molecular function=signal transducer activity; Cellular component=soluble fraction; Biological process =cell-cell signaling
  misc_feature: Pfam annotation: Pfam_ID=Peptidase_M16_C; Match level="Score=68.6, E -value=1.7e-17, Copies=1"; Pfam description=Peptidase M16 inactive domain
  misc_feature (380)..(380): Xaa can be any naturally occurring amino acid
AELAGLKWELINTKYGLILGIGGYNNKQHILLKKIMEKLTNFKIDPKRFNILKETYIRNLKNFAAEQPYQHAVYYLTVLLTEHSWTKQELLAATDQLTIERLEAFIPQMLSKMHIECLIHGNVNKEKALELVHIVEDGLTTAMSMSPLLPRQLLLNRELKLEDGSDYSYEVSNDVHKSSCIELYYQCGLQSKENNVKLELVAQIVQEPCFNILRTKEQLGYIVFSGVRRSNGVQGLRIIVQSDRHPNYLDSRVEKFLESMLEHITEMSEEDFLKHREALAAQRLEKPKQLNALTNKFWQEITSQQYHYDRANVEVAYLRTLTKEDIIDFYKEVLSKNAEKRKKLTVQVLSMAEGGAGRNAAEETNEVGDGTCSASVINDXTVFKSCHEMYPLVQPYINITRKGNKCKL

SEQ ID NO: 20558 - protein, 522 aa, Diabrotica virgifera
  misc_feature: Coding regions on vcDNA: vcDNA=SeqID_255; Strand=+; Position=335-1899
  misc_feature: Homolog annotation: Hit_ID=XP_392075.1; Match level="QueryCoverage =95%, HitCoverage=72%, E-value=1e-138, Identity=50%"; Hit description= similar to CG12598-PA [Apis mellifera]
  misc_feature: Gene Ontology Annotation: Molecular function=double-stranded RNA binding; Cellular component=nucleus; Biological process=central nervous system development
  misc_feature: Pfam annotation: Pfam_ID=A_deamin; Match level="Score=283.8, E-value =2.8e-82, Copies=1"; Pfam description=Adenosine-deaminase (editase) domain
  misc_feature (479)..(479): Xaa can be any naturally occurring amino acid
  misc_feature (519)..(519): Xaa can be any naturally occurring amino acid
MANELETESLETSVEEKSSGKRSQEDDYLNPQKKRKSEPKNINLQEKNPISLLNELRLGLKYDIIEHMGPSHNPTFKICVEVDGQKYFGVGNSKKAAKFEAATEALKSFIQFPTNGTFLSKKTVPGTRLDFTSDQVINKKHDNTLSNKNKGVKGPLMILNELYPDAEFTCISNESDPYGRFKISININNETYYGTGSNKRLAKNAAASRALSKLTNYTSPSSANSAMEDLPFATKEEQDLADTVGRLVNEKFSSLMADDCVHIKRKVLAGIVKTTNNDLSTAEVICVTTGTKCVAGDYISINGASLNDMHAEILSRRCLINYFYDQLELLLSNSTKDNSIFTLKADKKGYQLKPEIDFHLYINTAPCGDARIFSPHEEIAVDKHPNRISRGQLRSKIESGEGTIPVKNAAAIQTWDGIVQGERLLTMSCSDKICRWNVLGLQGALLSHFIEPIYLKSLTLGSLMKESHLYRAICGRIEXTLQGLPPPFLLNRPTMLRVTSVEVRQPQKAPNFSVIWTMXMQK

SEQ ID NO: 20559 - protein, 311 aa, Diabrotica virgifera
  misc_feature: Coding regions on vcDNA: vcDNA=SeqID_256; Strand=+; Position=24-955
  misc_feature: Homolog annotation: Hit_ID=AAF67724.2; Match level="QueryCoverage =100%, HitCoverage=62%, E-value=1e-146, Identity=82%"; Hit description=insecticide resistance-associated cytochrome P450 [Diabrotica virgifera virgifera]
  misc_feature: Gene Ontology Annotation: Molecular function=cytochrome P450 activity; Cellular component=extracellular space; Biological process= leukotriene metabolism
  misc_feature: Pfam annotation: Pfam_ID=p450; Match level="Score=-134.4, E-value =4.4e-05, Copies=1"; Pfam description=Cytochrome P450
  misc_feature (272)..(272): Xaa can be any naturally occurring amino acid
MDVFKYVYSVLVAVVVIYIVYKFLKLRSVLKKVYKLPGPPKLPIFGNFFDLFYCDSVQLFNQFREWGQKYSPVYAFLVFGQPIVCISGAEEFEKIAAGSKHLSKGFSYKLVEPWLGKGLLTNSGSLWQQRRKILTPAFHFSILQEFVKVFNKETARLVETIKKENKKSATNIVPLISQTALNTIAETSFGTTLDLTKTDDKNYVSAIHEMGEILIYRIIRPWFHSLLIFSIVSSVGVRLKQVLSTLHSFTERILLERSRDFKPFEVNTDGEXKRKKLAFLDLLLKCKISKRIIDDQGIKDEVNTFMFEGHD

SEQ ID NO: 20560 - protein, 510 aa, Diabrotica virgifera
  misc_feature: Coding regions on vcDNA: vcDNA=SeqID_257; Strand=+; Position=11-1543
  misc_feature: Homolog annotation: Hit_ID=AAF67724.2; Match level="QueryCoverage =97%, HitCoverage=99%, E-value=0.0, Identity=96%"; Hit description =insecticide resistance-associated cytochrome P450 [Diabrotica virgifera virgifera]
  misc_feature: Gene Ontology Annotation: Molecular function=monooxygenase activity; Cellular component=extracellular space; Biological process =leukotriene metabolism
  misc_feature: Pfam annotation: Pfam_ID=p450; Match level="Score=415.4, E-value=6.8e- 122, Copies=1"; Pfam description=Cytochrome P450
MNRINNISEAMDVFKNLSAVLAAVFVIYIVYKFLKIRSVLKKVYKLPGPPKLPILGNFNDLFYSDSVQLFKNFREWSRKYSPLYSVVVLDIPVVVVTGPDEFEKIASGSKHITKGMIYGLVEPWLGKGLLTNSGSLWQQRRKILTPAFHFSILQEFVKVFNKETARLVETIKQENKKSATNIIPLISQTALNTIAETSFGTTLDLTKKDDKNYVSAIHEMGKILIYRMVRPWFYSLSVFYILSSVGAKLKQVLSTLHSFTERIILERSKDFKPFEVNTDGETKRKKLAFLDLLLNAKLSKGIIDDQGIKDEVNTFMFEGHDTTATGISWILRQLATHSEYQDQIYEEIITVLGDAQKQPDLNDLNELKVMERFIKETLRLFPPVPYIARTLDEDIELNGYLIPKEALNHNIIYRLLRNPKYWPEPEKFDPDRFLPENCVNRHPFAYVPFSAGPRNCIGQRFAMFEMKAIICGIMQNFSVKLADKNEKVEIITDLVLRSAHEINLNFLPRN

SEQ ID NO: 20561 - protein, 376 aa, Diabrotica virgifera
  misc_feature: Coding regions on vcDNA: vcDNA=SeqID_258; Strand=+; Position=133-1260
  misc_feature: Homolog annotation: Hit_ID=CAG82940.1; Match level="QueryCoverage =86%, HitCoverage=40%, E-value=1e-20, Identity=28%"; Hit description =unnamed protein product [Yarrowia lipolytica CLIB99] ref|XP _500696.1| hypothetical protein [Yarrowia lipol
  misc_feature: Gene Ontology Annotation: Molecular function=molecular_function unknown; Cellular component=cellular_component unknown; Biological process=DNA repair
MIGHGLGFLVVAIGILGSVTGQFLSNYPAENRTGVFGRHSRIGYGGRGYEAENLEEKSEDAFPLDEDDEYDDNLRGDLSDDGDNGDNGEDDDYISPDDFARGYDTTGSYNPGRADDYTTTAPEGGESRAGSYPDPRSNPADPRYDPRYDRRHPNYDERLDPSSDRYDARFDPSSPSYDPRTAQYGPQYRTNSGSSGSQYNTITGSVSTSGTAGGGQYGPGGQPSGSSYPGNSQSGSSYGSGSQSGGSYSSGSQSGGSSPNAGAPYAPSPQGGSYYNAGSSSQSGSSYSSGSQSGGSSSPNSGAPYPPSSQGSSYYNSGSSSQSGSSYGSNPYGTSTGSASASGSISGSSQRFRLFHQFMVLVHIQEGSYSSGGSFR

SEQ ID NO: 20562 - protein, 423 aa, Diabrotica virgifera
  misc_feature: Coding regions on vcDNA: vcDNA=SeqID_259; Strand=+; Position=109-1381
  misc_feature: Homolog annotation: Hit_ID=XP_318878.1; Match level="QueryCoverage =99%, HitCoverage=92%, E-value=1e-156, Identity=65%"; Hit description= ENSANGP00000015771 [Anopheles gambiae]
  misc_feature: Gene Ontology Annotation: Molecular function=acyl-CoA dehydrogenase activity; Cellular component=mitochondrion; Biological process =energy pathways
  misc_feature: Pfam annotation: Pfam_ID=Acyl-CoA_dh; Match level="Score=211.7, E -value=1.4e-60, Copies=1"; Pfam description=Acyl-CoA dehydrogenase, C- terminal do
  misc_feature (275)..(275): Xaa can be any naturally occurring amino acid
MNSLTRQLFRTAKKAGARNLSVSGVRRQEPQPAELGAQFGRAPLTHLTEDEQVMKDTVARLAQDQIAPLVREMENEGKVKDSVLKMLFENGLMGIEIDSDYGGAGCNFMTTVLTVEEISKVDPAVAALVDIHNTLVNTVIIKLGNKQQKEQYLPRLATDMVASFALSEPSSGSDAFALKTTAKKDGSDYILNGSKMWISNSDIAGVFLIMANANPSAGYKGITCFIVDRDTPGFSVAKPENKLGIVASGTCMLNMDNVRVPETAILGELGQGYNXASILNEGRVGIAAQMIGLAQGCYDHTIPYTLERQQFGKPIFSFQGMQYQIAEVATQIEAARLLTYNAARMVEAKVPFMKEAAMAKFYAADIAQNVTVKCIDWMGGVGFTKDFIQEKYYRDVKIGSIYEGTANMQLSTIAKCIEREFKQ

SEQ ID NO: 20563 - protein, 241 aa, Diabrotica virgifera
  misc_feature: Coding regions on vcDNA: vcDNA=SeqID_260; Strand=+; Position=64-789
  misc_feature: Homolog annotation: Hit_ID=NP_650916.1; Match level="QueryCoverage =98%, HitCoverage=92%, E-value=2e-70, Identity=56%"; Hit description =CG17271-PA [Drosophila melanogaster] gb|AAF55808.2| CG17271-PA [Drosophila melanogaster]
  misc_feature: Gene Ontology Annotation: Molecular function=molecular_function unknown; Cellular component=nucleus; Biological process=regulation of protein activity, epigenetic
TFIQLNRMYLYSFSLIVLNVLVLIISAQKVPPGVPPQRYQQPPPPQYQPQVPQQQYQQHQVPQQQYQQPPPQQQQYQQPPPQQYQQQQQYQQVPQQVPVPQQNVPVQQQQHHDHHHNHDQPQQLLNAANVVQEKDHIAEHMDVPIDTSKMSEQELQFHYFKMHDADNNNKLDGCELIKSLIHWHEQGNKEKTNEEMRIFPDDELTNLIDPILNVDDANKDGYIDYPEFIRAQQKATGKPQV

SEQ ID NO: 20564 - protein, 225 aa, Diabrotica virgifera
  misc_feature: Coding regions on vcDNA: vcDNA=SeqID_261; Strand=+; Position=92-769
  misc_feature: Homolog annotation: Hit_ID=NP_650916.1; Match level="QueryCoverage =95%, HitCoverage=86%, E-value=3e-54, Identity=51%"; Hit description =CG17271-PA [Drosophila melanogaster] gb|AAF55808.2| CG17271-PA [Drosophila melanogaster]
  misc_feature: Gene Ontology Annotation: Molecular function=molecular_function unknown; Cellular component=nucleus; Biological process=regulation of protein activity, epigenetic
  misc_feature: Pfam annotation: Pfam_ID=efhand; Match level="Score=20.0, E-value =0.0073, Copies=1"; Pfam description=EF hand
MYLYSFSLIVLNVLVLIISAQKVPPGVPPQRYQQPPPPQYQPQVPQQQYQQHQVPQQQYQQPPPQQQQYQQPPPQQYQQQQQYQQVPQQVPVPQQNVPVQQQQHHDHHHNHDQPQQLLNAANVVQEKDHIAEHMDVPIDTSKMSEQELQFHYFKMHDADNNNKLDGCELIKSLIHWHDGDDSAKSLSDEAISDYVDEFLTRIDPDNDGYISYVEYRKYVDTVKTQ

SEQ ID NO: 20565 - protein, 228 aa, Diabrotica virgifera
  misc_feature: Coding regions on vcDNA: vcDNA=SeqID_262; Strand=+; Position=223-909
  misc_feature: Homolog annotation: Hit_ID=AAV91019.1; Match level="QueryCoverage =94%, HitCoverage=57%, E-value=3e-29, Identity=35%"; Hit description =hemolymph proteinase 21 [Manduca sexta]
MRKAEQSVLFVFVVFFCFNVKGQDQEVDDECFTEQGSLGVCKYLTNCQSAKDNIKKGIYPTDICGYDVTQVIVCCVPPRQPTPIIREPPIITRPPPQVITPTPNRVGNQPGDKANAMCQVYSQYAYEKIESPTLSVITTFSKILDCPISTQPLIVGGTKAGRKEFPHMIQIGYGSPDTSWDCGGTLISENFILTAAHCLRGGKGDAKFGRGGLANQSDTHHPSSQKYH

SEQ ID NO: 20566 - protein, 426 aa, Diabrotica virgifera
  misc_feature: Coding regions on vcDNA: vcDNA=SeqID_263; Strand=+; Position=51-1329
  misc_feature: Homolog annotation: Hit_ID=EAA01009.3; Match level="QueryCoverage =92%, HitCoverage=76%, E-value=7e-90, Identity=40%"; Hit description =ENSANGP00000012028 [Anopheles gambiae str. PEST] ref|XP_551713.1| ENSANGP00000012028 [Anopheles gambiae st
  misc_feature: Gene Ontology Annotation: Biological process=apoptosis
  misc_feature: Pfam annotation: Pfam_ID=PDCD9; Match level="Score=179.4, E-value =7.7e-51, Copies=1"; Pfam description=Mitochondrial 28S ribosomal protein S
  misc_feature (396)..(396): Xaa can be any naturally occurring amino acid
MSVIRLSPSVCQRLLGCRYASTIIRHEEEYTSSPNYPPILDLSYIKKRERKHDSVYDEIKAVKTIEEKQIKLNMPRYYGFKSYMLLEDRCHYNNLPLTQHVTRTHLVVNNDLPQFYKELNVDEATLQKLKSEIEDVISVEIDGYQRTHDLKSEDINEAKVEDLISSSVTKQINRIILNELSASLPHLKNAKIDIDPRIESSWYCGGIDPPEYAKKSREGMKWMKDLVDEPFDRLMVYIGNPNLSLRSELPLKPIVSHAESENPELAVPEFNYDPRVVGITSEHRHIANLPGFWPDDDTKFGLMSFHKRSYMHHRQRYGDAQDDKEAIHRNGVLASFGWLQAQANFLGFNTFNDLTYPLVTQTVVTDGKHWSFYAYQLNTIVFCERFYKENQKRNIXWGTPEMQLFDSIQDGKVIGFNDEVLKTLLK

SEQ ID NO: 20567 - protein, 469 aa, Diabrotica virgifera
  misc_feature: Coding regions on vcDNA: vcDNA=SeqID_264; Strand=+; Position=1-1407
  misc_feature: Homolog annotation: Hit_ID=XP_313397.1; Match level="QueryCoverage =64%, HitCoverage=27%, E-value=1e-15, Identity=25%"; Hit description =ENSANGP00000011372 [Anopheles gambiae]
VTTAGFLQMMTGSGSQNKENANLDQLTEPLTPSPGKNSTSNMENLSDSDLQTLLQNFKDLSTEEQHNLINYLKKLELQEPDRVEKLRKFVSLDSNSKDKDDQKETENDDDEDKPNSKHGQKSPSSISNSNLIDIDSEEENEDEEKKETGSDKQDIQIERIDSDEEEYTFDDVVKSVKDKEIERTKTVLEDTLKYDSAKPNLKSAKDLISDLMSNITKKNASTSKSVDLLGLGKPPASNPPMPNVDLSKLLGINIANLASIVNNVKSMSSNDTTISNITPGSPKRSQHKLNFDLSQLTSQLTSHLTSDDTKVSLDVDNPLAFGGPNKFGATRLGPGNLDRFPLDQNRLPVGGPGMMGARVPERLGPGPGGPNMFGHGGQDRFGRGGPDRFGPGGPDQFGIGVPNQFGPGGPDRFGPGGPPDRFGPGGPDRFGPGPDRLGPGPDRLDPGPDRLGPGPDRLGRGPHQIVPAN

SEQ ID NO: 20568 - protein, 225 aa, Diabrotica virgifera
  misc_feature: Coding regions on vcDNA: vcDNA=SeqID_265; Strand=-; Position=1-675
  misc_feature: Homolog annotation: Hit_ID=EAL28870.1; Match level="QueryCoverage =97%, HitCoverage=84%, E-value=2e-25, Identity=27%"; Hit description =GA10301-PA [Drosophila pseudoobscura]
  misc_feature: Gene Ontology Annotation: Molecular function=molecular_function unknown
  misc_feature: Pfam annotation: Pfam_ID=DUF233; Match level="Score=80.1, E-value =6.1e-21, Copies=1"; Pfam description=Odorant binding protein
LFYTILAPFVEPCNRNDPKMDECLARNIKNLQPRLAKGVPELYIPQFAPLIIEKAELEPNKHIKISMRNINLYHIENFTLVDIKYDAKKMHLDLSFEWDSIGVEADATMKGILLNLNLDAGGHAEGNLTNIKASGSLDLDRVYRKGVEYLTIKKTDLKIIIGKYVAVLDGLFGGDNELSQKTNQILNEHYKLIIEEFTPVIEQIVKAVVYERHENLFKRIPLDVL

SEQ ID NO: 20569 - protein, 108 aa, Diabrotica virgifera
  misc_feature: Coding regions on vcDNA: vcDNA=SeqID_266; Strand=+; Position=506-829
  misc_feature: Homolog annotation: Hit_ID=AAH62499.1; Match level="QueryCoverage =84%, HitCoverage=27%, E-value=3e-29, Identity=68%"; Hit description =COP9 signalosome subunit 5 [Xenopus tropicalis] ref|NP_989109.1| COP9 signalosome subunit 5 [Xenopus tropi
  misc_feature: Gene Ontology Annotation: Cellular component=signalosome complex; Biological process=glia cell migration
MSKVGCSSTSSQQFEGEAPSFVAQKMWEMSNAVEVVSSVYEIYRYDKKQQQDILVAKPWEKDPHFFKDIKISALALLKMVMHARSGGTLQLMGLILCNVDGNTMFVMD

SEQ ID NO: 20570 - protein, 333 aa, Diabrotica virgifera
  misc_feature: Coding regions on vcDNA: vcDNA=SeqID_267; Strand=+; Position=119-1121
  misc_feature: Homolog annotation: Hit_ID=AAH62499.1; Match level="QueryCoverage =93%, HitCoverage=94%, E-value=1e-143, Identity=80%"; Hit description= COP9 signalosome subunit 5 [Xenopus tropicalis] ref|NP_989109.1| COP9 signalosome subunit 5 [Xenopus trop
  misc_feature: Gene Ontology Annotation: Molecular function=proteasome endopeptidase activity; Cellular component=signalosome complex; Biological process =glia cell migration
  misc_feature: Pfam annotation: Pfam_ID=Mov34; Match level="Score=165.7, E-value =9.9e-47, Copies=1"; Pfam description=Mov34/MPN/PAD-1 family
  misc_feature (247)..(247): Xaa can be any naturally occurring amino acid
  misc_feature (251)..(251): Xaa can be any naturally occurring amino acid
  misc_feature (299)..(299): Xaa can be any naturally occurring amino acid
  misc_feature (301)..(301): Xaa can be any naturally occurring amino acid
  misc_feature (310)..(311): Xaa can be any naturally occurring amino acid
MSKVGCSSTSSQQFEGEAPSSVAQKMWEMSNAVEVVSSVDEIYRYDKKQQQDILVAKPWEKDPHFFKDIKISALALLKMVMHARSGGTLEVMGLILGKVDGNTMFVMDSFALPVEGTETRVNAQAQAYEYMSSYIEAAKLVGRQENAIGWYHSHPGYGCWLSGIDVSTQMLNQNFQEPFVAIVIDPVRTISAGKVCLGAFRTYPKGYKPANEEPSEYQTIPLNKIEDFGVHCKQYYSLEVSYFKSAXDRKXLDSLWNKYWVNTLSSSSLLTNADYTTGQIFDLSEKLEQSEAELGGCGXYXYRRKTTEDXXVKATRDSCKTTIEIIHGTDGSN

SEQ ID NO: 20571 - protein, 570 aa, Diabrotica virgifera
  misc_feature: Coding regions on vcDNA: vcDNA=SeqID_268; Strand=+; Position=3-1715
VNGICEKNDNGIRIQLPQPGVISVGIVSDNKPVNFNPPEHVPEVYPTPGSINFDINQRVPEYPGTLCSGLQCILPPVPGSKHVPGNTPTSGCSGAYCISIIPDNQEKLNCQNGKCENRDKPVSNENPNQENRNIYSGSESNANAQSTKNQENINLDLNKQQPTHIDLPIEVEIPVNTEDEKENKLKEPVPSIVPVQDNKPGSSMDFLLPGNKPTQHYHPHINKPNGPDSNGGYYSCTGSSCPLPKHPGQVTPSPTVQHSTTVAYPKQPYQPNNKPNCGNKPCDFPESYPQYSQHQPNCNGKDCTNLEPNTNPICIGGACVYNNQPQIPDAYKGAGGKDRLFVPNYNQELPPIVTPVIVKDQPQDGPQTNFNAGSQANAQANSQNGFVSGSVIVEKPDGLLIPVIDVQPPSINRPGYSCSGTECGSLKPIHGGIINSGSHLGSSDVNFEGSNQGNAYPDYPERNVPGSGCSTGKCGANGGSQASYSSSSNGLLERKRTWGGLEYRKIVDKVLSGGSPGSYSGNWKLWRRKKGLAKQGPAGFPTFRERGPKKGVLFSKEIPPSPAAPGKGNL

SEQ ID NO: 20572 - protein, 210 aa, Diabrotica virgifera
  misc_feature: Coding regions on vcDNA: vcDNA=SeqID_269; Strand=+; Position=1-633
  misc_feature: Homolog annotation: Hit_ID=XP_309798.1; Match level="QueryCoverage =100%, HitCoverage=31%, E-value=1e-108, Identity=93%"; Hit description=ENSANGP00000012386 [Anopheles gambiae]
  misc_feature: Gene Ontology Annotation: Molecular function=signal recognition particle binding; Cellular component=integral to membrane; Biological process=cotranslational membrane targeting
  misc_feature: Pfam annotation: Pfam_ID=SRP54; Match level="Score=151.1, E-value =2.4e-42, Copies=1"; Pfam description=SRP54-type protein, GTPase domain
GVGKSTNLAKICFWLIENNMRVLIAACDTFRAGAVEQLRTHMRHLNALHPADRHGGREMVQLYEKGYGKDAAGIAMEAIKFARDSRIDVVLIDTAGRMQDNEPLMRALTKLIKVNEPDLVLFVGEALVGNEAVDQLVKFNQALADYSSSTNPHIIDGIVLTKFDTIDDKVGAAISMTYITGQPIVFVGTGQTYTDLKALNAKTVVHSLMK

SEQ ID NO: 20573 - protein, 182 aa, Diabrotica virgifera
  misc_feature: Coding regions on vcDNA: vcDNA=SeqID_270; Strand=+; Position=101-649
  misc_feature: Homolog annotation: Hit_ID=XP_312630.1; Match level="QueryCoverage =100%, HitCoverage=92%, E-value=6e-96, Identity=90%"; Hit description= ENSANGP00000015419 [Anopheles gambiae]
  misc_feature: Gene Ontology Annotation: Molecular function=hydrolase activity; Cellular component=cytoplasmic vesicle; Biological process=Golgi to vacuole transport
  misc_feature: Pfam annotation: Pfam_ID=Metallophos; Match level="Score=51.8, E -value=1.9e-12, Copies=1"; Pfam description=Calcineurin-like phosphoesterase
MLVLVLGDLHIPHRCSSLPAKFKKLLVPGRIQHILCTGNLCTKESYDYLKTLASDVHVVRGDFDDNLNYPEQKVVTVGQFRIGLSHGHQVVPWGDPESIALIQRQLDVDILISGHTHKFEAYEHENKFYINPGSATGAYNSLETSITPSFVLMDIQNTTVVTYVYQLVGEDVKVERIEYKKN

SEQ ID NO: 20574 - protein, 433 aa, Diabrotica virgifera
  misc_feature: Coding regions on vcDNA: vcDNA=SeqID_271; Strand=+; Position=71-1369
  misc_feature: Homolog annotation: Hit_ID=XP_319911.1; Match level="QueryCoverage =98%, HitCoverage=54%, E-value=1e-131, Identity=52%"; Hit description= ENSANGP00000021502 [Anopheles gambiae]
  misc_feature: Gene Ontology Annotation: Molecular function=molecular_function unknown; Cellular component=cellular_component unknown; Biological process=reproduction
  misc_feature: Pfam annotation: Pfam_ID=TTL; Match level="Score=435.9, E-value=4.5e -128, Copies=1"; Pfam description=Tubulin-tyrosine ligase family
  misc_feature (413)..(414): Xaa can be any naturally occurring amino acid
MRLDIIDCDDCSGSDSENETNLDDEAGNTDENSTDKSDDSSESCTSLNVIETGSGDAVNWPIRQSLFPNIPPYIRFKLHDVEAEVQIPNAKKYFKWKLSTITPLIVRKTLTNTGFVLIRKSNQWLGTWGKHMKSPMFKTLKETQKLNHFPGTFQLGRKDRLWRNFQRMMTKFGAKEFGFLPHTYILPQELKLLKQCWEYKNGNGGEMWIIKPPASARGVGIKVINKWSQLPKKSSLIVQKYISNPYLINGSKFDLRLYVLVTSFNPLIIYMYKEGLARFASAKYSSDTKDLKDRYMHLTNYSINKFSSQYTANEDANACQGHKWTISKLMEYLQGYNVDTKALWRNLQQLVIKTIIACESPVVQLCEENINSRYNCYELFGIDILLDDKLRPWLLEVNISPSLHSASPLDAHXXGPFSSSFFDLAQFHLPSRI

SEQ ID NO: 20575 - protein, 153 aa, Diabrotica virgifera
  misc_feature: Coding regions on vcDNA: vcDNA=SeqID_272; Strand=-; Position=1-457
  misc_feature: Homolog annotation: Hit_ID=CAB55498.1; Match level="QueryCoverage =96%, HitCoverage=38%, E-value=2e-64, Identity=80%"; Hit description =vacuolar ATPase subunit C [Manduca sexta] sp|Q9U5N1|VATC_MANSE Vacuolar ATP synthase subunit C (V-ATPase C
  misc_feature: Gene Ontology Annotation: Molecular function=hydrogen-exporting ATPase activity, phosphorylative mechanism; Cellular component =hydrogen-transporting ATPase V1 domain; Biological process=proton transport
  misc_feature: Pfam annotation: Pfam_ID=V-ATPase_C; Match level="Score=-44.7, E -value=1.3e-11, Copies=1"; Pfam description=V-ATPase subunit C
  misc_feature (124)..(124): Xaa can be any naturally occurring amino acid
  misc_feature (131)..(131): Xaa can be any naturally occurring amino acid
MVSFVLSTRNLADLVKKEHFILDSEYLQTLLVIVPKAQFNEWNATYEKITDMIVPRSSQLIKQDNEYGLYTVSLFKKVVEEFKLHAREKKFIVRDFIYNEEELAAGKNEITKLVTDKKKQFGPXDKWLKVXFSECFCAWIPGKELRVFVEFVL

SEQ ID NO: 20576 - protein, 385 aa, Diabrotica virgifera
  misc_feature: Coding regions on vcDNA: vcDNA=SeqID_273; Strand=-; Position=392-1549
  misc_feature: Homolog annotation: Hit_ID=XP_315870.1; Match level="QueryCoverage =100%, HitCoverage=99%, E-value=0.0, Identity=85%"; Hit description =ENSANGP00000017401 [Anopheles gambiae]
  misc_feature: Gene Ontology Annotation: Molecular function=hydrogen-transporting ATPase activity, rotational mechanism; Cellular component=plasma membrane; Biological process=proton transport
  misc_feature: Pfam annotation: Pfam_ID=V-ATPase_C; Match level="Score=787.5, E -value=6.7e-234, Copies=1"; Pfam description=V-ATPase subunit C
MTEYWLISAPGDKTCQQTWDTMNNMTSKQNNLSTNYKFQIPDLKVGTLDQLVGLSDDLGKLDGFVEQVTRKVAQYLGEVLEEQRDKWSENLQANNSDLPTYLTRFTWDIAKYPIKQSLRNIADIISKQVGQIDADLKTKSSAYNNLKGSLQNLEKKQTGSLLTRNLADLVKKEHFILDSEYLQTLLVIVPKAQFNEWNATYEKITDMIVPRSSQLIKQDNEYGLYTVSLFKKVVEEFKLHAREKKFIVRDFIYNEEELAAGKNEITKLVTDKKKQFGPLVRWLKVNFSECFCAWIHVKALRVFVESVLRYGLPVNFQAILIHPNKKQLKRLRDVLNQLYGHLDSSAALSGPNVDSVDIPGLGFGQSEYYPYVYYKLNVDMLESKI

SEQ ID NO: 20577 - protein, 292 aa, Diabrotica virgifera
  misc_feature: Coding regions on vcDNA: vcDNA=SeqID_274; Strand=+; Position=57-932
  misc_feature: Homolog annotation: Hit_ID=XP_393586.1; Match level="QueryCoverage =100%, HitCoverage=71%, E-value=1e-116, Identity=65%"; Hit description=similar to ENSANGP00000021406 [Apis mellifera]
  misc_feature: Pfam annotation: Pfam_ID=WD40; Match level="Score=102.3, E-value=1.3e- 27, Copies=4"; Pfam description=WD domain, G-beta repeat
MAAEIKPATQSNERFCTTKKPILLSKLDGCSDEINAAVIIPGEEGIISVSDDKTVRVWLKRDSGQYWPSICQYMPSGTTSIYYTVETRQLFIGQENGTVSEFTLASDFNRMMPEKEYLAHQARVTDIIFAINCEWVLSVGRDKVFSFNCTQTGRNIGTFNAEAWCTALQFDVQTKHAFVGDYSGQITMLKLDNNGASVITTLKGHSGSIRSLSWDSDRNMLFSGSFDHTVIVWDIGGQQGHAYELQGHHNKVSSLYYSTSTKQLISAGEDNVIVFWDMNQPRQETPEWVESD

SEQ ID NO: 20578 - protein, 444 aa, Diabrotica virgifera
  misc_feature: Coding regions on vcDNA: vcDNA=SeqID_275; Strand=+; Position=1-1332
  misc_feature: Homolog annotation: Hit_ID=NP_788753.1; Match level="QueryCoverage =99%, HitCoverage=51%, E-value=1e-140, Identity=50%"; Hit description= CG1646-PC, isoform C [Drosophila melanogaster] ref|NP_651634.1| CG1646-PA, isoform A [Drosophila
  misc_feature: Gene Ontology Annotation: Molecular function=RNA binding; Cellular component=snRNP U1; Biological process=mRNA splicing
  misc_feature: Pfam annotation: Pfam_ID=HAT; Match level="Score=19.8, E-value =0.0071, Copies=3"; Pfam description=HAT (Half-A-TPR) repeat
MEAAREAYDAFLSHYPYCYGYWRKYADYEKRKGNKKKCEEVFERGAKAWPLSVDLWIHYLTYVKVTRTDDEEFIRSQFERAVTSCGLEFRSDRLWDSYIKWESEAKRLQKVTAIYDRLLGTPTQGYTTHFENFQEHISNNAPNKVVDVDEFFALRKEVRQQLKHEITDTPPADNDAPPGDEDQTKVISSDEETKILRERIISIRRKLHKNTVTAVTARWNYEEAIKRPYFHVKPLERCQLKNWQDYLDYETEQGDRVRIIVLFERCLIACALYEEFWLKFVHYLENLRDHELQPKIRDVYERACTIHHLKKPNLHLQWAIFEEGVDNMSRAAEILVNLEKSVPNVLQIAYRRINLERRRGDHEKCCQLFEHYINSTKNKIIASSISIKYSRFACFMMKDVEKAQTILKTAIAKDPNNPRLYLQLVDVTLQKGDPTEKNITEILN

SEQ ID NO: 20579 - protein, 375 aa, Diabrotica virgifera
  misc_feature: Coding regions on vcDNA: vcDNA=SeqID_276; Strand=+; Position=367-1494
  misc_feature: Homolog annotation: Hit_ID=XP_394874.1; Match level="QueryCoverage =72%, HitCoverage=76%, E-value=4e-52, Identity=42%"; Hit description =similar to ENSANGP00000021678 [Apis mellifera]
MIYPNYRVVKTPSKSPTPQDSSTSTPINITFKKSSISQFEPDSLNYSTSSPSWIYFKGTPDRSSGHFSPTSSPIFQASLNKSSFRDISPVEFIGDEDALRKYLKEHKEIEKVNKLASKKQNSSNLLSSFWSHPVTQTAKDVSEYLKKCQYQLSSQFIGKTPSSPNLKGDDKSASPAQTSALEIWTRINDDSVTLTQWNENLRMWISQTILERLVTEFDRINASLNKHGLSDVKIGAVGLDRLRKTAQTALVSQFIPSLPALIPFLEVTTNQEYLEMRIRNLDKGGCMSEFKRNGGGKYNGKEWDESLPTDCAVVMHLLASYLDTQLIPLPSMPDTKAISDNRFIRVADKAPTTLTSSSFYIQEVSEKPPHNRVFV

SEQ ID NO: 20580 - protein, 246 aa, Diabrotica virgifera
  misc_feature: Coding regions on vcDNA: vcDNA=SeqID_277; Strand=+; Position=1-741
  misc_feature: Homolog annotation: Hit_ID=XP_309632.1; Match level="QueryCoverage =96%, HitCoverage=44%, E-value=2e-61, Identity=50%"; Hit description =ENSANGP00000004077 [Anopheles gambiae]
  misc_feature: Pfam annotation: Pfam_ID=RUN; Match level="Score=13.5, E-value=7e-05, Copies=1"; Pfam description=RUN domain
MKHSMKVNHWGDLRARLEMAIARVKELAEQSEFRKEQEGDYSSDSESLSVLCNVQLTTAVRKYLATCIRDLMQHGAYMPQSTSLVPLIGCFPRRNSLSSNQIHAWEIILEYYRMKNGEKYNSTPARKLSQSFNLDIAGASPSSNKQNMLCCIGSIISTHTPYKRSNDSHFKAFICAALNANKLVPWLTLIFTCNHLIKTYYQPWSYLAKTGFQDSLRSLDTLSGIKFQLPVDLAIRQFQNIKDVFT

SEQ ID NO: 20581 - protein, 485 aa, Diabrotica virgifera
  misc_feature: Coding regions on vcDNA: vcDNA=SeqID_278; Strand=+; Position=105-1562
  misc_feature: Homolog annotation: Hit_ID=NP_608540.1; Match level="QueryCoverage =96%, HitCoverage=63%, E-value=3e-27, Identity=23%"; Hit description =CG2839-PA [Drosophila melanogaster] gb|AAF51469.2| CG2839-PA [Drosophila melanogaster]
  misc_feature: Gene Ontology Annotation: Molecular function=cytoskeletal protein binding; Cellular component=cell-cell adherens junction; Biological process=intercellular junction assembly and/or maintenance
MLPLKKLICSKSVWILFICLTSTTFGFLENLSRNDISRRNVRGSRSSVESVVEEMPFRKDTRRQVNEKDRLYENLYDRRSFRTGTDRFRNRNIDIRLDRRNQNWNDERRALNDRVFLTPVPDITIPIRGVPNERRSRDVRLNREQRVRSPDNRSERLFRDDRRSRDTRENEVQRERREETFTDNRMRNIRETQPRSLNIRAERMVRETLSRENRQQDQHIRQLRTRNNRQRELRTNDDSRLQNRDQRVERNIRTNQERINERRQLQERREESQDERRQLQERREEPQVRNHREQSRERMLKSRNEYLSPSRYEQNLRNSERRIDNRERNVEIRERRQENQERIREETFRYNRDNTLEKNRQIRSLNGRQERRTAFEATMDARESRNLSTRRFRDTQERNIERRMANSYRDSNERSLERRDVRSVRSSRIRNNRSNGLDANMNEIRQNRERNINIRSEDRSELYREREERESTRKTILQRTQVYGP

SEQ ID NO: 20582 - protein, 97 aa, Diabrotica virgifera
  misc_feature: Coding regions on vcDNA: vcDNA=SeqID_279; Strand=+; Position=228-521
YTVYKMYVHVDVRFTLCFDLNCLKMSRDAWEKLNGRTIYWSPLLYLIVLGKTKENISIIIKLYYNDFPIIQLLFRFKNLCSVGIFLNHLDVAFFVDS

SEQ ID NO: 20583 - protein, 489 aa, Diabrotica virgifera
  misc_feature: Coding regions on vcDNA: vcDNA=SeqID_280; Strand=+; Position=19-1488
  misc_feature: Homolog annotation: Hit_ID=NP_523475.3; Match level="QueryCoverage =93%, HitCoverage=92%, E-value=3e-41, Identity=35%"; Hit description =CG3047-PA [Drosophila melanogaster] gb|AAF50957.4| CG3047-PA [Drosophila melanogaster]
  misc_feature: Gene Ontology Annotation: Molecular function=DNA-directed RNA polymerase II activity; Cellular component=DNA-directed RNA polymerase II, core complex; Biological process=regulation of transcription, DNA-dependent
MNFGISILFFTICVNQGFLAASQRKPSKPEKLPWSNDRLSTKEPETSSYRPWSTTESYPSRTSSRSDSSTRRIWYSTSDSWRTSGRWDGTTGRPSYSTNDPWRTTGRWDSTTGRPSYSTNDPWRTSGRWDSTTGRPSYSTNDPWRTTGRWDSTTGRPSYSTNDPWRTSGRWDSTTGRPSYSTNDPWRTTGRWDSTTGRPSYSTNDPWRTTGRWDSTTGRPSYSTNDPWRTTGRWDSTTGRPSYTTNDPWRTSTRSDSSTYRTWSTTRRPTYWPTGTTWWPTERSTRSDSSTYTPWSTTRRPTYWPTGTTWWPTERSTRSDSSTYRPWSTTRRPTYWPTGTTWWPTERSTRSDSSTYRPWSTTRRPTYWPTGTTWWPTERSTRSDSSTYRPWSTTRRPTYWPTGTTWWPTERSTRSDSSTYRPWSTTRRPTYWPTGTTWWPTDTTWQSTTNRPFTTTQSPIPPPTPRPAPSIDNYCFKCLFLEIDFRLRK

SEQ ID NO: 20584 - protein, 295 aa, Diabrotica virgifera
  misc_feature: Coding regions on vcDNA: vcDNA=SeqID_281; Strand=+; Position=121-1006
  misc_feature: Homolog annotation: Hit_ID=NP_650751.3; Match level="QueryCoverage =88%, HitCoverage=53%, E-value=9e-74, Identity=49%"; Hit description =CG7718-PA [Drosophila melanogaster] gb|AAF55593.2| CG7718-PA [Drosophila melanogaster]
  misc_feature: Gene Ontology Annotation: Molecular function=CDP-diacylglycerol -glycerol-3-phosphate 3-phosphatidyltransferase activity; Cellular component=mitochondrion; Biological process=gametogenesis
  misc_feature: Pfam annotation: Pfam_ID=PLDc; Match level="Score=28.6, E-value=1.9e -05, Copies=1"; Pfam description=Phospholipase D Active site motif
  misc_feature (258)..(258): Xaa can be any naturally occurring amino acid
  misc_feature (263)..(263): Xaa can be any naturally occurring amino acid
  misc_feature (266)..(266): Xaa can be any naturally occurring amino acid
MIRRVFGVIETTLTSEQASYPKCFFKSENASFGWLPTAAPCFPINAKNIKILTEPKEFYDTLLSNCCNAKERITLASLYLGYGTLEKKLLESIRSNGNYKNNSLNINILLDYTRGSRGVANSRTMLLPLLQENSKNLRVSLYHTPELRGVLKQYIPDRYNELLGLQHMKLYIFDNTLIISGANLSNDYFTNRQDRYVVIKDKSLSDFYCSLVNKVQDFSLNIDQHDKAGLSKNWEMLPYESSKAQFVQKASRKIKISXGFYEXHTXVLCTRTNDTWIFPLVQMGPLNVNHDAPLL

SEQ ID NO: 20585 - protein, 88 aa, Diabrotica virgifera
  misc_feature: Coding regions on vcDNA: vcDNA=SeqID_282; Strand=+; Position=147-413
  misc_feature (54)..(54): Xaa can be any naturally occurring amino acid
PGKLKRIGNNIATTFKTTNTLRYILFKPKPDNTHGKSKNCICKIHCECNNFYVXETTKPLSVRINEHETYIKNREIRQITDIQTFLGQ

SEQ ID NO: 20586 - protein, 107 aa, Diabrotica virgifera
  misc_feature: Coding regions on vcDNA: vcDNA=SeqID_283; Strand=+; Position=220-543
LNYTIELCGVTHSSLLVANFFEYLMRFWTKFRSISVFRKFAILIVLHLGIPSLHDKLLTVLEGLRQVCGIVVFGYREYVVLSKPITDSRQSKETFVSIGNLILFCFC

SEQ ID NO: 20587 - protein, 623 aa, Diabrotica virgifera
  misc_feature: Coding regions on vcDNA: vcDNA=SeqID_284; Strand=+; Position=39-1910
  misc_feature: Homolog annotation: Hit_ID=CAG31071.1; Match level="QueryCoverage =97%, HitCoverage=96%, E-value=3e-87, Identity=33%"; Hit description =hypothetical protein [Gallus gallus] ref|NP_001006396.1| similar to KIAA0007 [Gallus gallus]
  misc_feature: Gene Ontology Annotation: Molecular function=snoRNA binding; Cellular component=small nucleolar ribonucleoprotein complex; Biological process=processing of 20S pre-rRNA
  misc_feature (195)..(195): Xaa can be any naturally occurring amino acid
FSEDGKYFAHLSTDGKLKIWDTLSNTFEQEFTPDFHLTSPCTCLHFIQNDSVKYKGGSPKKKKRRDSESVVSPKIVLGTTSGVLLLYSITNAGLENSFDSDTNQAINCLSTVDHNIIYSGLEQNVVIWNLEKQKVINKWKVGNEKVTAILAIPESSQLLTASRNIKLWDLEVKEVLRTFTGHKSEVMFLYRGHEXPPFVFYFMSGSKGDRTLSCWSLNTNVSEKNAVANFLMEDIVLNVSINVEDDGTTQMAATVRSGVVHFYRHTLNGKSGKPIKPKTTIQVVSDTGQSEEEVVNPIRIVGAFHRDSETLCIGHGTDVLLTFENIVPNTSRKLHCLIRQDPQKLKSQKNLQSTKTITPVVNDSVQYLTPETSVISSTKRKNDGTLEVPMEKRLENLSLGKAEGGKVPKADNVAQLLIQGLHSKDKKILRTVLYQKNEEVVRNTVKRLPVTAFVPLLQELASYIQGKTLSSQMGSMWMKYILQMHAGILMSNPQLPDLLSATLGSIQSRLGLLTPLNRLKGRLDLLIPQVSSSFQQDSTENEQALLVYNDRDTSDSEDEELQVDAQSESGSEWEEESNPELITENNIGSDVEENGDGKEEEDDGGEEEEDSGEEENDDEPMSS

SEQ ID NO: 20588 - protein, 211 aa, Diabrotica virgifera
  misc_feature: Coding regions on vcDNA: vcDNA=SeqID_285; Strand=+; Position=240-871
  misc_feature: Homolog annotation: Hit_ID=XP_545439.1; Match level="QueryCoverage =86%, HitCoverage=57%, E-value=2e-13, Identity=28%"; Hit description =PREDICTED: similar to zinc finger protein 435 [Canis familiaris]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=24.5, E-value =0.00033, Copies=1"; Pfam description=Zinc finger, C2H2 type
  misc_feature (188)..(188): Xaa can be any naturally occurring amino acid
MEVKQERYEIEHIDLDNVLLHGFKCEVKEESNNQSTHEAYDYLDSKEQEIKCNQMEIKQEIGDEKYKSVEEYNEMDLNDSKCEIKEESISQSANDPYDYLDLKEYPIITEELEQHGNKLEGNQKTEKDYLEDNEMEILEALTEPSSHEENYTNPQFTQGSNLKVHTEEKLYNCATCLKQFTVRDSLVXHLRVHSGEKPYKCKICSKLFSKT

SEQ ID NO: 20589 - protein, 634 aa, Diabrotica virgifera
  misc_feature: Coding regions on vcDNA: vcDNA=SeqID_286; Strand=+; Position=3-1907
  misc_feature: Homolog annotation: Hit_ID=XP_310333.1; Match level="QueryCoverage =86%, HitCoverage=82%, E-value=1e-104, Identity=38%"; Hit description= ENSANGP00000015188 [Anopheles gambiae]
  misc_feature: Gene Ontology Annotation: Biological process=reproduction
  misc_feature: Pfam annotation: Pfam_ID=GMC_oxred_N; Match level="Score=300.8, E -value=2.2e-87, Copies=1"; Pfam description=GMC oxidoreductase
  misc_feature (485)..(485): Xaa can be any naturally occurring amino acid
  misc_feature (531)..(531): Xaa can be any naturally occurring amino acid
KSGAWVFLVYNLALGAADTELDNLYNEVQSVLAGVQSYQVPVDNSALFTITNDTIVEYEDYDFVIIGAGAAGAVLANRLSEIYSWRILLLEAGGNSNKFSEIPQLIANLRRTDMNWGYFSTPQKTCCQGMINKQCIYPRGKVLGGTTTINGGVYSRGPRSDYNLWAAMGNTGWSYDEVLPYFKKSEFNALTEYDEGYHGSSGYLYVNRTTPPSVVAEAFCKANLEKGLKDIDYNGRQQIGVSRMEFNIKYNIKQNSERAFLDTIKERNNLDIVLNAAVNKIVIVKDEAKLVTFVKNGTLHKVKARKEVILSAGAINSPQLLMVSGVGPKKERNCPGLPIKVDLPQVGKNLQDHPMFVNLYFRTNQTAPSTTLKEKLALYLQKQTPLTNGAGLEQLAFLNSKTILFGDPDIELMTFAPPSSVPPNPKFAFNFDESNSAVYKNYNPLTDVSILVSLLKVKSRGQVTLKSSNIVDFPLIDLNFFSDAXGEDIATMYKGIQYALSLLNTKAFKSVNATLVSTQPNCEQYKDKGDXEYWYCALRQMTSTEYHTAGTTRMGLRPTDSVVNKDCIVHNIRNLRVVDAGVMPEITQAHVNAAVYMIAEKISDVIKCKHGKLNSPKCNYKPENTFFKYLNNFK

SEQ ID NO: 20590 - protein, 509 aa, Diabrotica virgifera
  misc_feature: Coding regions on vcDNA: vcDNA=SeqID_287; Strand=+; Position=123-1652
  misc_feature: Homolog annotation: Hit_ID=AAF97938.1; Match level="QueryCoverage =96%, HitCoverage=98%, E-value=1e-117, Identity=41%"; Hit description= cytochrome P450 CYP6N3v3 [Aedes albopictus]
  misc_feature: Gene Ontology Annotation: Cellular component=membrane; Biological process=electron transport
  misc_feature: Pfam annotation: Pfam_ID=p450; Match level="Score=322.0, E-value=8.8e- 94, Copies=1"; Pfam description=Cytochrome P450
MAIITGNICYDLTGVVFAFIAIFVVYCQWAFRYWKVRGVPFVEPRIPWGSLKPQINSTISMGEEFAQMYVNAKRDGHKHIGLYAAISPIYMPVDNDLIKRVLAKDFNYFNARGIYINEKDEPIGAHLFALGGTKWKSLRSKFTPNFSSGKLKSMFHTVISCGKMLENCLSTKINGEEPVDLKQFMGSFTISVIGSCAFGIDCNSFEDDNPFKQMANRIVNRTLSDDVKFAVAINFPKLASAIRLTWIPKTIKEFFTKVVVDTVTYRENSKIDRNDFLQGLINIKNDPETRGKLNDETAITMDEIVAQSFVFFVAGYETSATTMSWVLYEMAANPDIQERVREEIEEVLNNHNGEITYESLCDLKYMGQCIDETLRKYPPIPFLTRECSQDYQIPETNIVVEKGTRVVIPTIGIHYDEEYYDNPDVFDPERFSEENRKNIIPYTYVPFGEGPRLCLGMRFGIIQVKVGIMTVLRNYRLSISKKMQMPLKLTPAFIPTPEGGLWLDMEKVC

SEQ ID NO: 20591 - protein, 333 aa, Diabrotica virgifera
  misc_feature: Coding regions on vcDNA: vcDNA=SeqID_288; Strand=+; Position=83-1081
  misc_feature: Homolog annotation: Hit_ID=XP_414736.1; Match level="QueryCoverage =100%, HitCoverage=44%, E-value=2e-69, Identity=41%"; Hit description= PREDICTED: similar to poly(A)-specific ribonuclease (deadenylation nuclease);
  misc_feature: Gene Ontology Annotation: Biological process=nucleobase, nucleoside, nucleotide and nucleic acid metabolism
  misc_feature: Pfam annotation: Pfam_ID=CAF1; Match level="Score=111.5, E-value=2e -30, Copies=1"; Pfam description=CAF1 family ribonuclease
MEVLNSNFSSLFSEIEKAINASLFVSIDCELSGLNIVRNIKAFDTPQEYYSKMRINSKDFLVLQYGISTFRYDEVDNNFKHQTYNFYTFRRPVNRNVPDIRFLCQSSSIDFLIGHGFDFNKLFKEGISYLTEEEYDNYKANIDQSYQTVLEGICSRKSEDSCDTIQVPENAVAFIDDIKSKIENFLTSDETELQLPKCNAFFRKLIYQTKEEKYSNQIYLETRQVDKDRVLFVTRLKSPEEEKQLAKKRYEENLKELDNFHGFSKLLKVLIKSGKLIIGHNLCLDFLHTIDKFLMPLPESYTEFKRVSHTLFSRVLDTKYMASSGLFKDLIHS

SEQ ID NO: 20592 - protein, 71 aa, Diabrotica virgifera
  misc_feature: Coding regions on vcDNA: vcDNA=SeqID_289; Strand=-; Position=139-354
VNYFSHFQVLQSLISTIIGTIRIESLLNGSFIAKILTLIYDSNTALSLVLIHDLTAIYRSNTLQFMTTQHT

SEQ ID NO: 20593 - protein, 548 aa, Diabrotica virgifera
  misc_feature: Coding regions on vcDNA: vcDNA=SeqID_290; Strand=+; Position=504-2147
  misc_feature: Homolog annotation: Hit_ID=XP_316832.1; Match level="QueryCoverage =96%, HitCoverage=52%, E-value=1e-125, Identity=43%"; Hit description= ENSANGP00000010269 [Anopheles gambiae]
  misc_feature: Gene Ontology Annotation: Molecular function=protein binding; Cellular component=alpha-glucosidase complex; Biological process =protein modification
  misc_feature: Pfam annotation: Pfam_ID=Glyco_hydro_31; Match level="Score=514.1, E -value=1.4e-151, Copies=1"; Pfam description=Glycosyl hydrolases family 31
KISVESTDESKAFTFKADFPEANRLYGLLDHAWSLALGDTNNGTAESGDPLRLRNSDSWGYEANSPMALYGARPVVYGHSANKTSGIFLHNAAEQWIDASSGSDGKDPSVYFIVERAAFDLFILLGPTPKEIVRQFTGLTGKAHLPQIWALGYHQCRSSYKSQDDVKDVVARLDENDFPWDAIWLDGDHTDDYKWFHWNHTTYTDPVELQQNISATGRVCVSISDPHIKVDDDYDVYAGAKGKYFTKWANGSEYVADCWPGASSWIDYLNPEAADYYSTWFSFEKFNGSTPTLAGIWNDMNEPAVFDDSTEKTMPWEVQHYGGVEHGDIHNIYGLLHVKSTHKGLMARDQNAKRPFVLTRSNFAGSQRYAAMWTGDNSATWEHFANSISECMNANMLGMVFCGADIGGFIGDPSDELLQRWYQGAVWTPFFRGHSSRESKRREPYLFSKDVQDVIRNALRLRYQHIPAIYTLFYEHTVTGDPIISPLYYQYPRVNDRDTQTMIGADIMSVAVTKPGVKSVEVYSPGGYSDTDPFQQTDFWYRGDQKQF

SEQ ID NO: 20594 - protein, 299 aa, Diabrotica virgifera
  misc_feature: Coding regions on vcDNA: vcDNA=SeqID_291; Strand=+; Position=81-980
  misc_feature: Homolog annotation: Hit_ID=XP_309189.1; Match level="QueryCoverage =90%, HitCoverage=55%, E-value=2e-77, Identity=51%"; Hit description =ENSANGP00000018571 [Anopheles gambiae]
  misc_feature: Gene Ontology Annotation: Molecular function=serine carboxypeptidase activity; Cellular component=lysosome; Biological process=biological_ process unknown
  misc_feature: Pfam annotation: Pfam_ID=Peptidase_S28; Match level="Score=22.7, E -value=4e-15, Copies=1"; Pfam description=Serine carboxypeptidase S28
MRWEIVCFVGVLAIVLAEDNYLFETKYIDVPLDHFSFAQDTKFQLRYLINDTYHEDRGPIFFYTGNEGDIKNFAKNTGFMYDIAPTFSALLVFVEHRYYGESLPFGDQSYSSIDKLGYLSSQQALADFVYVIEALQEQYAHNQKNLPVIAFGGSYGGMLSSWIRMKYPSSVLGAIASSAPIWQLGGLTSCEIFNRITTSVYASFGTDKCTNGITNVWKTIRSFTKTAEGKANLTSTWNLCSPIKTDDDINQLIDWAAELIVNMAMVNYPYPTNFLADLPAYPVREFCNRLNSHKLNWRL

SEQ ID NO: 20595 - protein, 259 aa, Diabrotica virgifera
  misc_feature: Coding regions on vcDNA: vcDNA=SeqID_292; Strand=+; Position=161-937
  misc_feature: Homolog annotation: Hit_ID=XP_309076.1; Match level="QueryCoverage =74%, HitCoverage=60%, E-value=1e-77, Identity=74%"; Hit description =ENSANGP00000019593 [Anopheles gambiae]
  misc_feature: Gene Ontology Annotation: Molecular function=phospholipid binding; Cellular component=secretory granule; Biological process=exocytosis
  misc_feature: Pfam annotation: Pfam_ID=C2; Match level="Score=115.7, E-value=1.1e -31, Copies=1"; Pfam description=C2 domain
MITQEPAPDYQQVSVVTSDTTTLVPGNDVVVRHTNWQEADHKRHQKICDEVGVSEAHSSPMLASPRNGTKSATPSPVTSVAKRNGARLNPDWHDEDLDRIGSLQNRGSLSTLGARSDSMASVYSGAGEGRYGTVAVRGQVEFGLQYNYKAGALEIQIKQCKDLAPVDTKRNRSDPYVKVYLLPDKSKSGKRKTKVKKHTLNPVFDECLKFHISLNGLESRTLWLTVWHSDMFGRNDFLREVMMTLENKVFDDPTPKWYN

SEQ ID NO: 20596 - protein, 241 aa, Diabrotica virgifera
  misc_feature: Coding regions on vcDNA: vcDNA=SeqID_293; Strand=+; Position=168-890
SYLNKEFDKNKTMTSSDPLIVSKEPKGGIYQALDEVDRVLDKLEEGENSNDWCWFCSFDRCRWCCWWCSKETDAKEENDDVHCALVSYVQEVQSKPEGRTVKNIIVSKKDLLLYKDRQESNRSSVVQSEASDVETEPEEPPNKLSAQISISEPIINTTNSEEKTEVHKDEVGVSEAHSSPMLASPRNGTKSATPSPVTSVAPRNGARLNPDWHDEDLDRIGSLQNRRSLSTLGGSLGLDGE

SEQ ID NO: 20597 - protein, 293 aa, Diabrotica virgifera
  misc_feature: Coding regions on vcDNA: vcDNA=SeqID_294; Strand=+; Position=97-974
  misc_feature: Homolog annotation: Hit_ID=XP_394424.1; Match level="QueryCoverage =100%, HitCoverage=46%, E-value=1e-107, Identity=62%"; Hit description=similar to CG30446-PA [Apis mellifera]
  misc_feature: Gene Ontology Annotation: Molecular function=aromatic-L-amino acid decarboxylase activity; Cellular component=cellular_component unknown; Biological process=dopamine biosynthesis from tyrosine
  misc_feature: Pfam annotation: Pfam_ID=Pyridoxal_deC; Match level="Score=198.9, E -value=9.9e-57, Copies=1"; Pfam description=Pyridoxal-dependent decarboxylase con
  misc_feature (262)..(262): Xaa can be any naturally occurring amino acid
  misc_feature (268)..(268): Xaa can be any naturally occurring amino acid
  misc_feature (279)..(279): Xaa can be any naturally occurring amino acid
  misc_feature (281)..(281): Xaa can be any naturally occurring amino acid
MNTEEFKVRGKEMVDYICQYTSNLDKNKATPDVEPGYLRKLLPSEAPQEPENWDSIMRDVVSKIMPGVTHWQHPRFHAYFPSGNSYPSMLGEMLSNAISCIGFSWASSPACTELEIIVLDWFGKAIGLPDDFITSAKNSKGGGAFETSASECVLVCMLAARNQAIQYLKRDSPNSIHDSEFLPKLICYASKDAHSCVEKAAKILLVKIRTLDPDENGSLRGETVRAAMEEDIAKGLFPFLVTATLGTTGSASFDNLKRLARXCKLQHXTWLHVDAAYAXSXFYLPELKYLLKG

SEQ ID NO: 20598 - protein, 82 aa, Diabrotica virgifera
  misc_feature: Coding regions on vcDNA: vcDNA=SeqID_295; Strand=-; Position=534-782
YLRDNVHLCNFNYTIVKMTHGTRRQSDVHFLGLSETIGTCIPLFISSMSPFSFPLFISNCLGIVHKRLFKKLFFKQVSTVLK

SEQ ID NO: 20599 - protein, 327 aa, Diabrotica virgifera
  misc_feature: Coding regions on vcDNA: vcDNA=SeqID_296; Strand=-; Position=2-982
  misc_feature: Homolog annotation: Hit_ID=NP_652705.1; Match level="QueryCoverage =99%, HitCoverage=4%, E-value=2e-91, Identity=34%"; Hit description =CG1915-PC, isoform C [Drosophila melanogaster] gb|AAG22226.2| CG1915- PC, isoform C [Drosophila
  misc_feature: Gene Ontology Annotation: Molecular function=structural constituent of muscle; Cellular component=cytoskeleton; Biological process =mitotic chromosome condensation
  misc_feature: Pfam annotation: Pfam_ID=fn3; Match level="Score=133.1, E-value=6.5e -37, Copies=3"; Pfam description=Fibronectin type III domain
KNLPGSIFEDRRVRRLVVHKTTIEDEYEYSCTVEKYQLKTSSKLKIGDKPSPPRGPLEISGMSDTSFTIQWQPSESDGGSEIIEYIVEMKEAKTKKVFKKLGATKGSITNFAINYLEKGHGYNYRITARNAIGVSDPYLPSETIIAGSRMTPPSPPINLKVKDLTSRSATLTWEPPENDGGTEITGYIVEKKLEYMPKWEKVFTLEAFSLEYTFENLKEKSDYLFRVFAENSVGLSPPATSEIVQMRTHATVPSPPTPPLEIRTIGPNAIVVEWGIPESDGGSPLLGYNIAIRDTKKTMWMEIGRVQKGVQKFTIRDLQEDHEYMIR

SEQ ID NO: 20600 - protein, 169 aa, Diabrotica virgifera
  misc_feature: Coding regions on vcDNA: vcDNA=SeqID_297; Strand=+; Position=102-611
GKFYCEFYFCICKRFLIKSEICTEMASTLTTIVAVLLVINGAYALECYKCNSQDKTLCKWGLTSFLQDTEQCSSVLGAVFSPKCYKITAKSKGGSEYIARGCMATGLGGGCSAMAKTLSWFSSAVSSDDPDSLQVLGCETCETDKCNSATKLTGFAFIGLVLSAMAFLM

SEQ ID NO: 20601 - protein, 453 aa, Diabrotica virgifera
  misc_feature: Coding regions on vcDNA: vcDNA=SeqID_298; Strand=+; Position=188-1549
  misc_feature: Homolog annotation: Hit_ID=EAL27165.1; Match level="QueryCoverage =97%, HitCoverage=63%, E-value=2e-68, Identity=43%"; Hit description =GA11018-PA [Drosophila pseudoobscura]
  misc_feature: Gene Ontology Annotation: Cellular component=membrane; Biological process=electron transport
  misc_feature: Pfam annotation: Pfam_ID=p450; Match level="Score=-96.8, E-value=7.9e- 07, Copies=1"; Pfam description=Cytochrome P450
MLSLILFGVALALFYYVAIKPLSYWKERGVIFQEGALWLLGNQWKFFLNRQDMFEVFEDAYNVAPNARYVGFYQFTVPSLMIRDPQLLKQITVKDFDHFVNHRTFIPQGADPLWSKNLLSLRDQRWRDMRSVLSPSFTSSKMKMMFHLMAGCSENMVKHFLTKNQEIIDVTFKDVATRFANDIIASTAFGISTNSFQKPKNEFYLMGKEITSFSSFWKNLKIMGFITIPKIFKLLKINLFDGPSREFFIRLIEDTLKMREEKNIVRPDMLNLLIEAKKGIQHKDEQNGVDDGFYTVQEHLPGKHMQDSKEITNEDITAHALIFFFGGFDSVSSTMCFAAHELATHPRLHFANDIIASTAFGISTNSFQKPKNEFYLMGKEITSFSSFWKNLKIMGFITIPKIFKLLKINLFDGPSREFFIRLIEDTLKMRGEKNIVRPDMLNLLIEAKKGIQQ

SEQ ID NO: 20602 - protein, 273 aa, Diabrotica virgifera
  misc_feature: Coding regions on vcDNA: vcDNA=SeqID_299; Strand=+; Position=375-1193
  misc_feature: Homolog annotation: Hit_ID=EAA11941.3; Match level="QueryCoverage =92%, HitCoverage=53%, E-value=1e-63, Identity=45%"; Hit description =ENSANGP00000017423 [Anopheles gambiae str. PEST] ref|XP_556509.1| ENSANGP00000017423 [Anopheles gambiae st
  misc_feature: Gene Ontology Annotation: Molecular function=transporter activity; Cellular component=mitochondrion; Biological process=transport
MLPAESNDLFEKHPPAPVIKVYKRRWVILAIFILYSCANAFQWIEYSIITNIVVKFYRVSTIAVDWTSIIYMVIYPFIVVPASYIIDTQGLRVTALIGGLGTALAAVVKVFSIRQDLFRLVLLGQAIGSTAQVFVMCLPAKIAAVWFSPSEASLACSLAVFGTQLGFALGFVLPPTLVKNSEDLSVIGSGLQQLCWVLAIYMIPVSVAIIFYFPAQPPLPPSIAQFDERKLRKSSFRDFWNKFTNSLKHYGFVLHLAAYGINVGVYAGLWHLF

SEQ ID NO: 20603 - protein, 80 aa, Diabrotica virgifera
  misc_feature: Coding regions on vcDNA: vcDNA=SeqID_300; Strand=-; Position=176-418
NVFSGIFLQVTRTFPVSQFFLELYCTISSGSIFRMFINFVYKKFYKHNIEVILDRQYIEKFKIYMQKYLHLKLIVQNNGV

SEQ ID NO: 20604 - protein, 129 aa, Diabrotica virgifera
  misc_feature: Coding regions on vcDNA: vcDNA=SeqID_301; Strand=+; Position=668-1057
VTSQRPNVLIFLQMFVAVLTTLFVVIRHMWSFHSTLLFPTYLISVLLTICTILPVLPSIFLNGFHFHRFKQYFGLVCFCRVCHYWSDDGFIKFCFSFLYLYFYFSILCHVYLLLLILLWGPGKTVFRSF

SEQ ID NO: 20605 - protein, 441 aa, Diabrotica virgifera
  misc_feature: Coding regions on vcDNA: vcDNA=SeqID_302; Strand=+; Position=2-1326
  misc_feature: Homolog annotation: Hit_ID=XP_393252.1; Match level="QueryCoverage =95%, HitCoverage=12%, E-value=1e-142, Identity=60%"; Hit description= similar to SD14970p [Apis mellifera]
  misc_feature: Gene Ontology Annotation: Molecular function=rRNA primary transcript binding; Cellular component=nucleolus; Biological process=ribosome biogenesis
  misc_feature: Pfam annotation: Pfam_ID=RRM_1; Match level="Score=152.6, E-value =8.9e-43, Copies=3"; Pfam description=RNA recognition motif. (a.k.a. RRM, R
  misc_feature (289)..(289): Xaa can be any naturally occurring amino acid
SSNFKKKKAAKQKAQAGSSHNWNALFLGHDAVAEVIADSFGTTKEAVIGPDGKGSAAVRLALGETQIVAQTRKYLEQEGVVLDAFANSPGKRSKTLILVKNLPSKTEAKEIREIFEKNGEVGRVILPPSGITAIIEFLEPSEARKAFTRLAYTKFKNMPLYLEWAPENSLKESSKYNTGKIVNTDDKKIQPEEETNTEQNNEENSNENNVEEAEEEEEEPEPDTTLFVKNLNFKTTDEGLKKHFVSCGKIHYANVATKRDPKDNNNVLSMGYGFIRFTYKAGADKALKXMQQSVLDGKSLELKRSERTFKNDVQSARKVNKATKQTGSKILVRNVPFQANKKEIQELFSTFGEIRALRLPKKMGAGTDSHRGFAFIDYTTASDAKAAFEALSQSTHLYGRRLVLEWAAQEEGVDDIRKRTASHFRPEEEGKKKSKKSVFTM

SEQ ID NO: 20606 - protein, 131 aa, Diabrotica virgifera
  misc_feature: Coding regions on vcDNA: vcDNA=SeqID_303; Strand=+; Position=49-444
  misc_feature: Homolog annotation: Hit_ID=XP_315204.1; Match level="QueryCoverage =83%, HitCoverage=92%, E-value=2e-26, Identity=57%"; Hit description =ENSANGP00000021586 [Anopheles gambiae]
  misc_feature: Pfam annotation: Pfam_ID=ATP-synt_F6; Match level="Score=154.0, E -value=3.3e-43, Copies=1"; Pfam description=Mitochondrial ATP synthase coupling fa
SAVGLSTLYLKSTRSTQYTNTVKMLFTKVLGTVRNSVKNEVCSRNIGILAPCLQKASDPIQQLFVDKIREYRQKSNSGKSLVEPTAELEKELKTELDKVAKQYGGGQGVDMTKFPSFKFQDPVIDPINLEK

SEQ ID NO: 20607 - protein, 307 aa, Diabrotica virgifera
  misc_feature: Coding regions on vcDNA: vcDNA=SeqID_304; Strand=+; Position=2-925
  misc_feature: Homolog annotation: Hit_ID=NP_609669.1; Match level="QueryCoverage =97%, HitCoverage=47%, E-value=1e-112, Identity=64%"; Hit description= CG7364-PA [Drosophila melanogaster] gb|AAF53324.1| CG7364-PA [Drosophila melanogaster]
  misc_feature: Gene Ontology Annotation: Molecular function=transporter activity; Cellular component=integral to plasma membrane; Biological process =transport
  misc_feature: Pfam annotation: Pfam_ID=EMP70; Match level="Score=140.7, E-value =3.4e-39, Copies=1"; Pfam description=Endomembrane protein 70
AEYTPCTLLCNSPGNPINWSVRESQVVVDRIQHEYFVHLLVDNLPAAIDVFNPETNELQVEHGYRLGNTVGDRSFINNHLKLRFLYHNPQPDVYRIVGFQISAKSIHMDELKFNGNTCDLTSKHKSQVVDPVSGTKLYFTYEVEWKESSVSWASRWDTYLAMTDAQIHWFSIINSIVVIFFLSGILTMIMVRTLRRDIAKYNADESYDETIEETGWKLVHGDVFRPPRNSRLFAALVGSGIQIFLMSLITIFFAMLGMLSPASRGALTTAAITFYMIHGAVAGYLSARLYKTMKGKECKRPAFLQLG

SEQ ID NO: 20608 - protein, 288 aa, Diabrotica virgifera
  misc_feature: Coding regions on vcDNA: vcDNA=SeqID_305; Strand=+; Position=47-911
  misc_feature: Homolog annotation: Hit_ID=NP_648484.1; Match level="QueryCoverage =96%, HitCoverage=87%, E-value=1e-101, Identity=63%"; Hit description= CG6084-PA, isoform A [Drosophila melanogaster] gb|AAF50039.2| CG6084 -PA, isoform A [Drosophila
  misc_feature: Gene Ontology Annotation: Molecular function=electron transporter activity; Cellular component=cytoplasm; Biological process=glucose metabolism
  misc_feature: Pfam annotation: Pfam_ID=Aldo_ket_red; Match level="Score=431.2, E -value=1.2e-126, Copies=1"; Pfam description=Aldo/keto reductase family
  misc_feature (263)..(263): Xaa can be any naturally occurring amino acid
  misc_feature (275)..(275): Xaa can be any naturally occurring amino acid
MASKVPSVKLNNGREIPAFGLGTWKSKPGEVTQAVKDAIDAGYRHIDCAYFYENEAEVGAALKDKIDSGAVKREDLFITSKLWVTFMKPELVEPTFQKTLQNLGLDYLDLYLVHWPAALKEGGALLPKRPDHETLGIFSDVDYLDTWKEVEKLAKKGLAKSIGVSNFNKRQLERILENATIKPVNNQIECHPYLNQKKLIAFCKSKGISVTAYSPLGSPDRPWAKPGDPILTEDPKIKKIAEKYKKSSAQVILRYLLQSGVIXIPKSVNKNRLRXNINIFDFDSLQMM

SEQ ID NO: 20609 - protein, 323 aa, Diabrotica virgifera
  misc_feature: Coding regions on vcDNA: vcDNA=SeqID_306; Strand=+; Position=95-1066
  misc_feature: Homolog annotation: Hit_ID=BAA92809.1; Match level="QueryCoverage =100%, HitCoverage=99%, E-value=1e-150, Identity=80%"; Hit description=Annexin IX-A [Bombyx mori]
  misc_feature: Gene Ontology Annotation: Molecular function=voltage-gated calcium channel activity; Cellular component=nuclear membrane
  misc_feature: Pfam annotation: Pfam_ID=Annexin; Match level="Score=419.1, E-value =5.4e-123, Copies=4"; Pfam description=Annexin
MSNQQYYPFKCTPTVYPADPFDPVADAATLKKAMKGFGTDEKAIIDVLARRGIVQRLEIAETFKTSYGKDLVSELKSELGGKFEDVMVALMTPLPQLYAKELHDAVAGMGTDEEAIIEILCTLSNYGIRTIAQFYEQMYGKPLEKDLKGDTSGHFKRLCVSLVQANRDENQGVNEQQALADAEALIEAGEGKWGTEESIFNTVLITRSYQQLRATFSEYERLTGKDIEQSIKKEFSGDIEKGLLGIVKCVKSKVGYFAERLHWSMSGLGTNDKTLIRIIVSRSEIDLADIKQAFLDKYGKTLESWVQGDTSGDYKRVLLAILD

SEQ ID NO: 20610 - protein, 323 aa, Diabrotica virgifera
  misc_feature: Coding regions on vcDNA: vcDNA=SeqID_307; Strand=+; Position=141-1112
  misc_feature: Homolog annotation: Hit_ID=BAA92809.1; Match level="QueryCoverage =99%, HitCoverage=99%, E-value=1e-147, Identity=79%"; Hit description= Annexin IX-A [Bombyx mori]
  misc_feature: Gene Ontology Annotation: Molecular function=voltage-gated calcium channel activity; Cellular component=nuclear membrane
  misc_feature: Pfam annotation: Pfam_ID=Annexin; Match level="Score=389.8, E-value =3.6e-114, Copies=4"; Pfam description=Annexin
MSNQQYYPFKCTPTVYPADPFDPVADAATLKKAMKGFGTDEKAIIDVLARRGIVQRLEIAETFKTSYGKDLVSELKSELGGKFEDVMVALMTPLPQLYAKELHDAVAGMGTDEEAIIEILCTLSNYGIRTIAQFYEQMYGKPLEKDLKGDTSGHFKRLCVSLVQANRDENQGVNEQQALADAEALIEAGEGKWGTEESIFNTVLITRSYQQLRATFSEYERLTGKDIEQSIKKEFSGDIEKGLLGIVKCVKSKVGYFAERLHWSMSGLGTNDKTLIRIIVSRSEIDLADIKQAFLDKYGKTLESWGQGDKSGEYKKKLFGILH

SEQ ID NO: 20611 - protein, 290 aa, Diabrotica virgifera
  misc_feature: Coding regions on vcDNA: vcDNA=SeqID_308; Strand=+; Position=13-885
  misc_feature: Homolog annotation: Hit_ID=EAL41993.1; Match level="QueryCoverage =85%, HitCoverage=98%, E-value=7e-53, Identity=42%"; Hit description =ENSANGP00000027810 [Anopheles gambiae str. PEST] ref|XP_560368.1| ENSANGP00000027810 [Anopheles gambiae st
  misc_feature: Gene Ontology Annotation: Molecular function=hydrogen ion transporter activity; Biological process=proton transport
MIKLPNFIKLTRNFNLYLNSCKLSSNTEQSLSSKLEEKSKELQKPKYSPKDVTPADMKWRTPWHQKEGQYYSVLRNFYKEDTNTSLLQKIQAPIDLSPGAIKKWWAKKKEHESKVLQSYIPERHQILGNELAAAHFIVHRGGSVKFFNEDKWIKADDDNNYSLPRHYEEEKILQAIDCTDMDLYYEGLVNIRDLAKVEWLSFNGCPHIDDWCLDRISNIFSHSLIYLDLRNCPKITFKGLAALYKLEQLKILYLDDFLRSTQYELTCLLLQEVNPDLDVRSDQITFDISK

SEQ ID NO: 20612 - protein, 107 aa, Diabrotica virgifera
  misc_feature: Coding regions on vcDNA: vcDNA=SeqID_309; Strand=-; Position=14-337
NFSYKLTIYLLLQIRLKYANEITYVLRGSYSEPSDIQLKILYSPLARLRVILPGYTPMVNTKFSIVCQKMRNNYLLKPTKFHLHISTGFRATNKLSVCKKNCNTLYL

SEQ ID NO: 20613 - protein, 158 aa, Diabrotica virgifera
  misc_feature: Coding regions on vcDNA: vcDNA=SeqID_310; Strand=+; Position=1-474
  misc_feature: Homolog annotation: Hit_ID=CAA76929.1; Match level="QueryCoverage =93%, HitCoverage=57%, E-value=4e-17, Identity=34%"; Hit description =trypsin [Phaedon cochleariae]
  misc_feature: Gene Ontology Annotation: Molecular function=trypsin activity; Cellular component=extracellular space; Biological process =proteolysis and peptidolysis
  misc_feature: Pfam annotation: Pfam_ID=Trypsin; Match level="Score=-4.1, E-value =0.00086, Copies=1"; Pfam description=Trypsin
  misc_feature (93)..(93): Xaa can be any naturally occurring amino acid
THESGCLNQHTSDLSVRAGSANLTSGGYIIDVDDFVIHPKYNKKTYNSDIALLKFAKEVEGSNVSIALVPFHDTSDVSDHKGVAMTGWGALEXGENFTEVLQMGYPSSISRSSCQMAYPTKIISLNMFCAGVYDVQNITACDGDFGGPATFTNCLQGI

SEQ ID NO: 20614 - protein, 268 aa, Diabrotica virgifera
  misc_feature: Coding regions on vcDNA: vcDNA=SeqID_311; Strand=+; Position=3-809
  misc_feature: Homolog annotation: Hit_ID=CAG08229.1; Match level="QueryCoverage =95%, HitCoverage=27%, E-value=4e-29, Identity=31%"; Hit description =unnamed protein product [Tetraodon nigroviridis]
  misc_feature: Pfam annotation: Pfam_ID=Transposase_11; Match level="Score=9.3, E -value=0.0016, Copies=1"; Pfam description=Transposase DDE domain
IKPFIPSSSVTVLDPSQQYLLTLMKMRLNLDFKYLAYQFGISQSTCSTYFNTIISIMYQRFKNSIKWPDREIIKKNMPSCFREVFHDKTTIIIDCFEVFIQKPASYLTQQQTWSNYKHHNTVKFLIGITPQGCISYISKAWGGRTSDKQIVELSGFLDKIEPQDIVIADRGFLIKEFLDVLQAKLVIPAFTKGKKQLLPLELEETRNIAQVRIHVERVIGSIKNKFNIFSEPLPISMLTHVTDGINIVDKIIFIACVLINLCPPIVPI

SEQ ID NO: 20615 - protein, 275 aa, Diabrotica virgifera
  misc_feature: Coding regions on vcDNA: vcDNA=SeqID_312; Strand=-; Position=76-903
  misc_feature: Homolog annotation: Hit_ID=EAL27550.1; Match level="QueryCoverage =96%, HitCoverage=91%, E-value=3e-59, Identity=42%"; Hit description =GA15457-PA [Drosophila pseudoobscura]
  misc_feature: Gene Ontology Annotation: Molecular function=electron transporter activity; Cellular component=cytoplasm; Biological process=glucose metabolism
  misc_feature: Pfam annotation: Pfam_ID=Aldo_ket_red; Match level="Score=324.2, E -value=2e-94, Copies=1"; Pfam description=Aldo/keto reductase family
MALFQTLPNGFKIPSIGYGTADAQENALDHALEIGFRHLDTAYVYQSEALIGKVLKKWVPNKIKREDIFITSKFQPRDELDPEDTLKKTLEDLQLDYVDLYLIHNPSDDNEKNLKIWRRLEEQVDAGRVKYIGLSNFSIEQIEYILQNGRVKPVNLQVQVHLYGQRKEFVEYCKKNNITVVAYTPLGGPGGEYGVGLDIIDNETVKQIAKKYNKLPSQIALRFLIQKNIVPIPKSVTPERIEQNFNVFDFIISDEDVKILEGLDKNVFKTFVNPP

SEQ ID NO: 20616 - protein, 145 aa, Diabrotica virgifera
  misc_feature: Coding regions on vcDNA: vcDNA=SeqID_313; Strand=+; Position=25-462
  misc_feature: Pfam annotation: Pfam_ID=PBP_GOBP; Match level="Score=16.1, E-value =0.00049, Copies=1"; Pfam description=PBP/GOBP family
VDEKMNKIFLCFAVLCCVQQGFALLTPVSLGKHINKESKSLQANCKVLTGATQDQIDQVRQGNFNQGSNIKNYAACIYLQSRLMDKNFNFDVIMMDYFMPPKQDLYVEYLKCNLQWRNADLSFVDKLWNQIQCVYQHDPANFIFI

SEQ ID NO: 20617 - protein, 318 aa, Diabrotica virgifera
  misc_feature: Coding regions on vcDNA: vcDNA=SeqID_314; Strand=+; Position=81-1033
  misc_feature: Homolog annotation: Hit_ID=XP_316101.1; Match level="QueryCoverage =83%, HitCoverage=39%, E-value=5e-82, Identity=56%"; Hit description =ENSANGP00000012559 [Anopheles gambiae]
  misc_feature: Pfam annotation: Pfam_ID=PPR; Match level="Score=68.1, E-value=2.5e -17, Copies=2"; Pfam description=PPR repeat
  misc_feature (299)..(299): Xaa can be any naturally occurring amino acid
  misc_feature (301)..(301): Xaa can be any naturally occurring amino acid
MFRTPILRCIRQLQLLENTIKTTVVHTTSFQLQTTSLYKHPEKSELTKNKPSSSDHNFLVKLKSDPDTFGTQQEEDPLVEDDVKEDKYFTEKPLRSQKLSTKQYADIIKDLIRKRKIKEAIDVVEVRMLKEDRVKPESYIYNLLLGACGRVGYTKKAFMLYNDMKKRGLKITPGSYTALFNACANSPWPLTDGLKRATHLREIMIEKGYQPNDTNYNVMIKAFGRCGDLPMAFSLVDEMRSKKIRIRDETINFLLQSCISDKEAGFRHALLVWRKLVDKHIKPSIYTFNLLLRCVRDCXMXDVETTKDVIDTICKDRK

SEQ ID NO: 20618 - protein, 294 aa, Diabrotica virgifera
  misc_feature: Coding regions on vcDNA: vcDNA=SeqID_315; Strand=+; Position=46-928
  misc_feature: Homolog annotation: Hit_ID=XP_319430.1; Match level="QueryCoverage =84%, HitCoverage=44%, E-value=9e-59, Identity=46%"; Hit description =ENSANGP00000014465 [Anopheles gambiae]
  misc_feature: Gene Ontology Annotation: Molecular function=gamma-glutamyl transferase activity; Cellular component=integral to plasma membrane; Biological process=spermatogenesis
  misc_feature: Pfam annotation: Pfam_ID=G_glu_transpept; Match level="Score=-76.2, E- value=6.4e-10, Copies=1"; Pfam description=Gamma -glutamyltranspeptidase
  misc_feature (268)..(268): Xaa can be any naturally occurring amino acid
  misc_feature (277)..(277): Xaa can be any naturally occurring amino acid
MLGVSKSFKCACLAAAVVMVAIAGIVLLVILKPKEVINHKVHRGAVVSNSPGCSDIGVDIMTKGGTVADAAIATLFCESVGSPQSLSIGAGFLMTIYNRTTGEVITLNAREVAPMKATQDMFGGNAILASIGGLAVGVPGELRGYWQLYHKHGGGVPWKDLVQPSIDLCFNGINVTTYIESALNKTRVLIKNNTLLSEIFINPLTNETYKAGELYRRPRLGKFLEKVAEEGGEALHNGSFTESFVKDIQDNGGIITVEDMHNYSPRWXVQQSIRSLXNGRTMHTHSLPKSGTNI

SEQ ID NO: 20619 - protein, 102 aa, Diabrotica virgifera
  misc_feature: Coding regions on vcDNA: vcDNA=SeqID_316; Strand=+; Position=323-631
KAAVTSDYYARSVIVTWPRLRVVEPRKKKKRNDQMMRICANVKDIFKDHYSREVSRFRRYSSSFMDSPMTFRQKLWQYFGRGDYECEGNKLLKVWQYCQTFY

SEQ ID NO: 20620 - protein, 625 aa, Diabrotica virgifera
  misc_feature: Coding regions on vcDNA: vcDNA=SeqID_317; Strand=+; Position=1-1878
  misc_feature: Homolog annotation: Hit_ID=XP_321554.1; Match level="QueryCoverage =99%, HitCoverage=54%, E-value=0.0, Identity=62%"; Hit description =ENSANGP00000018144 [Anopheles gambiae] gb|EAA00907.1| ENSANGP00000018144 [Anopheles gambiae
  misc_feature: Gene Ontology Annotation: Molecular function=SH2-domain binding; Cellular component=nucleus; Biological process=chromosome segregation
  misc_feature: Pfam annotation: Pfam_ID=TPR_2; Match level="Score=68.8, E-value=1.5e- 17, Copies=5"; Pfam description=Tetratricopeptide repeat
PIYVDCYLRLGCMARDKGHVYDASDWFKEAFRIDTEHPDAWSLLGNLHLAKQEWGPGQKKYERILKNPSTSQDAYSLIALGNVWLQTVHQPTKDKDRIKRHQDRALMLYKQVLKIDPKNIFAANGVGAVLAHKNAVNEARDIFAQVREATADFSDVWLNIAHIYVEQKQFVSAIQMYENCLRKFYKYNNVEVLQYLARAYFKAGKFKEAKMVLLKARRVAPQDTILLYNIALVLQRLATVILKDEKSTLSTVLQAVHELGLSLKYFNYLVELADKQRYDVAVAELEARQCKDLLSQAQYHVARARRVDEEERLIRRKQEEERVAFKMRQIEEQKKFAEFQRLNKEQLVQKRQEYKEKTKNAIIFQDMPSEKKAAKGKGRSKGDIMSSSESGGENEGPSRDKREKKEKKERGRKRQKNDGEKKSKGKRGRKRKDDDDSDGSDKPRKKHSKKKEPKAKKDEGLSSKQKSRIVSKATISSSDDDSDGGKLRMASGDESDQGYSGKRKRKISSGSDSSRGRSKSRSRSRSGSRSKSRSKSRSKSKSRSRSRSKSGSRSRSRSKSGSRSKSRSRSRSKSGSRSRSGSRARSRSKSGSRERSRSKSGSRSKSRSRSRSKSGSRSRSASKSP

SEQ ID NO: 20621 - protein, 230 aa, Diabrotica virgifera
  misc_feature: Coding regions on vcDNA: vcDNA=SeqID_318; Strand=+; Position=182-869
  misc_feature: Homolog annotation: Hit_ID=XP_319323.1; Match level="QueryCoverage =100%, HitCoverage=20%, E-value=1e-92, Identity=74%"; Hit description= ENSANGP00000012364 [Anopheles gambiae]
  misc_feature: Gene Ontology Annotation: Molecular function=ATP citrate synthase activity; Cellular component=citrate lyase complex; Biological process=ATP catabolism
  misc_feature (215)..(215): Xaa can be any naturally occurring amino acid
KMSAKAIREATGKHLINKYLGGNTAAVQCRFASVEADTKFSELVSNNPWLKTEKLVVKPDQLIKRRGKLGLIAVNKDLNTVVDWVNERMNQNQKVGNATGKLRNFIIEPFVPHKQEEEAYVCIYSHRHADTILFYHEGGVDIGDVDSKALKLDVPVGQTVDAGTISKVLLGEVPAAKKQMVADFIANLYKLYVDLYFTYLEINPLVVTDKEIYIXLDLAAKLDATADFIC

SEQ ID NO: 20622 - protein, 272 aa, Diabrotica virgifera
  misc_feature: Coding regions on vcDNA: vcDNA=SeqID_319; Strand=+; Position=105-920
  misc_feature: Homolog annotation: Hit_ID=AAG17127.1; Match level="QueryCoverage =99%, HitCoverage=83%, E-value=1e-109, Identity=70%"; Hit description= cathepsin L-like cysteine proteinase CAL1 [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=163.5, E -value=4.7e-46, Copies=1"; Pfam description=Papain family cysteine protease
MKILIAFAAIILSVSALSLKQHWENFKVKHGKVYKNPIEERVRFSVFQSNLKLINEHNAKYEQGLESYTMGVNQFADMTPEEFKAKLILQTKNMPNIEKSLHVPNLNDEVPDAIDWRQKGAVLEVKDQGKCGSCWAFSATGAVEGQNYIVNGQSVPLSEQELLDCSGGYGDGNCHDGGLMTNAFKYIQDLGIESESDYPYKAVRQYCTRSASKTVVQIQGYKELEANEEAFKQAVGAIGPISAAIFADPIQFYSCGIYDNKKCKAERYLLDH

SEQ ID NO: 20623 - protein, 350 aa, Diabrotica virgifera
  misc_feature: Coding regions on vcDNA: vcDNA=SeqID_320; Strand=+; Position=2-1054
  misc_feature: Homolog annotation: Hit_ID=XP_393153.1; Match level="QueryCoverage =100%, HitCoverage=25%, E-value=1e-129, Identity=64%"; Hit description=similar to DCAPL3 [Apis mellifera]
  misc_feature: Gene Ontology Annotation: Molecular function=structural constituent of cytoskeleton; Cellular component=actin cytoskeleton; Biological process=cell adhesion
  misc_feature: Pfam annotation: Pfam_ID=SH3_1; Match level="Score=210.8, E-value =2.7e-60, Copies=3"; Pfam description=SH3 domain
EDELAHRQAQSMKKIYQEERRKKYLQVSKSLQELQDMNSRRHTDNFIPSQKSPISLNRYDDFDDLAPSVKPRPRTPEPRICARALYNFVGQSARELTFRKGDIIYLRRQIDKNWYEGELNAMVGLFPANYVEIIPFEGLKSKSTIRKAHEGQARAKYNFVAQTHLELSLAKGELVVITRKVDENWYEGKIGGRKGIFPANYVEVLIDPQTPPTSNTKPVASPAAHSLLLNGSAGGKESMGTHSYTPNISSSQLGPSYHAKPVHVLNNGSIGSSHTSRNAALNQALHIETQNEPTPYRAMYKYKPQNEDELELLEGDTVYVLEKCDDGWYVGSSERTGAFGTFPGNYVEKI

SEQ ID NO: 20624 - protein, 387 aa, Diabrotica virgifera
  misc_feature: Coding regions on vcDNA: vcDNA=SeqID_321; Strand=+; Position=102-1265
  misc_feature: Homolog annotation: Hit_ID=XP_307994.1; Match level="QueryCoverage =94%, HitCoverage=88%, E-value=1e-157, Identity=72%"; Hit description= ENSANGP00000013512 [Anopheles gambiae]
  misc_feature: Gene Ontology Annotation: Molecular function=isocitrate dehydrogenase (NAD+) activity; Cellular component=mitochondrion; Biological process= hermaphrodite genital morphogenesis
  misc_feature: Pfam annotation: Pfam_ID=Iso_dh; Match level="Score=278.1, E-value =1.4e-80, Copies=1"; Pfam description=Isocitrate/isopropylmalate dehydrogen
MASRVMKKNTFNLGQRIFRAQSTMSAFELQHKTPLIKKQTSIPIALYGGRHAVSMLPGGGIGPELMAYVREVFKYAAAPVDFEVIDIDPKSESNAELEYALTSIKRNGVAIKGNIETKSESAEVISRNVAIRNELDLFVNVLHVKSYPGVPARQKDIDIVIIRQNTEGEYAMLEHESVDGVVESMKVVTESNSDRVARFAFEWAKNNGRKKITTIHKANIMKLSDGLFLETSKRIAKEYPEIEHNEMIIDNCCMQLVSKPHQFDVMIMTNLYGSIVSNVVCGLVGGAGLLSGKNYGDHYAIFEPGTRNTGTAIAGKNIANPIAMLSASVDMLKHLGHQQHANLIERAMFKTISEDKIHTPDLGGTAKSTDVVQRIIDHILQSDIRPW

SEQ ID NO: 20625 - protein, 379 aa, Diabrotica virgifera
  misc_feature: Coding regions on vcDNA: vcDNA=SeqID_322; Strand=+; Position=1-1139
  misc_feature: Homolog annotation: Hit_ID=BAA74713.1; Match level="QueryCoverage =94%, HitCoverage=26%, E-value=5e-82, Identity=43%"; Hit description =copia-like retrotransposable element [Bombyx mori]
  misc_feature: Pfam annotation: Pfam_ID=RVT_2; Match level="Score=7.2, E-value=1.6e -18, Copies=1"; Pfam description=Reverse transcriptase (RNA-dependent
  misc_feature (85)..(85): Xaa can be any naturally occurring amino acid
GYKRQSKVLKLQKALYGLKESPKCWNQRFNKWAIKIGFKSAESDCCVYTKKNVCMCIWVDDILLCGEDSDSIQKIIESLKSEFNXKNLGCVNNFLGIDFEYSVNKNDVKMYISQKPLINKIIEKFNMTNCNVIKTPMETGFQVDKTNANNQISVNVPYRQLIGSLMYIALGSRPDIMFSISYLSQFLDCPDDILWKAAKRIIRYLKNTINFCLIYSKNIKRKPLIFAYSDSDWAANVNDRKSMSGGIVYFLDNPVSWYSRKQSTVSLSSTEAEYISSTVTCCELLFTKNLAEELLNEKITGSILYIDNQGAICIATNSFKGKRSKHIDTKYHFIRNLIENNVITLQYINTKSNCADIFTKAPSNEIFSRLRTLIKIQEC

SEQ ID NO: 20626 - protein, 283 aa, Diabrotica virgifera
  misc_feature: Coding regions on vcDNA: vcDNA=SeqID_323; Strand=+; Position=131-978
  misc_feature: Homolog annotation: Hit_ID=AAH87051.1; Match level="QueryCoverage =82%, HitCoverage=43%, E-value=1e-19, Identity=27%"; Hit description =Unknown (protein for MGC:94007) [Rattus norvegicus]
  misc_feature: Pfam annotation: Pfam_ID=MMR_HSR1; Match level="Score=-23.8, E-value =0.089, Copies=1"; Pfam description=GTPase of unknown function
  misc_feature (259)..(259): Xaa can be any naturally occurring amino acid
MSDYGPRKKLDSKKKNFNIVKETITGTDGRSFSGSKTEGSLKLGSSNDTPKKQPTILLKAREPNTEDVSASPKRNQKDDHLHTHTTVASSKDEANTAPTLKIMSKAMKLIDEGVICTESLQDYFNENNEFLIVGVVGAQGVGKSTIMNLLSYSKITEDLKKEIFKTENNSISKECDIKILTEHFEKVDLKQDEKLRKEIFKIETSEDIERGFNRTQGIDIYVTPNRLILLDCQPISSVSVLEELIKSETKRTNLVSEFXTPRNSGEIQGLQLTTFLMSVCHVL

SEQ ID NO: 20627 - protein, 238 aa, Diabrotica virgifera
  misc_feature: Coding regions on vcDNA: vcDNA=SeqID_324; Strand=+; Position=269-982
  misc_feature: Homolog annotation: Hit_ID=EAL30167.1; Match level="QueryCoverage =95%, HitCoverage=52%, E-value=1e-60, Identity=51%"; Hit description =GA20395-PA [Drosophila pseudoobscura]
  misc_feature: Gene Ontology Annotation: Molecular function=transporter activity; Cellular component=integral to membrane; Biological process=transport
  misc_feature: Pfam annotation: Pfam_ID=Ammonium_transp; Match level="Score=-182.9, E-value=0.00094, Copies=1"; Pfam description=Ammonium Transporter Family
MSTKEIVLPLVIVQIVLLILFCVFGRYAPPGGDEKYPLFQDVHVMIFIGFGFLMTFLKRYGYSSVGFTLLLGSFIIQWAILCQGFFELNADYKIEIGIESIYRADIAAASVLISVGVVLGRTTVLHLLIMGLIEIVVFSANSYLGTKVLQVADAGGSIFVHAFGAYFGLAVSYVLNRKKKNKEGNSETAASLAEANYTSDLFAMIGTVFLWIYWASFNAIELEGSQKSTAIVNTYLCT

SEQ ID NO: 20628 - protein, 193 aa, Diabrotica virgifera
  misc_feature: Coding regions on vcDNA: vcDNA=SeqID_325; Strand=+; Position=3-584
  misc_feature: Homolog annotation: Hit_ID=XP_311261.1; Match level="QueryCoverage =79%, HitCoverage=35%, E-value=6e-33, Identity=49%"; Hit description =ENSANGP00000001598 [Anopheles gambiae]
  misc_feature: Gene Ontology Annotation: Cellular component=cytoplasmic dynein complex
ILYENMHSCKPDDYYRDVIVQPVTRKTINRETEVIAEDEQAFLTRQQQISFGGGPPTVRLGESPVRPPLGGIQGSPRKLDGSKVVSSPGGEGVLANFFNSLLYKKTGSPGGGMAKASGSESLPDKATMRTDAAAELDRLSRGAGKKSLGPASTPGSLGSSGSTEEEGNKKSAEGGNGNGEPGPGGVDFNATDC

SEQ ID NO: 20629 - protein, 160 aa, Diabrotica virgifera
  misc_feature: Coding regions on vcDNA: vcDNA=SeqID_326; Strand=+; Position=1-483
  misc_feature: Homolog annotation: Hit_ID=XP_393332.1; Match level="QueryCoverage =98%, HitCoverage=26%, E-value=2e-38, Identity=45%"; Hit description =similar to GH03617p [Apis mellifera]
  misc_feature: Pfam annotation: Pfam_ID=zf-RanBP; Match level="Score=20.4, E-value =0.0025, Copies=1"; Pfam description=Zn-finger in Ran binding protein and
PVSPQRTFNIDPNKQPFPVENRLVEGHIQDFNALSTYLSQFAFNEFFTAINDFHLLLYISTMEMLPMREFIEPLLKALRNKDREAAEEWSRSEHWATLEQLIAASSPPPSRPGSVASGSITSSPGASSGPKWTCPFCTFLNNADVQNCEMCNLPRSSRPQ

SEQ ID NO: 20630 - protein, 384 aa, Diabrotica virgifera
  misc_feature: Coding regions on vcDNA: vcDNA=SeqID_327; Strand=+; Position=352-1506
  misc_feature: Homolog annotation: Hit_ID=XP_313338.1; Match level="QueryCoverage =88%, HitCoverage=84%, E-value=1e-122, Identity=61%"; Hit description= ENSANGP00000011358 [Anopheles gambiae]
  misc_feature: Gene Ontology Annotation: Molecular function=oxidoreductase activity, acting on the CH-OH group of donors, NAD or NADP as acceptor; Cellular component=cellular_component unknown; Biological process =biological_process unknown
  misc_feature: Pfam annotation: Pfam_ID=ADH_zinc_N; Match level="Score=324.3, E -value=1.8e-94, Copies=1"; Pfam description=Zinc-binding dehydrogenase
MASTKDNLSAVLYGINDLRLEQRPIPVPKDNQVLLQMEVVGICGSDVHYLVSGRCGPFVVKDPMVIGHEASGTVVQVGKNVKNLKPGDRVAIEPGVPCRTCHHCKTGAYHLCPDIFFCATPPDDGNLSRYYVHDADFCWKLPDNMDLEEGALMEPLSVGVHACKRAEIKVGDVCLITGAGPIGLVTLLSAKAMGASKVVITDILDVKLEMAKQLGADYTIKIEKGMSEEDIVKRVIQLLGQEPNKSMDCTGVEQCVRVCVSATGVNGCVVLVGLGKIEMTLPLTNALIKEVDVRGTFRYVNDYPTSIELVRSGRVNVKPLVTHHYKLKNSVKAFHPAKTQKGNPGQNPDPPPTHWYEHPLIIFPPLPLFFFFKIFFGEKKMFFL

SEQ ID NO: 20631 - protein, 356 aa, Diabrotica virgifera
  misc_feature: Coding regions on vcDNA: vcDNA=SeqID_328; Strand=+; Position=92-1162
  misc_feature: Homolog annotation: Hit_ID=NP_611468.1; Match level="QueryCoverage =98%, HitCoverage=94%, E-value=1e-156, Identity=76%"; Hit description= CG9090-PA [Drosophila melanogaster] gb|AAF57486.1| CG9090-PA [Drosophila melanogaster]
  misc_feature: Gene Ontology Annotation: Molecular function=phosphate carrier activity; Cellular component=integral to plasma membrane; Biological process=transport
  misc_feature: Pfam annotation: Pfam_ID=Mito_carr; Match level="Score=225.2, E-value= 1.2e-64, Copies=3"; Pfam description=Mitochondrial carrier protein
MFSAFFNKASCQALPENQTLPQPVDDSPRALVKSLVAGRQIAAAAAAEGDSCEFGSAHYFALCGLGGILSCGITHTAVVPLDLVKCRIQVDPAKYKSVFNGFKVTLAEDGTRGLAKGWAPTFFGYSAQGLCKFGLYEVFKVMYGDMIGEENAYLYRTWLYLSASATAEFFADIALSPMEAAKVKIQTTPGFANTLREAWPRIYREEGLNGFYKSLVPLWMRQIPYTMMKFACFERTVELLYKYVVPKPRADCTKGEQLIVTFAAGYIAGVFCAIVSHPADTVVSKLNQEKGSTALEAAKKLGMAGLWKGLTPRIVMIGTLTALQWFIYDAFKVAMRMPRPPPPEMPESLKKKLEGK

SEQ ID NO: 20632 - protein, 189 aa, Diabrotica virgifera
  misc_feature: Coding regions on vcDNA: vcDNA=SeqID_329; Strand=-; Position=2-568
  misc_feature: Homolog annotation: Hit_ID=AAT40500.1; Match level="QueryCoverage =69%, HitCoverage=61%, E-value=3e-10, Identity=29%"; Hit description =putative reverse transcriptase [Solanum demissum]
  misc_feature (118)..(118): Xaa can be any naturally occurring amino acid
MLLAQEKHFLVYVQLLIQRCRDMNKDVNIKILISNINMKMNTEKTKTMIISNTRKTHAIELDGKQLEQVEYFKYLGVIIESNGKQDMEINERMERTGSLFNTMKTTFFGKKEIPEKVXTAVVKSVVRPTIMYSSQTWTFDGETKIESMLWEMRFLRKIANRKRTDKIRNETIRQNLKLEPINEKIVEGQ

SEQ ID NO: 20633 - protein, 91 aa, Diabrotica virgifera
  misc_feature: Coding regions on vcDNA: vcDNA=SeqID_330; Strand=-; Position=426-701
FLFSNIIVRTLNCSSLNLITSDKHLFFTLMRQLIFSNIQIVITLTIGTYQWCYIGLFIDCHLFRASVMCHIILIYPRHPSLVFIMVYTNIV

SEQ ID NO: 20634 - protein, 274 aa, Diabrotica virgifera
  misc_feature: Coding regions on vcDNA: vcDNA=SeqID_331; Strand=+; Position=88-909
  misc_feature: Homolog annotation: Hit_ID=XP_394728.1; Match level="QueryCoverage =96%, HitCoverage=89%, E-value=1e-97, Identity=62%"; Hit description =similar to ENSANGP00000014923 [Apis mellifera]
  misc_feature: Pfam annotation: Pfam_ID=Thioredoxin; Match level="Score=-28.8, E -value=0.0089, Copies=1"; Pfam description=Thioredoxin
  misc_feature (230)..(230): Xaa can be any naturally occurring amino acid
MKKIVICTVLFYLFSIAQSNLEVVQDEELMNLIRTEKHVIVLFSRKYCESCDNYENELTGLREDIVETLNAWVVKVEDSQLTRLYSPDKEPVLVFFRHGIPLLYDGPLNDELILHTFTTNKEPISKELTDNTFEHLTQAATGATTGDWFVMFYTSECVECTRLQARWEAVGAHIRSRINIARINKGGDGAITGRRFEVTNVPSFILFRQGKLYRYHLQKYDVQSLVDFAXSWHKNVTPEKVPVPKSPFDDFVAMVVEYMRENPWVWTWRWNFLF

SEQ ID NO: 20635 - protein, 265 aa, Diabrotica virgifera
  misc_feature: Coding regions on vcDNA: vcDNA=SeqID_332; Strand=+; Position=118-915
ILKKLMMKSVAFLLVLVIVCTGCNCEISSSASGNVSVSASASASASVDISAVLKAFLGFQSSIVDSFKGVVSICFDFWKSWFQNVDFCIGSLLNIDLFKPVFSILADFRELIGSISITITEIANFFLNAFDELKHAITQVIIPSYPMTELKNIGDLYFVIVEIFKAFITTSISIWETFWEKLPPPPNVPEIIVNYYKALFQIFFKASSDNFINFLSTVTDAYSLVIHFISRIDDILVQLLSKLPFPVLSNIRNAIQFVFWDLRAN

SEQ ID NO: 20636 - protein, 104 aa, Diabrotica virgifera
  misc_feature: Coding regions on vcDNA: vcDNA=SeqID_333; Strand=+; Position=16-330
  misc_feature: Homolog annotation: Hit_ID=NP_609179.2; Match level="QueryCoverage =100%, HitCoverage=100%, E-value=2e-52, Identity=92%"; Hit description=CG7424-PA [Drosophila melanogaster] gb|EAL33655.1| GA20340-PA [Drosophila
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L44; Match level="Score=142.7, E -value=8.7e-40, Copies=1"; Pfam description=Ribosomal protein L44
MVNVPKQRRTFCKKCKVHKPHKVTQYKKSKERHASQGRRRYDRKQQGFGGQTKPIFRKKAKTTKKIVLRMECSDCKFRKQIPLKRCKHFELGGDKKRKGQMIQF

SEQ ID NO: 20637 - protein, 138 aa, Diabrotica virgifera
  misc_feature: Coding regions on vcDNA: vcDNA=SeqID_334; Strand=+; Position=345-762
  misc_feature (93)..(93): Xaa can be any naturally occurring amino acid
LSKTQENFSIYCHIFCTFYTYYFFYVLFIGTSVYSKVYLNLVLLLIFNYFLLILIFPSCFHIFITNFVQLPKILLFPSNFLFGWYILLYLYSXTRTIFKFFSFIKVFYSYSSSLRIQNINLNHSSSSSCVGSQKNFCS

SEQ ID NO: 20638 - protein, 346 aa, Diabrotica virgifera
  misc_feature: Coding regions on vcDNA: vcDNA=SeqID_335; Strand=+; Position=401-1441
  misc_feature: Homolog annotation: Hit_ID=XP_320715.1; Match level="QueryCoverage =95%, HitCoverage=80%, E-value=1e-135, Identity=74%"; Hit description= ENSANGP00000020121 [Anopheles gambiae]
  misc_feature: Gene Ontology Annotation: Molecular function=transaldolase activity; Cellular component=cytoplasm; Biological process=carbohydrate metabolism
  misc_feature: Pfam annotation: Pfam_ID=Transaldolase; Match level="Score=548.0, E -value=8.1e-162, Copies=1"; Pfam description=Transaldolase
MSEVGLHAGVITEPHSKKAKKMSNTLEQLKAVTTVVADTGDFEAMKAFKPTDATTNPSLILAAAALPQYKPIIDKAIQYGNKLGGDMSQKLDNTMDMLCVLFGVEILKIVPGRVSTEVDARLSFNKEASVAKARKIINLYEEQGISKDRILIKLASTWEGIQAARELEKKHGIHCNLTLLFNFAQAVACAEAGVTLISPFVGRILDWYVANTDKKSYTGDEDPGVVSVTKIYNYYKKFGYKTVVMGASFRNVGEIKALAGCDLLTISPKLLGELEASHDSLPVKLSVESALKTDLEKIEMDESTFRWMLNEDQMATDKLSDGIRKFAADSIKLEGTLKPLLCAAKK

SEQ ID NO: 20639 - protein, 257 aa, Diabrotica virgifera
  misc_feature: Coding regions on vcDNA: vcDNA=SeqID_336; Strand=-; Position=108-880
  misc_feature: Homolog annotation: Hit_ID=NP_730023.1; Match level="QueryCoverage =87%, HitCoverage=35%, E-value=8e-71, Identity=58%"; Hit description =CG6854-PC, isoform C [Drosophila melanogaster] gb|AAF49665.1| CG6854- PC, isoform C [Drosophila
  misc_feature: Gene Ontology Annotation: Molecular function=CTP synthase activity; Cellular component=cytosol; Biological process=pyrimidine base metabolism
  misc_feature: Pfam annotation: Pfam_ID=GATase; Match level="Score=89.2, E-value =1.1e-23, Copies=1"; Pfam description=Glutamine amidotransferase class-I
  misc_feature (24)..(24): Xaa can be any naturally occurring amino acid
  misc_feature (26)..(26): Xaa can be any naturally occurring amino acid
  misc_feature (50)..(50): Xaa can be any naturally occurring amino acid
  misc_feature (74)..(74): Xaa can be any naturally occurring amino acid
  misc_feature (82)..(82): Xaa can be any naturally occurring amino acid
  misc_feature (84)..(84): Xaa can be any naturally occurring amino acid
TILLFYHNACINLCVCDGVVVPEXLXKRGVKGKMKACKWCRLNDKTFFLXICLGFQAAVIEYARNVLNLPGANXTEVNENHXHXGVVIDMPEHNTGGKGGTMRLGKRTTIFNRPTSLVKTLYENRDKIDERHRHRYEVNPEYIEAFEESGMHFVGVDVDKKRMEILELDKHPYYVAVQYHPEYLSRPMRPSPPFLGLILAAKDRLKAYISRGCKFSPREPQSDYYDSDEDLNELTVKQLTVNDVDDNSSAYSSSSLS

SEQ ID NO: 20640 - protein, 999 aa, Diabrotica virgifera
  misc_feature: Coding regions on vcDNA: vcDNA=SeqID_337; Strand=+; Position=2-3001
  misc_feature: Homolog annotation: Hit_ID=XP_392490.1; Match level="QueryCoverage =97%, HitCoverage=30%, E-value=1e-127, Identity=28%"; Hit description= similar to apolipophorin precursor protein [Apis mellifera]
  misc_feature: Gene Ontology Annotation: Molecular function=microtubule binding; Cellular component=extracellular space; Biological process =biological_process unknown
  misc_feature: Pfam annotation: Pfam_ID=VWD; Match level="Score=49.7, E-value=8.2e -12, Copies=1"; Pfam description=von Willebrand factor type D domain
SREYTRARPICVPLGHKNTPKQKLQINSGFIPGQVADVRADYVTGGGTLNLFHATLKLDEANFLKPDYNVNAKGIEKVFTQGKEGVSRFVNGLEKIEDEIEKDIRKEASQLSELAKKAAPNLQAVRQYYSTELQRIKNEIVQDKSLQEFGELIKTIFFSVSELVETIFVRVFEVLEAVTHAVQSVVVAFVESFEKHIVPALKDLVEKLSGIAGEILNTLVEITSSYLATVSEIIEKYQPEIKQLTATFGELGQDVARFIQKSYEQVRRIFINLYRRLVEELRALPIFEELRAQWDDFVKNGLPNADGIVGALKEVAATIKDLVPGDLFVSKEVYEFVDILTDYLEKKIKQQPVDDIAVLNRLFTVSANLVQKILTLITSSTADIQQPQVSISLDFFKKLPKLVAVKLSPINYILLEDPSKEILDLGLSLVTKPKEWLAPFQLFGMILQAQHVYTFDGKYLNFQGTCKYLLARDAVNGNFTVIGNSANGRLNTISLSDKEDIITVNEHGQVILNGAHAEFPVRKAELAAYRSYENIHLKSTAGVHIVCTPTLQACGVYVSGFYHGQVKGLLGKGNNEPFDDLTVANGKIVTSDVEFVNSYKIGNCQPAVVPPSAPSNPACEKLFGWESPLRLCYSFVDTEIYKRACNYGFANNVKDTEISAASAYVGRCHEHNIPVSVPSRLAQCLNGPEPHNVGDQFSVKVPKNAADIVVLVDTIKSNEPVYNELVKPLIQELTKGLAAKGLTDVETHLITYGGENQWPSHVTVGGKLVFKGKAPEIKFSENPQEPPVVGELSKSVEALRSILRDIKLALGQDLQAKTYTEGYEYPFRAHAVKIILAVTSKPCEVGKLYPKLRTLLFKNNQISLQLITPFEGLQVKDVKKTKDVIGFNDEHVFTFSQSKKKPEGTAELYKELQYDDYCVDFTVKNRGNVFVTDNFLDAKPDGKKQFLHTAAHNIIEEAVNLEQGLDCECRPSSAYGGKNICRESYSKEKSAPKRLSNKA

SEQ ID NO: 20641 - protein, 84 aa, Diabrotica virgifera
  misc_feature: Coding regions on vcDNA: vcDNA=SeqID_338; Strand=-; Position=961-1215
QIMSNWMSETRLRLRIKASPNSRVQIPMQVFIFLLFYAFYDCKYIYYIFFSENAYLKFLPTIIIVQKSFFLCGIFNGFVCVLFF

SEQ ID NO: 20642 - protein, 134 aa, Diabrotica virgifera
  misc_feature: Coding regions on vcDNA: vcDNA=SeqID_339; Strand=+; Position=8-412
  misc_feature: Pfam annotation: Pfam_ID=OS-D; Match level="Score=-11.0, E-value=8.1e- 06, Copies=1"; Pfam description=Insect pheromone-binding family, A10/
MNRYCLSVFLVAFTVVGVVLSAPEKSFEEYLEILRKVNVDDVFKNDRLVKSYVDCFTGSKTCTVEGAALKAIWNKILDIDGFEEDKRKVKKAIKHLYVDHRSWYDEVQDKLPKDEEFRNKYKKYFDAILKDDTL

SEQ ID NO: 20643 - protein, 492 aa, Diabrotica virgifera
  misc_feature: Coding regions on vcDNA: vcDNA=SeqID_340; Strand=+; Position=74-1552
  misc_feature: Homolog annotation: Hit_ID=S49313; Match level="QueryCoverage=79%, HitCoverage=39%, E-value=1e-20, Identity=25%"; Hit description =protein kinase - slime mold (Dictyostelium discoideum) emb|CAA86053.1| protein kinase
  misc_feature: Gene Ontology Annotation: Molecular function=calcium/calmodulin -dependent protein kinase activity; Cellular component=sarcomere; Biological process=mitotic chromosome condensation
MFKINILIFLIVVSSSCINCQLDIFQDLPLEADSQEFDELEQQINNDIWDEVENQHQELDSPEKLLQKICALYDFEIKTERVECQDVKIVSKSLNVNNHVIHKRQAEDELEGSGDDSPIQTEEEKPEESDTNPEEAKTEEPLETTAAEASQKEKVVEENIAPVLPESDKATKTEEPLETTAAEASQKEKVVDENIVHVLPESDKATKTEEPLETTAAEASTAEEQRIKPFKPFKKQALEIPLEEPIKDDSIQSSTAAPSVEITSKQEHHEEEKSIEEVTKISPEIKNEEATTAQAHSEAPLKQPELDIPEMVAPKEVPVNVLVKNQDESTNAPKLEIPVKEAESPVKEDEASSKQHIETSETKKDDIQLPDEEIILHQSGNAILNDNKDGMSNAEKTVRKMEANESIKSQVSDIEEPKAGATSEGAIGGKDTKLLIIIGGLVAAVGVAAFAYNILKKRESYWLTESQTPNPNERKWGTGDDPQKKDKKMKPF

SEQ ID NO: 20644 - protein, 206 aa, Diabrotica virgifera
  misc_feature: Coding regions on vcDNA: vcDNA=SeqID_341; Strand=-; Position=947-1567
NDGAVICVTDKTSTAFSNELQTDYTNSSIPCDQLKFPFCVQNPNAAVPVQIPCFSTAKVYANVSIMVRSYTAINETRTYRTYELSNVTTGVAPQTIVTPRELCVGILVLPGEKTITKDPERRKVTGIPDAPNPLLLLKYKYTNLGTTTLGLFLKYRLPKIRYPSYYFLNAYLYAQSGIAQQFDHYSIHYHEHGKRGCSWKSGIPSF

SEQ ID NO: 20645 - protein, 95 aa, Diabrotica virgifera
  misc_feature: Coding regions on vcDNA: vcDNA=SeqID_342; Strand=-; Position=414-701
NTSKWLPKLWRFMKLMKIMKKFKQTISTYHVNGIFSTSYRPTHINARGTNQRRRKRYLHSQDENYYENYPPCTLRVKKNWYNSYNRKSCFSSCVS

SEQ ID NO: 20646 - protein, 108 aa, Diabrotica virgifera
  misc_feature: Coding regions on vcDNA: vcDNA=SeqID_343; Strand=+; Position=71-397
VIKKDFDLICFGVYKMGKTPKKQFFGFFKVAHLTEKKIGSIVFDKIHRIKNKPAPSQKKVFQKKIKCILGLCTNTQPMCQLFELDKLIACHHKKNKNEKITFWWWVEA

SEQ ID NO: 20647 - protein, 632 aa, Diabrotica virgifera
  misc_feature: Coding regions on vcDNA: vcDNA=SeqID_344; Strand=+; Position=127-2025
  misc_feature: Homolog annotation: Hit_ID=XP_321324.1; Match level="QueryCoverage =99%, HitCoverage=79%, E-value=0.0, Identity=83%"; Hit description =ENSANGP00000012825 [Anopheles gambiae]
  misc_feature: Gene Ontology Annotation: Molecular function=GTPase activator activity; Cellular component=membrane; Biological process=vesicle -mediated transport
  misc_feature: Pfam annotation: Pfam_ID=Sec23_trunk; Match level="Score=458.6, E -value=6.7e-135, Copies=1"; Pfam description=Sec23/Sec24 trunk domain
MSTYEEYIQQNEDRDGIRFTWNVWPSSRIEATRLVVPLACLYQPIKERLDLPPIQYDPVLCTRNTCRAILNPLCQVDYRAKLWVCNFCFQRNPFPPQYAAISEQHQPAELMPMFSTIEYTITRAQCLPPIFLYVVDTCMDDEELGSLKDSLQMSLSLLPPNALIGLITFGKMVQVHELGTEGCSKSYVFRGTKDLSAKQVQEMLGIGKVALGQQAPQQPGQPLRPGQMQPTVVAPGSRFLQPVSKCDMNLTDLIGEQQKDPWPVHQGKRYLRSTGVALSIAIGLLECTYSNTGARVMLFVGGPCSQGPGQVVNDDLKQPIRSHHDIQKDNAKYMKKGIKHYDALAMRAATNGHSVDIYSCALDQTGLMEMKQCCNSTGGHMVMGDSFNSSLFKQTFQRVFTRDQKSDLKMAFNGTLEVKCSRELKVQGGIGSCVSLNVKSPLVSDTEIGMGNTVQWKMCTLTPSTTMSLFFEVVNQHSAPIPQGGRGCIQFITQYQHSSGQRKIRVTTVARNWADATANIHHISAGFDQEAAAVIMARMAVYRAESDDSPDVLRWVDRMLIRLCQKFGEYNKDDPNSFRLGQNFSLYPQFMYHLRRSQFLQVFNNSPDETSFYRHMLMMEDLTRSLKMETLF

SEQ ID NO: 20648 - protein, 359 aa, Diabrotica virgifera
  misc_feature: Coding regions on vcDNA: vcDNA=SeqID_345; Strand=+; Position=178-1257
  misc_feature: Homolog annotation: Hit_ID=XP_394765.1; Match level="QueryCoverage =100%, HitCoverage=95%, E-value=1e-108, Identity=55%"; Hit description=similar to ENSANGP00000017591 [Apis mellifera]
  misc_feature: Gene Ontology Annotation: Molecular function=protein binding; Cellular component=lateral plasma membrane; Biological process =establishment and/or maintenance of epithelial cell polarity
  misc_feature: Pfam annotation: Pfam_ID=LRR_1; Match level="Score=88.6, E-value=1.6e- 23, Copies=8"; Pfam description=Leucine Rich Repeat
MENYTSDSSDSENSVKVIDYAYLLLNPDETEDKLEKYFDEKKSFELVEKLILHHNQLITLPDSVYQFSNTRVLDISNNGITTLPDVFKYLPLTSFTAKNNLLTCSSIPKSFEKCLSLIELNLSGNKLCHFPEQILDFVGLKFLYLGGNGMVEISKNIWKLQNLQMISFGGNKLTEVPAAIGLLQHLQALVLCDNHIECLPANIANLHKLKTLLLHKNKLRTLPPEIVALKNLSELSLRDNPLIIRFVSEMSHSPSSLLELSARTIKLYNIGYGPGDIPATLFSYINSGHHCVNPHCKGVYFDNRVEHIKFVDFCGKYRIPLLQYLCSSKCANTASVREWKDESIDRPSRSYMMKKVLLG

SEQ ID NO: 20649 - protein, 284 aa, Diabrotica virgifera
  misc_feature: Coding regions on vcDNA: vcDNA=SeqID_346; Strand=+; Position=1-855
KSKMKALVFFSLLVGVFLYQINAAVVEPRKHDDNYDNELKQNLTECKRSLFLAFKEAVHDTSDFVVQKARKVKASIRNKTHMVMQKARAKMQSVRCKLHLIKSKFYPHVHLQDPCNMTDQVLEKGKEVINKTATVIDSASGTAKNQITSKVEKVRVIPDPSRNRIVNDPDESQTISNSRRITTRVGSDPERSVHYRRTLVGGNSNTTRITTDPDKSKVHSRTIIVRRDPDPDQSDESSETNRTQVVTRLVTDPRGTKVVYRTIVRSNPNTKINETDSDESNETH

SEQ ID NO: 20650 - protein, 291 aa, Diabrotica virgifera
  misc_feature: Coding regions on vcDNA: vcDNA=SeqID_347; Strand=+; Position=299-1174
  misc_feature: Homolog annotation: Hit_ID=XP_307216.1; Match level="QueryCoverage =95%, HitCoverage=52%, E-value=1e-53, Identity=38%"; Hit description =ENSANGP00000023315 [Anopheles gambiae]
MLQLVLIFTAVVLFYYFAIKPMSYWKDRGVVQSKPVWFFGDQWKQIFRLENIYEFFERGYKLTDGRYAGMYQFNIPTLIIKDPGLLKQIAVKDFDHFVNHRPLIPEGGDPLWSKNLFALTDQKWRDMRPVLSPSFTSSKMKMMYQLMADCAQNLVDHFSKINEEVAEVSFKDVSTRFANDIIATTAFGLHTDSLKNKDNEFYLMGKEITDFTSVSSVSRILGFIFMPRILKLFDVKLFSGASRNFFINLIDKTIKAREEQHIVRPDMIHLLLEAKKGNHHDDHNGTTGFAI

SEQ ID NO: 20651 - protein, 413 aa, Diabrotica virgifera
  misc_feature: Coding regions on vcDNA: vcDNA=SeqID_348; Strand=+; Position=56-1297
  misc_feature: Homolog annotation: Hit_ID=XP_391945.1; Match level="QueryCoverage =100%, HitCoverage=100%, E-value=0.0, Identity=80%"; Hit description =similar to CG10149-PB [Apis mellifera]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=PCI; Match level="Score=106.0, E-value=9.7e -29, Copies=1"; Pfam description=PCI domain
MAGAMLFERAPSVSSQHEKLLKLSRDSDDEDQNIVNKEQDILNLGEKYKKEGKAKELAELIKATRPFLSLISKAKAAKLVRSLVDYFLDLEAGIGIEVQLCKECIEWAKEERRTFLRQSLEARLIALYFDTGMYSEALQLESTLLKELKKLDDKNLLVEVQLLESKTYHALSNLPKARAALTSARTTANAIYCPPKMQAALDLQSGVLHAADEKDFKTAYSYFYEAFEGFDSVESPKALTALKYMLLSKIMINSPEDVQQIVSGKLAFKYAGQDIEAMKSVAQAAHKRSLADFQQAVKQFKHELEDDVIVRAHLGTLYDNMLEQNLCRIIEPYSRVQVEYVAKTIKLPVLQVEKKLSQMILDAKFHGILDQGEGVLIVFEESAVDKTYEMALETIQSMSKVVDTLYQKAKKLS

SEQ ID NO: 20652 - protein, 302 aa, Diabrotica virgifera
  misc_feature: Coding regions on vcDNA: vcDNA=SeqID_349; Strand=+; Position=73-978
  misc_feature: Homolog annotation: Hit_ID=AAS15645.1; Match level="QueryCoverage =76%, HitCoverage=44%, E-value=4e-51, Identity=44%"; Hit description =carboxylesterase [Aphis gossypii] dbj|BAA32385.1| carboxylesterase precursor [Aphis gossypii]
  misc_feature: Gene Ontology Annotation: Molecular function=carboxylesterase activity; Cellular component=extracellular space; Biological process= cholesterol catabolism
  misc_feature: Pfam annotation: Pfam_ID=COesterase; Match level="Score=5.9, E-value =2.3e-11, Copies=1"; Pfam description=Carboxylesterase
MKLFIYCGLLVFLVLSFTVCGVLTDSANELIVDLVTPKGQISGHTLQSYNGNEYYAFQEIPYAAPPVGDLRYQLPQSHPGWTGVLNCTNNTKVCPQPQSTYLDQDEDCLFANVYTPVKPGSNILLPVYVWIHGGGYAVWDGGFQRYNPSYLIDHNIVIVTFNYRLGALGFLATDDCVIPGNLGLKDQNFLLKWVSENIHLFGGDSSKVTIGGESAGSSAVADHILSKMSTGLFRGAIQESGSAINYFNFVPSPSVYAYKLAQVIDNSINPQTTNTSVLLDFSQKAEIGDLVAASLKVPAVAN

SEQ ID NO: 20653 - protein, 382 aa, Diabrotica virgifera
  misc_feature: Coding regions on vcDNA: vcDNA=SeqID_350; Strand=+; Position=329-1476
  misc_feature: Homolog annotation: Hit_ID=JC4967; Match level="QueryCoverage=97%, HitCoverage=99%, E-value=1e-174, Identity=77%"; Hit description =alcohol dehydrogenase (EC 1.1.1.1) class III - gilthead sea bream gb|AAB41888.1| alcohol
  misc_feature: Gene Ontology Annotation: Molecular function=formaldehyde dehydrogenase (glutathione) activity; Cellular component=cytoplasm; Biological process=retinoid metabolism
  misc_feature: Pfam annotation: Pfam_ID=ADH_zinc_N; Match level="Score=505.1, E -value=6.7e-149, Copies=1"; Pfam description=Zinc-binding dehydrogenase
  misc_feature (242)..(242): Xaa can be any naturally occurring amino acid
MSTVGQVIKCKAAVAWGPKEDLKIETIEVDPPKAHEVRLKVVYTAVCHTDAYTLSGQDPEGLFPVVLGHEGSGIVESVGEGVTNVKPGDHVIPLYVPQCGECKFCKTPKTNLCQKIRITQGQGKMPDGTSRFRCNGKELYHFMGCSTFSEYTVVADISVTKINSNAPLDKVCLLGCGVPTGYGAALNTAKVEKGSTCAVWGLGAVGLAVGLGCQAAGASRIIGVDLNPDKFKIAKNFGFTEXCNPKDYEKPITEVLVELTDGGLDYTFECVGNVHTMRAALESCHKGWGVSTIVGVAGAGQEISTRPFQLVTGRVWKGTAFGGWKSRDSVPKLVEEYLNKKLKLDEFVSHSLKFEEINEAFHLMHKGVSIRTVLALTQNSNL

SEQ ID NO: 20654 - protein, 304 aa, Diabrotica virgifera
  misc_feature: Coding regions on vcDNA: vcDNA=SeqID_351; Strand=+; Position=149-1060
  misc_feature: Homolog annotation: Hit_ID=EAL38887.1; Match level="QueryCoverage =100%, HitCoverage=71%, E-value=1e-113, Identity=65%"; Hit description=ENSANGP00000025675 [Anopheles gambiae str. PEST] ref|XP _552528.1| ENSANGP00000025675 [Anopheles gambiae
  misc_feature: Gene Ontology Annotation: Molecular function=mannose-1-phosphate guanylyltransferase activity; Cellular component=cytoplasm; Biological process=protein modification
  misc_feature: Pfam annotation: Pfam_ID=NTP_transferase; Match level="Score=59.2, E -value=1.1e-14, Copies=1"; Pfam description=Nucleotidyl transferase
  misc_feature (253)..(253): Xaa can be any naturally occurring amino acid
MLKAVILIGGPQKGTRFRPLSLDIPKPLFPVAGLPLIQHHIEACSAIEGVKEILIIGFYPISQIQPFATEMQHLYNITVKYLQEYVALGTAGGLYHFRDPIRFGNPEAFFVMNGDVCSDFPLAELYQFHKETWEKSGKKALVTIMGTEATRHQSLNYGCIVTNKETLEVTHYVEKPSSYVSTLINCGVYVFSPEIFHTIGAVIMKLQEQYSKNGNGNGNREAGYIQLEQEILAPLAGSGQIYALPVTNWWSQXKTAGSAIYANRHYLQLYKANFPERFMSPGGNEERCVIYPDVLIDKTASIHP

SEQ ID NO: 20655 - protein, 434 aa, Diabrotica virgifera
  misc_feature: Coding regions on vcDNA: vcDNA=SeqID_352; Strand=-; Position=131-1435
  misc_feature: Homolog annotation: Hit_ID=XP_309657.1; Match level="QueryCoverage =83%, HitCoverage=99%, E-value=2e-34, Identity=29%"; Hit description =ENSANGP00000003881 [Anopheles gambiae]
  misc_feature: Gene Ontology Annotation: Molecular function=lipase activity; Cellular component=extracellular; Biological process=digestion
  misc_feature: Pfam annotation: Pfam_ID=Abhydrolase_1; Match level="Score=31.9, E -value=2e-06, Copies=1"; Pfam description=alpha/beta hydrolase fold
MGSPIYLFLSLLCFSCSVTLTTAGVKTCTTELEYYFNLFGQTNGGTCQIDPDGGASPMEILGRWGCTVEEKILTTGDGYQVSVIRAYSKNLNTSLAPILMVHGIYMNTRGFMSSQEKSLAYQFLVAGGGDRQVFFLSLRGTIYSTGNINGLDQSNYAYWNFSWHEMGKYDVAAALEFVWTTTGQKAIVIGYSMGTTVTTVYLSLDPATAQSRVRNFIAMAPVVILNKQIRSILGGLATIWPLVQPMAKLAFNGQILKKNPAYTSFCALVPVTMQMCYSVTVPIFGNNYPCLDYEKRPIQITNNPDSICEKVITHYAQLINSGRFQKFDYGSAGNLVAYNSATPPEYPLSDINVPVTYIVSDNDWLAEKSNALLAYNKIRSDCQCGFMRVSDTQFAHDNFINHKDQLLLLNQRLEAIINNQLDQINPTCPTQQTI

SEQ ID NO: 20656 - protein, 337 aa, Diabrotica virgifera
  misc_feature: Coding regions on vcDNA: vcDNA=SeqID_353; Strand=+; Position=48-1061
  misc_feature: Homolog annotation: Hit_ID=XP_320682.1; Match level="QueryCoverage =96%, HitCoverage=90%, E-value=3e-81, Identity=45%"; Hit description =ENSANGP00000020213 [Anopheles gambiae]
  misc_feature: Gene Ontology Annotation: Molecular function=enoyl-[acyl-carrier protein] reductase activity; Cellular component=mitochondrion; Biological process=aerobic respiration
  misc_feature: Pfam annotation: Pfam_ID=ADH_zinc_N; Match level="Score=165.6, E -value=1.1e-46, Copies=1"; Pfam description=Zinc-binding dehydrogenase
YIHFIMPTKIRYANTGEPLDVLYLENYDMPEPEKDEALVQMIAAAVNPVDINIVQGKYPLKVDSPGYEGMGKVIKVGSEVKNLKVGDHVIPIVYAGTWRTHITLPEESLFRIPKSIDVPEGATLQVNPVTMYTMLKEFVNLGPEDTVIQNGANSACGVIAIQMCKAWGIKTVNVVRDRPLIDDLKTFLKSLGATYVFTEEEIKKTDIFKTGELNNPVLGLNCIGGSSATSIMRHLSEEGVLVTYGGMSLEPVTASTTALVFKNIRLEGFNMSRWNNKEENFAKLPKILNEIVDMVLEEKLKAPPHALVDFLNYKEALRNTLSPGGMIGKNSFWILGI

SEQ ID NO: 20657 - protein, 258 aa, Diabrotica virgifera
  misc_feature: Coding regions on vcDNA: vcDNA=SeqID_354; Strand=+; Position=105-880
  misc_feature: Homolog annotation: Hit_ID=AAP13852.1; Match level="QueryCoverage =82%, HitCoverage=43%, E-value=1e-58, Identity=49%"; Hit description =glucosidase [Bombyx mori]
  misc_feature: Gene Ontology Annotation: Cellular component=endoplasmic reticulum; Biological process=aging
  misc_feature: Pfam annotation: Pfam_ID=Glyco_hydro_1; Match level="Score=-36.6, E -value=4.5e-17, Copies=1"; Pfam description=Glycosyl hydrolase family 1
  misc_feature (208)..(208): Xaa can be any naturally occurring amino acid
  misc_feature (222)..(222): Xaa can be any naturally occurring amino acid
  misc_feature (224)..(224): Xaa can be any naturally occurring amino acid
MEYTFCLLFLWVGSTTSAKLPMYDFPKKFSFGVATSAFQIEGGWNASGKGVSIWDHLVHDTNEIIVDGSNADVACDSYNKVDYDILLLKALGVSHYRFSIAWTRILPNGFRNHVSEDGVKYYNYLINKLLENGIEPWVTIFHFDIPYGMFLIGGMFNEKFSEYLSDYADLLFNLYGDRVKTWVTINEPYSVCVSGTRVLGEYRPNGIXNTLCGHTFLKAHAXSXYDLYQRKYKSQQNGKNKYGLLTYNVTIERIQQKI

SEQ ID NO: 20658 - protein, 74 aa, Diabrotica virgifera
  misc_feature: Coding regions on vcDNA: vcDNA=SeqID_355; Strand=+; Position=625-849
TVPTAMNIEMFIIIYIFIIHDTALQTLFTTTFRIKQMFKMPSFQFQAFFVAFMKILSHVCEQKLPPSAFLIGTH

SEQ ID NO: 20659 - protein, 54 aa, Diabrotica virgifera
  misc_feature: Coding regions on vcDNA: vcDNA=SeqID_356; Strand=+; Position=3-167
PGRSTRQRTRGRTRGDSSCTLRFNQSIMQLLHFRVAKKLKMFILYSFYQFMYSN

SEQ ID NO: 20660 - protein, 101 aa, Diabrotica virgifera
  misc_feature: Coding regions on vcDNA: vcDNA=SeqID_357; Strand=-; Position=654-959
  misc_feature (89)..(89): Xaa can be any naturally occurring amino acid
LKIYHFLAQSNQNVIHLICRSLHFLIKLFIGMYKHSQFLCNTKMQKLHNTLVKSESAGRVYTGFRGLFPLISSPISSSLRFLHVSYFRXFRIAKKEMSRMN

SEQ ID NO: 20661 - protein, 231 aa, Diabrotica virgifera
  misc_feature: Coding regions on vcDNA: vcDNA=SeqID_358; Strand=-; Position=778-1473
  misc_feature: Homolog annotation: Hit_ID=XP_316642.1; Match level="QueryCoverage =90%, HitCoverage=86%, E-value=8e-42, Identity=45%"; Hit description =ENSANGP00000011566 [Anopheles gambiae]
MESWDDDNFEPTAPTVVPVAANKWEGEDEEEDIKESWEDEDEEKKEDGKADPDQKKPKKKSLAEKIAEKERLKREEMERRLREEAEEDIPPEEKLRRQQESDLKLALETTFGGNKTTEVLTDLTLPNSTEEFDSFTDTLSKKLITLSKSTEYPNFVENLTRSLCATMSSLDIKKVKNSLDNLFLEKQKIKKGDKAKKNKGKGKAKLHIEGDNQFNQLSAYVNDYDEYDDFM

SEQ ID NO: 20662 - protein, 155 aa, Diabrotica virgifera
  misc_feature: Coding regions on vcDNA: vcDNA=SeqID_359; Strand=+; Position=45-512
  misc_feature: Homolog annotation: Hit_ID=XP_318997.1; Match level="QueryCoverage =90%, HitCoverage=34%, E-value=2e-30, Identity=51%"; Hit description =ENSANGP00000014755 [Anopheles gambiae]
  misc_feature: Pfam annotation: Pfam_ID=Chitin_bind_4; Match level="Score=87.8, E -value=2.8e-23, Copies=1"; Pfam description=Insect cuticle protein
MKLFIVCLAILSVCYGRPADAPAASGPPANAQPPVALIKYENEGVNADGSYQWSFEAANGIKQEEKGSFKPGASEGESIAEVSGQVEYTADDGTPIHLSYIANENGFQPQGDHLPTPPPIPEAIQKSLDFNAAHPQAEDAGAGAGSPPGAAAPQE

SEQ ID NO: 20663 - protein, 256 aa, Diabrotica virgifera
  misc_feature: Coding regions on vcDNA: vcDNA=SeqID_360; Strand=+; Position=78-848
  misc_feature: Homolog annotation: Hit_ID=EAA08478.2; Match level="QueryCoverage =96%, HitCoverage=56%, E-value=1e-101, Identity=63%"; Hit description= ENSANGP00000014729 [Anopheles gambiae str. PEST] ref|XP_562958.1| ENSANGP00000014729 [Anopheles gambiae s
  misc_feature: Gene Ontology Annotation: Molecular function=electron transporter activity; Cellular component=extracellular space; Biological process= electron transport
  misc_feature: Pfam annotation: Pfam_ID=ALA_synthase; Match level="Score=143.5, E -value=4.9e-40, Copies=1"; Pfam description=Aminolevulinic acid synthase domain
MSCPFLSKLSQAYLKNYASLLVKMYGNQCPVISRSMNNVASKAEVKTQDDVFAYDQFFHQQIMKKKKEHSYRVFKKVNRLAGPGEFPKAVEHSWGQAPITVWCSNDYLGMSSHPEVKAAVRDALEKYGTGAGGTRNISVNSTLHEKLESNLAELHNKDAALLFTSCFVANDSTLYTLAKALPGCHIFSDAGNHASMIQGIRNSRVPKHIFRHNDPAHLEELLQGVDRNVPKIVAFETVHSMAGAVCPLRGTLGFFP

SEQ ID NO: 20664 - protein, 152 aa, Diabrotica virgifera
  misc_feature: Coding regions on vcDNA: vcDNA=SeqID_361; Strand=+; Position=84-542
  misc_feature: Homolog annotation: Hit_ID=XP_314769.1; Match level="QueryCoverage =97%, HitCoverage=76%, E-value=1e-38, Identity=50%"; Hit description =ENSANGP00000014474 [Anopheles gambiae]
  misc_feature: Gene Ontology Annotation: Cellular component=integral to plasma membrane
  misc_feature: Pfam annotation: Pfam_ID=JTB; Match level="Score=135.2, E-value=1.6e -37, Copies=1"; Pfam description=Jumping translocation breakpoint prot
MIESCPKKRMLLGITVLGILTILVLFIESHWTESTRRDKKSNFIVEQNSTCWEAGNFEVIKECEPCTAFEIRSKTIGVCIHSHYKEVLKCANGETVTRSCDKAVYYDELSFWRFEGFMFAIGLISTVCVISRRRVLNKRILQRVQRQLANCV

SEQ ID NO: 20665 - protein, 315 aa, Diabrotica virgifera
  misc_feature: Coding regions on vcDNA: vcDNA=SeqID_362; Strand=+; Position=39-986
  misc_feature: Homolog annotation: Hit_ID=NP_729395.2; Match level="QueryCoverage =96%, HitCoverage=86%, E-value=6e-48, Identity=35%"; Hit description =CG6416-PE, isoform E [Drosophila melanogaster] gb|AAN11990.2| CG6416- PE, isoform E [Drosophila
MSYQRPSFWQWRADNNKKKVGFGSPVEGVLHRGDIITKVGNYDSRDIRHQDAQNLFRNAGNNIQVVVQRENAPHSTGSSRTSSHNYSPLSVSPHLSPKGYTVSSGYSPAGSALTPYYSTPLTPIDNNYFEVYEHDPKRRHEEDNKDVHVTQQPYRTTPLVLPGAKVKRDQGPTESYLRHHPNPSVRAPPLNMLGHTNFSSPRNLYRESNIDTMQNQTRNKSQTRRQVKFNPAESETYKALQEEEYECDNIQEVTVPPQSKVYAPNKTIPSKKMAYVVNQNPQSQYGNALGTDPEVIQQSGSFKRLMWSVLPGSQF

SEQ ID NO: 20666 - protein, 167 aa, Diabrotica virgifera
  misc_feature: Coding regions on vcDNA: vcDNA=SeqID_363; Strand=+; Position=10-513
  misc_feature: Homolog annotation: Hit_ID=XP_317357.1; Match level="QueryCoverage =99%, HitCoverage=98%, E-value=1e-84, Identity=87%"; Hit description =ENSANGP00000010523 [Anopheles gambiae]
MVDEGTRKTLSNIPLLKTKAGPRDKELWIQRLKEEYQSLIKYVQNNKAADNDWFRLESNKEGTKWFGKCWFIHELLKYEFDVEFDIPIGYPTTAPEIALPELDGKTAKMYRGGKICLSDHFKPLWARNVPKFGIGHAMALGLGPWLAVEIPDLIAKGVISYKEKTSQ

SEQ ID NO: 20667 - protein, 343 aa, Diabrotica virgifera
  misc_feature: Coding regions on vcDNA: vcDNA=SeqID_364; Strand=+; Position=165-1190
  misc_feature: Homolog annotation: Hit_ID=AAO67521.1; Match level="QueryCoverage =91%, HitCoverage=53%, E-value=7e-18, Identity=32%"; Hit description =SINA [Schistosoma mansoni] sp|Q86MW9|SINA_SCHMA Ubiquitin ligase SINA (Seven in absentia homolog) (SmSINA)
  misc_feature: Gene Ontology Annotation: Molecular function=transcription co -repressor activity; Cellular component=cytoplasm; Biological process= small GTPase mediated signal transduction
  misc_feature: Pfam annotation: Pfam_ID=Sina; Match level="Score=-21.1, E-value=1.2e- 05, Copies=1"; Pfam description=Seven in absentia protein family
  misc_feature (312)..(312): Xaa can be any naturally occurring amino acid
  misc_feature (323)..(323): Xaa can be any naturally occurring amino acid
MAEQSLMSFMDELLESMCLFCAVCKDILKPPIMLVENVGNVCTKCYEEKQEVMNWKSMKNSALENILNLLKLPCKYKAKGCAVRVSYEDLDFHQSGCKYRTKVCSMLKFGCDWEGSTIDFIEHFKECHGDHVINFENNLFFLETSLNDTNMVKLLVMKQHTFILRMQTNLQKNKLFYIICSVDDDYSSFCEYSVKHKGGSENYIKTKSKIVSSYHIYNEFNENIAVEIDLDALKQISHISDTITNIFKIKLEESSGETIDDKILHFFECPVCKNFMKPPIFQCSSGHSICNMCRPRLEKCPTCRSAFGNTRXLFFRSLTAGVXYPCVYHDSGCLEIGFCHHIV

SEQ ID NO: 20668 - protein, 315 aa, Diabrotica virgifera
  misc_feature: Coding regions on vcDNA: vcDNA=SeqID_365; Strand=+; Position=19-963
  misc_feature: Homolog annotation: Hit_ID=EAL28949.1; Match level="QueryCoverage =88%, HitCoverage=70%, E-value=3e-92, Identity=56%"; Hit description =GA15542-PA [Drosophila pseudoobscura]
  misc_feature (290)..(290): Xaa can be any naturally occurring amino acid
  misc_feature (294)..(294): Xaa can be any naturally occurring amino acid
  misc_feature (301)..(301): Xaa can be any naturally occurring amino acid
MFLPKINRIIDPFKSLAIQKNIAATVNGAQTMSTTVAPSEQKTEKKPISKAMKAYLERAKEHDEFMKRQKEEFLIGKRHLANMMGEDPETFTQEDVDNAIQYLFPSGLFEPKARPHMKPPEEIFPQRKAAEFDETGRPYHFLFYTGKPSYYQVLHDLTSHINDLIKFEDTMIRKNLQPDPNLTFSMSGFQWLDKQSLETKFVETLKEKDYEYFITSLERLSAMPYSYKVKDFILEYANPLINKVQSQETPKANIDKDGRQFVTIYECMRKRSRGDVTIKLPGTGKISINXRDIXYFKKDHXRETVLFPLIFTQHA

SEQ ID NO: 20669 - protein, 290 aa, Diabrotica virgifera
  misc_feature: Coding regions on vcDNA: vcDNA=SeqID_366; Strand=+; Position=116-988
  misc_feature: Homolog annotation: Hit_ID=AAV88596.1; Match level="QueryCoverage =97%, HitCoverage=98%, E-value=1e-101, Identity=55%"; Hit description= Sparc [Schistocerca gregaria]
  misc_feature: Gene Ontology Annotation: Molecular function=calcium ion binding; Cellular component=extracellular matrix; Biological process =ossification
MKLCHLGLIFLIVFLVTDIAAEKVVKRKKTRRKPIHIESFDSKNDIQSEEAIPIAPPGDEDIDNRVPLVDPCMQVRCGAGRICQVNELREPECVCIPTCPEESESRRKVCSNYNETWSSDCAIYQQRCLCAKGDQECKGPQYKHVHIEYYGQCREMPHCTQEEMADFPRRMRDWLFNIMRDLADRQELTPHYMNMEKEAESNMTRRWTNAAVWKFCDLDGNPPDRSVSRHELFPIRAPLMALEHCISPFLNSCDADNNHRITLHEWAKCLQLEEEEIEHQCEEISDISAE

SEQ ID NO: 20670 - protein, 462 aa, Diabrotica virgifera
  misc_feature: Coding regions on vcDNA: vcDNA=SeqID_367; Strand=+; Position=110-1495
  misc_feature: Homolog annotation: Hit_ID=XP_321735.1; Match level="QueryCoverage =97%, HitCoverage=46%, E-value=0.0, Identity=80%"; Hit description =ENSANGP00000016931 [Anopheles gambiae]
  misc_feature: Gene Ontology Annotation: Molecular function=molecular_function unknown; Cellular component=Golgi apparatus; Biological process=ER to Golgi transport
  misc_feature: Pfam annotation: Pfam_ID=Adaptin_N; Match level="Score=269.3, E-value= 6.5e-78, Copies=1"; Pfam description=Adaptin N terminal region
  misc_feature (427)..(427): Xaa can be any naturally occurring amino acid
  misc_feature (438)..(438): Xaa can be any naturally occurring amino acid
MTAVEQPCYTLINLPTDSEPYNEMQLKMDLEKGEVKVKIRALEKIIHMILAGERLPNGFLMTIIRNVLPLQDHLAKKLLLIFWEIVPKTNPEGKLLQEMILVCDAYRKDLQHPNEFLRGSTLRFLCKLKEPELLEPLMPSIRACLDHRHSYVRRNAVLAIFTIYKNFEALIPDAPELISNYLDGEQDMSCKRNAFLMLLHADQERALSYLASCLDQVNSFGDILQLVIVELIYKVCHSNPAERSRFIRCIYNLLNSSSPAVRYEAAGTLVTLSSAPTAVKAAASCYIELIIKESDNNVKLIVLDRLIALKELPNHERILQDLVMDILRVLSAPDLEVRKKTLSLALELVSSRNIEEMVLVLTKEVSKTVDSEHEDTGKYRQLLVRTLHSCSIKFPDIARSVIPVLIEFLSDNNELAATDVLLFLREXIQKFKELQPLXIEKLIETFKDIKLVKVHRAAILDF

SEQ ID NO: 20671 - protein, 225 aa, Diabrotica virgifera
  misc_feature: Coding regions on vcDNA: vcDNA=SeqID_368; Strand=+; Position=1-678
LVLDRERPPFSFFFYSYSYTKMIAKTLCFLLVLFYGHQVNSRTTQGDVVEWQDYNPDSIPDDAIPSGGTLDGQDIYIGLVHFNNKEFEGFIPTNIIGGQKCVHIPVGLEEIETVCDDIKILVGKNDYINKLYWEIARPYFFESYFDSDDFRPVRAGWESHTTSYNSSLYIGKQYFSGVNWIGKIYNSYPKTDENGAAVYVFENYFDPEELKIYKGVYYGLLLFRY

SEQ ID NO: 20672 - protein, 95 aa, Diabrotica virgifera
  misc_feature: Coding regions on vcDNA: vcDNA=SeqID_369; Strand=+; Position=77-364
LFDSKKSKKIILVVVLSYTKMIAKTLCFLLVLFYGHQVNSRTTQGDVVEWQDYNPDSIPDDAIPSGGTLDGQDIYIGLVHFNNKEFGRFIPTNII

SEQ ID NO: 20673 - protein, 132 aa, Diabrotica virgifera
  misc_feature: Coding regions on vcDNA: vcDNA=SeqID_370; Strand=+; Position=1-399
  misc_feature: Homolog annotation: Hit_ID=NP_725476.1; Match level="QueryCoverage =99%, HitCoverage=30%, E-value=9e-52, Identity=78%"; Hit description =CG8200-PB, isoform B [Drosophila melanogaster] gb|AAF58121.1| CG8200- PB, isoform B [Drosophila
  misc_feature: Gene Ontology Annotation: Molecular function=structural molecule activity; Cellular component=flotillin complex; Biological process =biological_process unknown
  misc_feature: Pfam annotation: Pfam_ID=Flotillin; Match level="Score=-22.4, E-value= 6.4e-06, Copies=1"; Pfam description=Flotillin family
FRLEKIAEANHKRVLLEAEAEAESTRLRGEAEAFAIQAKAAAEAEQMAKKAEAWKEYKEAAMIDMYLDVLPKVAAEVAAPLSQAKKITMVSTGTGEVGAAKLTGEILDIVNKVPMLVKSMTGVDISKSVHAA

SEQ ID NO: 20674 - protein, 432 aa, Diabrotica virgifera
  misc_feature: Coding regions on vcDNA: vcDNA=SeqID_371; Strand=+; Position=90-1388
  misc_feature: Homolog annotation: Hit_ID=NP_725476.1; Match level="QueryCoverage =99%, HitCoverage=99%, E-value=0.0, Identity=84%"; Hit description =CG8200-PB, isoform B [Drosophila melanogaster] gb|AAF58121.1| CG8200- PB, isoform B [Drosophila
  misc_feature: Gene Ontology Annotation: Molecular function=structural molecule activity; Cellular component=flotillin complex; Biological process =biological_process unknown
  misc_feature: Pfam annotation: Pfam_ID=Flotillin; Match level="Score=334.3, E-value= 1.8e-97, Copies=1"; Pfam description=Flotillin family
MTWGFVTCGPNEALVISGCCYSKPLLVPGGRAFVWPSIQKIQRISLNTMTLIVDSPTVYTSQGVPISVTGIAQVKIQGQNEEMLLAACEQFLGKKQDEIQLIALHTLEGHQRAIMGSMTVEEIYKDRKKFSKQVFEVASSDLVNMGITVVSYTLKDIRDEEDPVDGRGYLKSLGMARTAEVKRDARIGEAEARAEATIKEAIAEEQRMASVFLNDTEIAKAKRDFELKKAAYDVEVQTKNAEAEMAYELQAAKTKQRIKEEQMQIQVVERTQQIAVQEQEIARRERELESTIRRPAEAEKFRLEKIAEANHKRVLLEAEAEAESTRLRGEAEAFAIQAKAAAEAEQMAKKAEAWKEYKEAAMIDMYLDVLPKVAAEVAAPLSQAKKITMVSTGTGEVGAAKLTGEILDIVNKVPMLVKSMTGVDISKSVHAA

SEQ ID NO: 20675 - protein, 258 aa, Diabrotica virgifera
  misc_feature: Coding regions on vcDNA: vcDNA=SeqID_372; Strand=+; Position=45-821
  misc_feature: Homolog annotation: Hit_ID=NP_648017.1; Match level="QueryCoverage =89%, HitCoverage=78%, E-value=4e-28, Identity=37%"; Hit description =CG10472-PA [Drosophila melanogaster] gb|AAF50708.1| CG10472-PA [Drosophila melanogaster]
  misc_feature: Gene Ontology Annotation: Molecular function=serine-type peptidase activity; Cellular component=extracellular space; Biological process= biological_process unknown
  misc_feature: Pfam annotation: Pfam_ID=Trypsin; Match level="Score=135.2, E-value =1.5e-37, Copies=1"; Pfam description=Trypsin
MKVYVLILFLVTLVAFGVQGLIGGTLIYPHSLPYMVFLNVSGSTNTTRCSGALISKDYILTAARCLKNSTAVRVVLGADDISVNEEMQVSFDTTQSNFIIHENFVDETLENDIGLIKLPSSVESNEYIQVIPMATEDQEEAQLGELVVVSGWGLTYYGYPESMATVPMAEWLVVLNNTNKECQRFGTLVKDTNICCSTTNSWDGPLQLCDGDWGDPLVNDGKNKTLYGIASFTAYESCVMGKPNVFTNVAKYSEMDKF

SEQ ID NO: 20676 - protein, 130 aa, Diabrotica virgifera
  misc_feature: Coding regions on vcDNA: vcDNA=SeqID_373; Strand=+; Position=29-418
  misc_feature: Homolog annotation: Hit_ID=XP_313425.1; Match level="QueryCoverage =97%, HitCoverage=24%, E-value=2e-49, Identity=74%"; Hit description =ENSANGP00000020207 [Anopheles gambiae]
  misc_feature: Gene Ontology Annotation: Molecular function=aldehyde dehydrogenase activity; Cellular component=mitochondrion; Biological process =vitamin A metabolism
  misc_feature: Pfam annotation: Pfam_ID=Aldedh; Match level="Score=-288.1, E-value =0.00099, Copies=1"; Pfam description=Aldehyde dehydrogenase family
  misc_feature (103)..(103): Xaa can be any naturally occurring amino acid
  misc_feature (123)..(123): Xaa can be any naturally occurring amino acid
QALVENPNVDKIAFTGSTEVGKLIQANAGKNNLKRTTLELGGKSPNIILADADLEHAVEHSHQGVFYNQGQVCCAGTRCFIDDKIYDEFVERSVERAKKRVVXDPFDLKTEQGPQVDETQFNXILGLIKE

SEQ ID NO: 20677 - protein, 338 aa, Diabrotica virgifera
  misc_feature: Coding regions on vcDNA: vcDNA=SeqID_374; Strand=+; Position=89-1105
  misc_feature: Homolog annotation: Hit_ID=EAL34483.1; Match level="QueryCoverage =94%, HitCoverage=98%, E-value=1e-104, Identity=55%"; Hit description= GA21652-PA [Drosophila pseudoobscura]
  misc_feature: Gene Ontology Annotation: Molecular function=sodium/potassium -exchanging ATPase activity; Cellular component=integral to membrane; Biological process=transport
  misc_feature: Pfam annotation: Pfam_ID=Na_K-ATPase; Match level="Score=232.1, E -value=1e-66, Copies=1"; Pfam description=Sodium / potassium ATPase beta chain
MREKKISQVSQMSRSLSKQEELLNVQTQYFLKLDEIKLTKKERFKKAIYDPKTKKVFGRTSISWAKIGLFYLIFYGMLAALVAVCMWVFFQTLDPRIPKWQLDESLIGTNPGLGFRPMPEKNEESTLIWFQGSNKTSYSYWVENILKFLDKYYVPSKIAKGNGQIKTCSHHDYPTSGEVCEVDVRDWEECNRDQFFNYHKNSPCIFIKLNKIYNWEPMYYDDPYDLPEEMPDNLKQHIRGINNTRELRNVWVSCQGENPADVEYLGPITYYPRSVQGFPGYYFPYLNSEGYLSPLVAVKFERPVAGIVINVECRAWARNILYNRADRTGSVHFELLID

SEQ ID NO: 20678 - protein, 565 aa, Diabrotica virgifera
  misc_feature: Coding regions on vcDNA: vcDNA=SeqID_375; Strand=+; Position=4-1701
  misc_feature: Homolog annotation: Hit_ID=XP_391943.1; Match level="QueryCoverage =98%, HitCoverage=96%, E-value=1e-136, Identity=44%"; Hit description= similar to RE16761p [Apis mellifera]
  misc_feature: Gene Ontology Annotation: Molecular function=carboxylesterase activity; Biological process=cholesterol catabolism
  misc_feature: Pfam annotation: Pfam_ID=COesterase; Match level="Score=609.4, E -value=2.7e-180, Copies=1"; Pfam description=Carboxylesterase
MVSSRTVGFCLSVLVCSVVCNDYPLVRISDGLLQGAFLKTRNNRKFSGFNGIPFAKPPVGQLRFQPPVPNDPWEGQLNATGVHAECPQRDVYRRSPKISGEEDCLYLNVYTPKLSNFENDLLPVMIWFHGGGLLCGGGNSDWYGPDILLDRDIVLVVTNYRLGPLGFLATGDAVVPGNNGLRDQSLALRWIQKNIRKFGGDPNLVTLFGESAGGSSSNFHMISPLSRGLFTKAILQSGTTLSPWTFSENQETEKNSRKLAKALNCPTDSSQEMVECLRKVEARTFVELDDIFKVWDYDPMIPFKPVVEPSEVEDPFMPDHPLNIIKSGKSMDVPIIVGITSQDGALKNAGYKNANLLDEFADRFDELVPISLFYDRTEKDPQRVTRRLKKFYFGNKRVQDNIQGITDMYTDGWFFKASDDVARLHTKFYKQPVYFYVFGYNGSVSFSKVFGGGDEHFGTVHADDLQYLFPVGDGLFPDVKPSESDKRIAKVFTTLWTNFAKTGNPTPETTTLLPNKWEKYTLENEEYYIIDNDNLETRTGVLRNRALFWRELINDPLKEGKREEL

SEQ ID NO: 20679 - protein, 419 aa, Diabrotica virgifera
  misc_feature: Coding regions on vcDNA: vcDNA=SeqID_376; Strand=+; Position=1-1259
  misc_feature: Homolog annotation: Hit_ID=XP_395743.1; Match level="QueryCoverage =100%, HitCoverage=42%, E-value=1e-175, Identity=68%"; Hit description=similar to CG33123-PA [Apis mellifera]
  misc_feature: Gene Ontology Annotation: Molecular function=leucine-tRNA ligase activity; Cellular component=cytoplasm; Biological process=tRNA modification
  misc_feature: Pfam annotation: Pfam_ID=tRNA-synt_1; Match level="Score=-292.5, E -value=0.049, Copies=1"; Pfam description=tRNA synthetases class I (I, L, M and
  misc_feature (305)..(305): Xaa can be any naturally occurring amino acid
  misc_feature (413)..(413): Xaa can be any naturally occurring amino acid
VQYLQKLEKEVQERWKNEKIFEIDAPETPRKSEDEKFFCNFPYPYMNGRLHLGHTFSLSKCEFAVRYNRLKGKKVQFPFGFHCTGMPIKACADKLKREMELYGNPPKFPEVEEEVKEEEKDGIPKDKSKSKKSKAVAKAGPAKFPRPIMQSIGLDDKDIPKFADALYWCEFFPPKAVEDLNRFGIHTDWRRTFITTDANPFYDSFVRWQFIRLKERNKIKFGKRNTIFSVRDGQPCMDHDRASGEGVGPQEYTLIKMKLLAPYPAKLSPLKNKPVFLVAATLRPETMYGQTNCWLRPDMKYIGFXTKNNEVFVCTQRAARNMAFQEFTKEQGKFDIVVELTGQDLLGCALTSPLSVYPKIYALPMLTIKEDKGTGVVTSVPSDSPDDYAAIVDLKKNQPFREKYGITDDMVLXFEPVPV

SEQ ID NO: 20680 - protein, 260 aa, Diabrotica virgifera
  misc_feature: Coding regions on vcDNA: vcDNA=SeqID_377; Strand=+; Position=44-826
  misc_feature: Homolog annotation: Hit_ID=XP_216837.2; Match level="QueryCoverage =80%, HitCoverage=23%, E-value=3e-28, Identity=32%"; Hit description =similar to vitamin D receptor-interacting protein [Rattus norvegicus]
MDHIFTISKKPSRSLNPYKQNIFNKLEKSILCSVSSTNVIAFSTESNIEECNSLYWSSNVYVADLNSPWQIHKVLSNSSPVTVLQWDFTGELLLIADESGCVRIYSAKDHILNDWNIVLQTVLQGEHILAAAFFHSGKRICLNIEKKDSSSYIEKFQHVKFACSVKQFGSKPAIGALLLTTTGMLAAVLLPQPTCQTPMTMATESLGPTRMFIKTADICYGKNGHFLLAVSSGDPSCPFHVPGFGKKKKRKVYYCNAIFA

SEQ ID NO: 20681 - protein, 253 aa, Diabrotica virgifera
  misc_feature: Coding regions on vcDNA: vcDNA=SeqID_378; Strand=+; Position=207-965
  misc_feature: Homolog annotation: Hit_ID=XP_312744.1; Match level="QueryCoverage =94%, HitCoverage=81%, E-value=2e-25, Identity=33%"; Hit description =ENSANGP00000020324 [Anopheles gambiae]
  misc_feature: Gene Ontology Annotation: Molecular function=serine-type endopeptidase activity; Cellular component=extracellular; Biological process=Tl signaling pathway
MVPTCLKSFCVFLVVVSLSNGQYGGDPCTTPAGIQGNCLPVRSCPSMMTALLTVQRPLSDTAREQLEAYYCSTDFKVCCPRVPIVIKELANRTDPDTSDPGQISSDVDMTKHRNYGLLPSDCGYLDVAVTKIINGQDAGRDYPWMTLLSFRGPDNRGAFDCAGSIINNRYILTAAHCLVDRSRLLGVRVGEYNITNKGVDCFGKGDEMDCNYPTQDLAIEDIISHPNYEQKQQINDIALLRVTPITFNDKNIK

SEQ ID NO: 20682 - protein, 219 aa, Diabrotica virgifera
  misc_feature: Coding regions on vcDNA: vcDNA=SeqID_379; Strand=+; Position=275-935
  misc_feature: Homolog annotation: Hit_ID=XP_515638.1; Match level="QueryCoverage =98%, HitCoverage=11%, E-value=4e-54, Identity=47%"; Hit description =PREDICTED: RW1 protein [Pan troglodytes]
  misc_feature: Gene Ontology Annotation: Cellular component=integral to membrane; Biological process=positive regulation of body size
  misc_feature (173)..(173): Xaa can be any naturally occurring amino acid
MKFEPTFLDFKKRPFGIPHMEKVTLFNIDKNKSIDMTSISGSTVHFHSSFFADRNIPPKGNTSFNVVFLGREEGYIESDLYIHTSEGFLKYNVRGASTYSHYRIRPIGVKLPLNSTFAPLIFLHNPHLEPLQIVEVHGEGGGFHLELPNGESEGAKDLWKLDPHETKAIIRVXYNPEILQNYTAYVRIRLNKPDLTLVVPVEVEVTEDTEISIRAAMST

SEQ ID NO: 20683 - protein, 274 aa, Diabrotica virgifera
  misc_feature: Coding regions on vcDNA: vcDNA=SeqID_380; Strand=+; Position=1-825
  misc_feature: Homolog annotation: Hit_ID=NP_002257.1; Match level="QueryCoverage =100%, HitCoverage=74%, E-value=3e-83, Identity=41%"; Hit description= karyopherin alpha 2 [Homo sapiens] emb|CAC83080.1| karyopherin alpha 2 [Homo sapiens]
  misc_feature: Gene Ontology Annotation: Molecular function=nuclear localization sequence binding; Cellular component=nucleoplasm; Biological process= NLS-bearing substrate-nucleus import
  misc_feature: Pfam annotation: Pfam_ID=Arm; Match level="Score=157.4, E-value=3.2e -44, Copies=4"; Pfam description=Armadillo/beta-catenin-like repeat
RLLNHSDPEVQADTCWALSYLTDGPNEKIQAVLDTGLIERLVQLLYSEHGTVLTPALRAVGNIVTGNDQQTDCVINAGALNVLADLLQHSKLNIVKEAAWTVSNITAGNSEQIQKVIDAGILPPLLHVLQTGDFKSQKEASWAVTNFTSGGTISQLAKLVEAGALKPMCNLINSKDQKTVLVVLDGLNNILNAANKMGQVEKVAIMIEECGGLDGIEALQSHDNEKIYEKALSIIENYFSEGGTEDNNMPAPVTADGQMQFSSPTQVPNGGFSF

SEQ ID NO: 20684 - protein, 119 aa, Diabrotica virgifera
  misc_feature: Coding regions on vcDNA: vcDNA=SeqID_381; Strand=+; Position=46-405
KLYFILMTMKVLLLLAIFVPFVVGHDVKITELLSQEILRDVDVELLLKEMETIYLFEKKSSGNITAVLNEFIDKVLGNAGNYLIDHGYDSCHIPDTVLHLPITGTVSLKKGWVRRLGHD

SEQ ID NO: 20685 - protein, 101 aa, Diabrotica virgifera
  misc_feature: Coding regions on vcDNA: vcDNA=SeqID_382; Strand=+; Position=118-423
IRFFICSKINSNEVTLFLIEPETSGRRFFPILNILVYLSLFDLPTCPVSVFTHWQFLLSLDIVLSDAFYSFYKSIHFLFPLHSLSSYLCQLLHCTILTSSL

SEQ ID NO: 20686 - protein, 237 aa, Diabrotica virgifera
  misc_feature: Coding regions on vcDNA: vcDNA=SeqID_383; Strand=+; Position=128-841
  misc_feature: Homolog annotation: Hit_ID=XP_312131.1; Match level="QueryCoverage =86%, HitCoverage=89%, E-value=1e-41, Identity=42%"; Hit description =ENSANGP00000022131 [Anopheles gambiae]
KKFEVKMLKQQVFTRCLVPTVLAAVATDTKEKAVSDNKIDPKLCRPSELPLYTPDPIHNVKQIDDSESNQLEEVIRATRLKLVEINKEVEAYKRVGVEQFEKGKDELDWVVNYLRQEDNTLPKVGAIGIGGLTGLIFGLRGGFIKKTVYAAVGALGISAVCYPKEASEYSQVALTEGKKYAVVAYNFVHGVKKDDPPLELPSLPKLPTSLDEAWESVKSFVSSDSSEKTPEKSKDQQ

SEQ ID NO: 20687 - protein, 78 aa, Diabrotica virgifera
  misc_feature: Coding regions on vcDNA: vcDNA=SeqID_384; Strand=-; Position=542-778
  misc_feature: Homolog annotation: Hit_ID=ZP_00357698.1; Match level="QueryCoverage =88%, HitCoverage=41%, E-value=3e-17, Identity=63%"; Hit description =hypothetical protein Chlo02002738 [Chloroflexus aurantiacus]
PPIFFFSLFFFFFFFFFFFFLFFFLFFFFFFFFFFFFFNFFFFFFYRFLNVYLKYVTVINILLKNITFIILNNIIFFF

SEQ ID NO: 20688 - protein, 172 aa, Diabrotica virgifera
  misc_feature: Coding regions on vcDNA: vcDNA=SeqID_385; Strand=+; Position=91-609
  misc_feature: Homolog annotation: Hit_ID=XP_321841.1; Match level="QueryCoverage =98%, HitCoverage=100%, E-value=2e-82, Identity=91%"; Hit description= ENSANGP00000020957 [Anopheles gambiae]
  misc_feature: Gene Ontology Annotation: Molecular function=structural molecule activity; Cellular component=actin filament; Biological process =actin cytoskeleton organization and biogenesis
  misc_feature: Pfam annotation: Pfam_ID=ARPC4; Match level="Score=401.1, E-value =1.4e-117, Copies=1"; Pfam description=ARP2/3 complex 20 kDa subunit (ARPC4)
KHLKMSATLKPYLTAVRHTLTAAMCLDNFSSQVVERHNKPEVEVTTSKELLLNPVVISRNEKEKVFIEASVNSIRISIAVKQADEIEKILCKKFMRFMMMRAENFIVLRRKPIEGYDISFLITNFHTEQMYKHKLVDFVIHFMEEIDKEISEMKLAVNARARIVSEEFLKRF

SEQ ID NO: 20689 - protein, 197 aa, Diabrotica virgifera
  misc_feature: Coding regions on vcDNA: vcDNA=SeqID_386; Strand=-; Position=1-591
  misc_feature: Homolog annotation: Hit_ID=XP_314581.1; Match level="QueryCoverage =94%, HitCoverage=95%, E-value=1e-40, Identity=45%"; Hit description =ENSANGP00000018098 [Anopheles gambiae]
WKHIAKEFEARLNFPHCFGAVDGKYVQSIPPNGQGSYFYNYKGFHSMVLMAVVNANYEFIIYEFGVNGRICDGGVIEQTIFYNKLKENTLQIPVFDHLSGSDKMLSDVFIGVEAFALAPHFLKPFNQRELTNERKIFNYRLSRTRRVVENAFGILANRFRIFHTTINLNLKTVYIIVMTYCVLHNFFEKVICFQLYS

SEQ ID NO: 20690 - protein, 235 aa, Diabrotica virgifera
  misc_feature: Coding regions on vcDNA: vcDNA=SeqID_387; Strand=+; Position=367-1074
  misc_feature: Homolog annotation: Hit_ID=AAT42220.1; Match level="QueryCoverage =97%, HitCoverage=86%, E-value=4e-66, Identity=56%"; Hit description =transformer-2 [Bombyx mori]
  misc_feature: Gene Ontology Annotation: Molecular function=RNA binding; Cellular component=nucleus; Biological process=growth
  misc_feature: Pfam annotation: Pfam_ID=RRM_1; Match level="Score=91.2, E-value=2.7e- 24, Copies=1"; Pfam description=RNA recognition motif. (a.k.a. RRM, R
MADYSPRHEDSPREYKSRSHSRDRKVYRNGDKGKRSRSRSHSEKRYRSSKYSRSRSRSADYGRRSSSHSPMSSRKRHTGTRDNPKQSRCLGVFGLSVYTTEDELYHLMSKYGPVERVQVVIDAKTGRSRGFSFVYFENVEDAKVAKEQCTGMKLNGKSIRVDFSITERAHTPTPGIYMGKPTYKYSDRYDRRRDRGDRDDYYRSSRYRRSPSPYYSSSSRRRRYSRSRSYSPRRY

SEQ ID NO: 20691 - protein, 235 aa, Diabrotica virgifera; identical to SEQ ID NO: 20690
  misc_feature: Coding regions on vcDNA: vcDNA=SeqID_388; Strand=+; Position=185-892
  misc_feature: Homolog annotation: Hit_ID=AAT42220.1; Match level="QueryCoverage =97%, HitCoverage=86%, E-value=4e-66, Identity=56%"; Hit description =transformer-2 [Bombyx mori]
  misc_feature: Gene Ontology Annotation: Molecular function=RNA binding; Cellular component=nucleus; Biological process=growth
  misc_feature: Pfam annotation: Pfam_ID=RRM_1; Match level="Score=91.2, E-value=2.7e- 24, Copies=1"; Pfam description=RNA recognition motif. (a.k.a. RRM, R

SEQ ID NO: 20692 - protein, 235 aa, Diabrotica virgifera
  misc_feature: Coding regions on vcDNA: vcDNA=SeqID_389; Strand=+; Position=213-920
  misc_feature: Homolog annotation: Hit_ID=AAT42220.1; Match level="QueryCoverage =97%, HitCoverage=86%, E-value=9e-65, Identity=55%"; Hit description =transformer-2 [Bombyx mori]
  misc_feature: Gene Ontology Annotation: Molecular function=RNA binding; Cellular component=nucleus; Biological process=growth
  misc_feature: Pfam annotation: Pfam_ID=RRM_1; Match level="Score=91.2, E-value=2.7e- 24, Copies=1"; Pfam description=RNA recognition motif. (a.k.a. RRM, R
  misc_feature (195)..(195): Xaa can be any naturally occurring amino acid
  misc_feature (222)..(222): Xaa can be any naturally occurring amino acid
MADYSPRHEDSPREYKSRSHSRDRKVYRNGDKGKRSRSRSHSEKRYRSSKYSRSRSRSADYGRRSSSHSPMSSRKRHTGTRDNPKQSRCLGVFGLSVYTTEDELYHLMSKYGPVERVQVVIDAKTGRSRGFSFVYFENVEDAKVAKEQCTGMKLNGKSIRVDFSITERAHTPTPGIYMGKPTYKYSDRYDRRRDXGDRDDYYRSSRYRRSPSPYYSSSSRRXRYSRSRSYSPRRY

SEQ ID NO: 20693 - protein, 508 aa, Diabrotica virgifera
  misc_feature: Coding regions on vcDNA: vcDNA=SeqID_390; Strand=+; Position=1-1524
  misc_feature: Homolog annotation: Hit_ID=XP_318550.1; Match level="QueryCoverage =95%, HitCoverage=50%, E-value=9e-56, Identity=32%"; Hit description =ENSANGP00000020240 [Anopheles gambiae]
  misc_feature: Pfam annotation: Pfam_ID=rve; Match level="Score=95.8, E-value=1.1e -25, Copies=1"; Pfam description=Integrase core domain
EMLSIVNACLKFHQYIFGRVDVTIETDHKPLVGVFNKPLVDAPARLQRMLVMLQPYSFTIVYKKGKDMFFADALSRAFPKSYDETFENKFSEIESQLLSITESFPISNCKIREFQKQTAEDPHLIQLMKLITEGFPDSKYINQEFQKYLPFKDELSVVQGIIVKNNKLLVPKHLREETLDKLHMSHQGIQKTKLLARQYFFWPGMSRDIENVVKCCNICLSERKCNQREPLLPHTIPDLPWDKVGIDLFVFNSQNYILVVDYYSKFVEMSALTSQTSNRVIQFLKQIFCRHGIPTVVFSDNGPCFSSMEFSRFAAEWGFSHKTSSPHFPQSNGQVERFVQTAKSMLKKAFKSNKDPYLCILDLMNTPISDKVPSPAELLYSRKVRTTFPVLKSNLRPQVVKNNVRKELTQRQNQYKKYYDKNTKELPVLKINDQVKVKNFNESNKEKWLDGIVVEKLSNPRSYKIRLCGTNNVVVRNRAHLIKVELKNVNSGEAPCSYNQFQYDNAPS

SEQ ID NO: 20694 - protein, 191 aa, Diabrotica virgifera
  misc_feature: Coding regions on vcDNA: vcDNA=SeqID_391; Strand=+; Position=362-937
  misc_feature: Homolog annotation: Hit_ID=XP_394608.1; Match level="QueryCoverage =100%, HitCoverage=93%, E-value=1e-102, Identity=94%"; Hit description=similar to CG12530-PA [Apis mellifera]
  misc_feature: Gene Ontology Annotation: Molecular function=signal transducer activity; Cellular component=plasma membrane; Biological process =signal transduction
  misc_feature: Pfam annotation: Pfam_ID=Ras; Match level="Score=304.1, E-value=2.2e -88, Copies=1"; Pfam description=Ras family
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCQKTPFLLVGTQVDLRDDGATIEKLAKNKQKPISIEQGEKLAKELKAVKYVECSALTQKGLKNVFDEAILAALEPPEPVKRKKCVIL

SEQ ID NO: 20695 - protein, 170 aa, Diabrotica virgifera
  misc_feature: Coding regions on vcDNA: vcDNA=SeqID_392; Strand=+; Position=89-601
  misc_feature: Homolog annotation: Hit_ID=AAK83039.1; Match level="QueryCoverage =100%, HitCoverage=100%, E-value=1e-91, Identity=98%"; Hit description=calcineurin B [Bombyx mori]
  misc_feature: Gene Ontology Annotation: Molecular function=calcium-dependent protein serine/threonine phosphatase activity; Cellular component =synaptic vesicle; Biological process=synaptic vesicle fusion
  misc_feature: Pfam annotation: Pfam_ID=efhand; Match level="Score=108.7, E-value =1.5e-29, Copies=4"; Pfam description=EF hand
MGNESSLPMELCSNFDADEIRRLGKRFRKLDLDNSGALSIDEFMSLPELQQNPLVQRVIDIFDADGNGEVDFKEFIQGVSQFSVKGDKLSKLRFAFRIYDMDNDGYISNGELFQVLKMMVGNNLKDTQLQQIVDKTILFADKDEDGKISFEEFCNVVGNTDIHKKMVVDV

SEQ ID NO: 20696 - protein, 480 aa, Diabrotica virgifera
  misc_feature: Coding regions on vcDNA: vcDNA=SeqID_393; Strand=+; Position=10-1451
  misc_feature: Homolog annotation: Hit_ID=EAL40075.1; Match level="QueryCoverage =99%, HitCoverage=95%, E-value=1e-105, Identity=41%"; Hit description= ENSANGP00000025519 [Anopheles gambiae str. PEST] ref|XP_557100.1| ENSANGP00000025519 [Anopheles gambiae s
  misc_feature: Gene Ontology Annotation: Cellular component=endoplasmic reticulum; Biological process=aging
  misc_feature: Pfam annotation: Pfam_ID=Glyco_hydro_1; Match level="Score=386.5, E -value=3.4e-113, Copies=1"; Pfam description=Glycosyl hydrolase family 1
  misc_feature (451)..(451): Xaa can be any naturally occurring amino acid
MMSPKHLTLLRYLIYICLTFNLVAAESQELHYNRKFPDDFLFGAATSAYQIEGAWNVDGKGESIWDTYVHRVPSPIKNGDTGDIACDSYYKYKEDVKLAADLGIKLYRFSISWPRVLPTGKADNISEAGLNYYKNLVKEIRNYGMIPVATIYHWDLPQKLYDEGIHWSNVSLVPYIVDYARIVIKALPDVGYWVTINEPKQVCRIGYGATMLAPALNSSGLLEYDCAYVLVKSHAAIYRMYKKEFPDYKAKMSIVIDCQWIEPQTNAPKDKDAAERQLQFECGLYFNPIFNNGDWPKVVKDRVDFRSLKANLTTSRLRAFTEEEKIYNKGTYDFLGLNHYYTMLARDEAEEAPFNETNYENDVGTVDSFDPKWVVESNGLFVIVPGGVFKILKWIKQNYGDQDIIITEIGMSDNGTYLNDKDRIDFYTEYFCNILEAMDEDKSKGIILWSXMDNFEWIVVHCSLGNIHVDFQNPTEPKPP

SEQ ID NO: 20697 - protein, 224 aa, Diabrotica virgifera
  misc_feature: Coding regions on vcDNA: vcDNA=SeqID_394; Strand=+; Position=238-912
  misc_feature: Homolog annotation: Hit_ID=XP_312241.1; Match level="QueryCoverage =90%, HitCoverage=44%, E-value=3e-13, Identity=26%"; Hit description =ENSANGP00000010785 [Anopheles gambiae]
MEGEFFRINNLKPRPTSSSNGLWIQFLLPLSVIVSVFKHSITSTPTYKLASLICMGMIFVSLIISMQKYRKQRLKVFSLWTILALAATSALFHICLHKDVPFSVFGGFFSTVVYFQIYKFVLKHFKESFTLGEAGIICQGLTLMLYFTILNVVNHTTRPLPFKSNIQVATLIIQLGLVGILAIAFCSYYFKIKNIVPFYTISSIIIVGGIIIPLHVLLQRSPVL

SEQ ID NO: 20698 - protein, 453 aa, Diabrotica virgifera
  misc_feature: Coding regions on vcDNA: vcDNA=SeqID_395; Strand=+; Position=96-1457
  misc_feature: Homolog annotation: Hit_ID=AAB88192.1; Match level="QueryCoverage =99%, HitCoverage=96%, E-value=1e-112, Identity=46%"; Hit description= epoxide hydrolase [Trichoplusia ni]
  misc_feature: Gene Ontology Annotation: Molecular function=epoxide hydrolase activity
  misc_feature: Pfam annotation: Pfam_ID=EHN; Match level="Score=215.3, E-value=1.2e -61, Copies=1"; Pfam description=Epoxide hydrolase N terminus
MFLLLLFSVIAYFVYKKIKRLMGHPPLPKKLEETWWGPGAPGSVKPEVKPFTISVSDEVLKDLQYRLDHHRPFTPPLEGIVHEYGINTNLVKTIVDYWRTKYNWREREKYLNQYPQFTVNIQGLDLHYIHIKPKVSSDIKVLPLLILHGWPGSVREFYELFPLLTTPQKGRNFVFEVIAPHIPGFGFSKPAVRPGLSPDNIALVFKNMMHHLGFQKFYVQGGDFGSIILRNMVVLYPEVIEGFHCNFPVVTSARHYIKLFLASLFPSLSSWYVRPEHRNKVLPMKQGFERTLRETGYLHEQATKPDTLGVAMNESPIGLAAYILEKFVSATNHQKALLEEGGLSESYTYDSLLDNIMFYWLNSAATTSFRLYAETFNKATNRKAILQHPIEIPTAVARYKYDFYSPDGAINDIFVNCVHFADIDGGHFSAFEKPEVFANDLYDGIEKILKLKN

SEQ ID NO: 20699 - protein, 675 aa, Diabrotica virgifera
  misc_feature: Coding regions on vcDNA: vcDNA=SeqID_396; Strand=+; Position=14-2038
  misc_feature: Homolog annotation: Hit_ID=AAM97895.1; Match level="QueryCoverage =98%, HitCoverage=68%, E-value=1e-92, Identity=34%"; Hit description =relish R6 isoform [Aedes aegypti]
  misc_feature: Gene Ontology Annotation: Molecular function=transcription factor activity; Cellular component=nucleus; Biological process=lymph gland development
  misc_feature: Pfam annotation: Pfam_ID=RHD; Match level="Score=145.3, E-value=1.4e -40, Copies=1"; Pfam description=Rel homology domain (RHD)
MLTPPSSSEDSPHSTYLVASPSSNTFEYDNYEYAPVQPIIYPKPTVIVDPNLLTVKMEGPTTPSATLHFVEQPTDRFRFRYKSEMAGTHGSLTGINSDKSRKPTYPTVELRNCGNHDKVVIRCSIYQANANPKGFYPHAHRLMMKRGREEFDDPHDVEVGHEDGFRAVFQGMGIIHTAKRNLVTELVRKKVQLQEEHVARTENRRGLTQKEVVEIKGLAESESKSINLNIVCLRFDAYIKKNGILFPLCEPIFSHSINNLKSALTGDLKIVRLDHVVSPAKGNKEVFILVERVTKKNIKIRFYELDDDENVVWEGWGQFNDLDVHHQYAIVFKTPKYRDENITSPVNVFVELVRPSDQARSEAREFRYVPNKNMAKPGQKRARYDYYSSSSYDSSNVGSEELPAVINTLQIGQDSHMSFNNIPSGLSDEIKRALTDMNSDEFQQLHDAHADEYLTLLENLATDGVNANSMPVRKQRRDIQIQEPIKMEVSNEDKRMAIMVVSELRSFIRTTHTAANAITILNKYFNADNCTNALHVCAALRDNDSAMLLLKVIAVYRVFHLLDKTNDQNLTALHIAVMCHNKDLTKALVLCNSKLSVTDSNLNTVLHIAIKSNVPIEIFETLLRPSRYTSVDQVKGFIDMVNLDGNTALMMAVEANKLAYVQLLCFKMQMKIKNS

SEQ ID NO: 20700 - protein, 460 aa, Diabrotica virgifera
  misc_feature: Coding regions on vcDNA: vcDNA=SeqID_397; Strand=+; Position=91-1473
  misc_feature: Homolog annotation: Hit_ID=CAG84142.1; Match level="QueryCoverage =85%, HitCoverage=77%, E-value=6e-64, Identity=38%"; Hit description =unnamed protein product [Yarrowia lipolytica CLIB99] ref|XP _500209.1| hypothetical protein [Yarrowia lipol
  misc_feature: Gene Ontology Annotation: Molecular function=ATP binding; Cellular component=cellular_component unknown; Biological process=signal transduction
  misc_feature: Pfam annotation: Pfam_ID=Pkinase; Match level="Score=86.4, E-value =7.8e-23, Copies=1"; Pfam description=Protein kinase domain
MVKFFSFLNVAIPLVVLWYFINYKGKAQKKKIHRVEIEPLQIKEESLPKQVLWKPSGRCQSLYTMKLSPSKDTSLLDLDDIQKIRYIENRESQEDEKDYNTGGYMPINIGDILKGQYKVCRKLGWGHFSTVWLCQNLLNDGPTYVALKICKSAQMFTVVAQDEIKLLRDTKLIDPSHLGYKHIVQMVDTFKLLSINGVHTAISMEIMGPSLLHLLVQSDFRGIHLCGVKRIITQVLKGLTYLHEACRIIHTDIKPENILIKVDENYIKSIIGKTEKFTELGIDMPRSYVAADCWIDRERSLRDSDENILSKFEEQRGQSYPYDKFLGELPDFRRRHGEPRLNAPMWVSPNIEIKIADLGNACWEEHHFSSEIQTRQYRALEVILGAGYSFPADIWSVGCMGFEMATGEMLFSPKGDREPSANLDHLCLIWETLGSIPQYITEKWYTRTSVLYKWSIAGYR

SEQ ID NO: 20701 - protein, 251 aa, Diabrotica virgifera
  misc_feature: Coding regions on vcDNA: vcDNA=SeqID_398; Strand=+; Position=425-1180
  misc_feature: Homolog annotation: Hit_ID=NP_523856.2; Match level="QueryCoverage =74%, HitCoverage=54%, E-value=1e-14, Identity=28%"; Hit description =CG16910-PA [Drosophila melanogaster] gb|AAF47273.2| CG16910-PA [Drosophila melanogaster]
  misc_feature: Gene Ontology Annotation: Biological process=antibacterial polypeptide induction
  misc_feature: Pfam annotation: Pfam_ID=zf-C2H2; Match level="Score=19.2, E-value =0.013, Copies=1"; Pfam description=Zinc finger, C2H2 type
MMANINRGVELSSVISIASFTPDMSSEEVQKKIAHIIDENIRLKISIKSQREESLHMTITSLKSQMEASAEEVNTLRTQLGETQNALTWMEATRSRAYSQIRELTDELSEVRSQLESLQSQTQERSRDSELDHEEMSVLKMQMDVYKTDFEEERRAREVMKGEKDRLEEDLQNIQRRNQQLQEEIELLRREGNNFVIPPRTSPPRVEQIRQPSAPSPSRNELLRCPKCHFAFNDLVHLETHVYRCLDMELF

SEQ ID NO: 20702 - protein, 271 aa, Diabrotica virgifera
  misc_feature: Coding regions on vcDNA: vcDNA=SeqID_399; Strand=+; Position=100-911
  misc_feature: Homolog annotation: Hit_ID=NP_725204.1; Match level="QueryCoverage =98%, HitCoverage=25%, E-value=1e-102, Identity=69%"; Hit description= CG8625-PC, isoform C [Drosophila melanogaster] ref|NP_725203.1| CG8625-PB, isoform B [Drosophila
  misc_feature: Gene Ontology Annotation: Molecular function=helicase activity; Cellular component=nucleus; Biological process=chromatin modeling
  misc_feature: Pfam annotation: Pfam_ID=SNF2_N; Match level="Score=16.1, E-value =1.7e-09, Copies=1"; Pfam description=SNF2 family N-terminal domain
  misc_feature (252)..(252): Xaa can be any naturally occurring amino acid
MSQTEGSTEASVSASEPMEEAENSELAQNEESSSDTTSKGEEFEVKVASDRGKRFDYLLKQTEIFSHFMNQTKSPSKPKTGRPKKEKSDTSDLRHRKTEQEEDEELLAETNLKTKTTTRFDASPPYIKHGEMRDYQVRGLNWMISLYEHGINGILADEMGLGKTLQTISLLGYMKHYKSTPGPHIVIVPKSTLSNWMNEFEKWCPTLRAVCLIGDQEARSSFIRDTMMPGEWDVCVTSYDMCIKEKSVFKKXNWRYMVIDEAHRIKMKNLS

SEQ ID NO: 20703 - protein, 322 aa, Diabrotica virgifera
  misc_feature: Coding regions on vcDNA: vcDNA=SeqID_400; Strand=+; Position=39-1007
  misc_feature: Homolog annotation: Hit_ID=EAA08682.2; Match level="QueryCoverage =51%, HitCoverage=71%, E-value=9e-28, Identity=38%"; Hit description =ENSANGP00000013423 [Anopheles gambiae str. PEST] ref|XP_562755.1| ENSANGP00000013423 [Anopheles gambiae st
MAEGQVSNANHEELIRKVDDLEKRLQTKDAEIQVYKMLMSQMEEEAATAKKYKALHEKQTQDVDGLRTESEKTLTKAKSMIFEKTKIIKNQELQIEAFTQQIESLREVVRITKDLLEIRNMEVKQLEIKIESIEGKQKAEKERYDLMHKKLEMMIRHNAELKREYETQLCLFTALRERYSERELAKDVIENLKTPTLKIASQNEDNTTQKEISVVPNQEKPIESTVEDKQKSAAEQNTTTTVESAPPTNQPESDKVVPVDQNKNATPTEIVPKIEDSIPVPNEVVPEPSKLENNVLSQISRQKLTIIQIRLNRSSRTSYYCT

SEQ ID NO: 20704 - protein, 77 aa, Diabrotica virgifera
  misc_feature: Coding regions on vcDNA: vcDNA=SeqID_401; Strand=-; Position=669-902
FRSAGTALSYSPFSILAIALAFCASFKCVITIVGEFDIVWFYFSTLARFLTKIDFLKFFNFDIYQIRTTLQFYSIAI

SEQ ID NO: 20705 - protein, 376 aa, Diabrotica virgifera
  misc_feature: Coding regions on vcDNA: vcDNA=SeqID_402; Strand=+; Position=135-1265
  misc_feature: Homolog annotation: Hit_ID=NP_724706.2; Match level="QueryCoverage =69%, HitCoverage=68%, E-value=8e-61, Identity=45%"; Hit description =CG14767-PC, isoform C [Drosophila melanogaster] ref|NP_724705.1| CG14767-PB, isoform B [Drosophila
  misc_feature: Gene Ontology Annotation: Cellular component=integral to membrane
  misc_feature: Pfam annotation: Pfam_ID=Mtp; Match level="Score=21.3, E-value=1.6e -09, Copies=1"; Pfam description=Golgi 4-transmembrane spanning transp
MFTMRLKLGSDRNKEWTSCFCLHVRTATILFGIWHLVLHILALTVLALMMRNHHVILQKNEDLQTDFLPTPLSKKDDDNPYYLPTTQDSRKIYTSDIDMGALMTVCTLSITLLMVYGTIKGKPTHVLPFFCLQLFDFAITALTATGYFCYLRSAHRLIAENWNLPLRQELLQLSPQVLTLIVLLAFLFSMLWKAYWISVVWRCYKYLTFRQQTNRNAIRYIIPESDHRGITDPDYPNLFRDQEAVFGVLKQTPPPSYQDVMDEQPPPYPCTTQVVQETPNRFRIIQNTTENQEPSTSAEAVNVTPVIETSAEVSPAVVPESPVSQQPEEPELQPEVGKAEAVEIVVEADEPKKETEQDPKVESPTKKVAVVPQNEN

SEQ ID NO: 20706 - protein, 67 aa, Diabrotica virgifera
  misc_feature: Coding regions on vcDNA: vcDNA=SeqID_403; Strand=+; Position=315-518
CQCHYVRSWTLSVTFSPQQCMLTLIPYYIYLMYYRLLINIPCIFIYQQRYYLYYFKVRMLHLSWTSL

SEQ ID NO: 20707 - protein, 80 aa, Diabrotica virgifera
  misc_feature: Coding regions on vcDNA: vcDNA=SeqID_404; Strand=-; Position=156-398
TTLPILLKIYLITNHRRMRQPRSPIADQTRPGPTIPTTLERTLLLGDRGHVTSAMKCIILLNSVATFSRYLLFWYIFDII

SEQ ID NO: 20708 - protein, 56 aa, Diabrotica virgifera
  misc_feature: Coding regions on vcDNA: vcDNA=SeqID_405; Strand=+; Position=85-255
GGSRPVLTGNHILTQTRETSFVTINLNSIIVSISNLVTQRLHRTKVFVSSCHLWIC

SEQ ID NO: 20709 - protein, 495 aa, Diabrotica virgifera
  misc_feature: Coding regions on vcDNA: vcDNA=SeqID_406; Strand=+; Position=2-1485
  misc_feature: Homolog annotation: Hit_ID=S59872; Match level="QueryCoverage=99%, HitCoverage=58%, E-value=0.0, Identity=69%"; Hit description =replication licensing factor MCM4 - fruit fly (Drosophila melanogaster) gb|AAB35644.1| replication
  misc_feature: Gene Ontology Annotation: Molecular function=electron transporter activity; Cellular component=pre-replicative complex; Biological process=mitotic spindle assembly
  misc_feature: Pfam annotation: Pfam_ID=MCM; Match level="Score=-229.4, E-value =0.0063, Copies=1"; Pfam description=MCM2/3/5 family
  misc_feature (477)..(477): Xaa can be any naturally occurring amino acid
  misc_feature (483)..(483): Xaa can be any naturally occurring amino acid
LVRNPRRGRNTPAKSISTVDTPMRFGAPRNDIDAQSEIPSSPAHSLAPTSPGTGLAMSEIDLSSPLNYGTPSSLGSIRTPRSGIRGTPIRMRPDVRSDKRIRQVNVGGDAALEAIPETQESDSTAPHLVIWGTNVSVAECKEKFKQFILRFIDPNAEEDEITDDMNVNEPLYIQKLEEIHTLDEPFLSVNCAHLETFDANLYRQLVCYPQEVIPTFDMCVNEMFYERYPAAVLEHQIQVRPFNAEKTKNMRALNPEDIDQLITISGMVIRSSNIMPEMREAFFKCIVCQFTSTVEIDRGRITEPTLCSSCNTNHTFTLVHNRSQFTDKQMIKLQESPDDMPAGQTPHTVVLFAHNDLVDAVQPGDRVTVTGIYRAQPLQINPRQRNIRSVYKTHIDVLHFRKIDQRRIYEEEDGKDRRFTPERVELLNLLSQKADIYERLSRAIAPSIYENQDVKKGILLQLFGGTKKTFVTSGRTXFRAEIXILLCGDPGTSKS

SEQ ID NO: 20710 - protein, 201 aa, Diabrotica virgifera
  misc_feature: Coding regions on vcDNA: vcDNA=SeqID_407; Strand=+; Position=228-833
  misc_feature: Homolog annotation: Hit_ID=EAA11261.3; Match level="QueryCoverage =90%, HitCoverage=29%, E-value=5e-38, Identity=43%"; Hit description =ENSANGP00000017150 [Anopheles gambiae str. PEST] ref|XP_556888.1| ENSANGP00000017150 [Anopheles gambiae st
  misc_feature: Gene Ontology Annotation: Molecular function=multicopper ferroxidase iron transport mediator activity; Cellular component=plasma membrane; Biological process=high affinity iron ion transport
  misc_feature: Pfam annotation: Pfam_ID=Cu-oxidase_3; Match level="Score=130.6, E -value=3.7e-36, Copies=1"; Pfam description=Multicopper oxidase
MTAVPNLALVRLAVFLGMVAATVTLLYLAPVPNQSIKSCDRPCHELDWPMICRFKLTIEKLPTSVICQECQNSVDCPYCTSQADLPQELTLINRQLPAPTFHVCHNDILIVDVVNKLQTESLTMHWRGQNNEETPFMDGVPLITQCPVGPYTTYQYKFRASSPGTHSYHAFSDFERTNGLHGALVIRKAEKIEPNIYKLRC

SEQ ID NO: 20711 - protein, 317 aa, Diabrotica virgifera
  misc_feature: Coding regions on vcDNA: vcDNA=SeqID_408; Strand=-; Position=157-1110
  misc_feature: Homolog annotation: Hit_ID=CAA10770.1; Match level="QueryCoverage =90%, HitCoverage=83%, E-value=1e-43, Identity=34%"; Hit description =reverse transcriptase-like [Bos taurus]
  misc_feature: Gene Ontology Annotation: Molecular function=molecular_function unknown; Cellular component=cellular_component unknown; Biological process=biological_process unknown
YCQTAKIRVDNQDTQDIKIQRGVRQGCVLSPLLFNVYSEAVFQEALSNSIEGISINGEVLNNLRFADDTVIITDNNNDLQNVMQRLNERCHEYGLKMNLKKTKCMIITKSAQVNIQLTIEDTVIESVDNYKYLGTWITSNVDQTKEIKTRIEIACASFIKLKKFLCCQDIRLELRLRMLRCYVFSTLLYGLEAWTLKQVHLNKLAAFEFWCYRRILRISWIQRMSNVEVTRRIGNQPEIILTIKRQKLEYLGHVMRGQKYSLLQLVMQGKIRGKRNVGRRRTSWLKNLREWFECSSAELFRAAVNRVRIAMMISNLR

SEQ ID NO: 20712 - protein, 312 aa, Diabrotica virgifera
  misc_feature: Coding regions on vcDNA: vcDNA=SeqID_409; Strand=-; Position=3-938
  misc_feature: Homolog annotation: Hit_ID=CAA10770.1; Match level="QueryCoverage =77%, HitCoverage=70%, E-value=2e-31, Identity=34%"; Hit description =reverse transcriptase-like [Bos taurus]
  misc_feature (191)..(191): Xaa can be any naturally occurring amino acid
  misc_feature (219)..(219): Xaa can be any naturally occurring amino acid
YPTSDSRRNFKKKKVFQGALSDSIEGISLNGEVLNNLRFADDTVIITDNNNDLKNVMQRLNERCHEYGLKMNLKKTKYIIMTKSAHANIQLTIEDTVIESVDNYKYLGTWITSNEDQTKEIKTRIEIARASFTKLKKFLCCRDIRLELRLRMLRCYVFSTLLYGLEAWTLKQVHLNKWAVFEFLCYRRILXISRIQRISNVEVTRRIGNQPEILTIKRXKLKYLGHVMKGQKYSLLQLIMQGKIRGKRNVGRRRTSWLKNLREWFECSSAEIFRAAVNRVRIAMMISPFDRRWHFKKKKEEKQESTFLCQCN

SEQ ID NO: 20713 - protein, 163 aa, Diabrotica virgifera
  misc_feature: Coding regions on vcDNA: vcDNA=SeqID_410; Strand=+; Position=846-1338
  misc_feature: Homolog annotation: Hit_ID=AAC46947.1; Match level="QueryCoverage =96%, HitCoverage=47%, E-value=4e-31, Identity=44%"; Hit description =mariner transposase gb|AAA28265.1| mariner transposase
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=25.4, E -value=1.2e-06, Copies=1"; Pfam description=Transposase
  misc_feature (41)..(41): Xaa can be any naturally occurring amino acid
  misc_feature (51)..(51): Xaa can be any naturally occurring amino acid
  misc_feature (66)..(66): Xaa can be any naturally occurring amino acid
  misc_feature (78)..(78): Xaa can be any naturally occurring amino acid
RTCNTEAYLRLLKRNQKMLLRCFINVNETCIHWYIPETKEXSKQWTLSREXKTVLSTGKAIATVFXDTQGVIYVDFLXEDKTVTELYYTKLLGRFDVKLQRNNPNWRKKKVLFHNANTAAHTSAVAMALLGYELLSHPLYSSYLTPNDFFLFPSLKRSVLNPL

SEQ ID NO: 20714 - protein, 273 aa, Diabrotica virgifera
  misc_feature: Coding regions on vcDNA: vcDNA=SeqID_411; Strand=+; Position=109-927
  misc_feature: Homolog annotation: Hit_ID=EAA07068.2; Match level="QueryCoverage =91%, HitCoverage=48%, E-value=1e-93, Identity=69%"; Hit description =ENSANGP00000018445 [Anopheles gambiae str. PEST] ref|XP_559227.1| ENSANGP00000018445 [Anopheles gambiae st
  misc_feature: Gene Ontology Annotation: Molecular function=protein binding; Cellular component=Golgi vesicle; Biological process=intracellular protein transport
  misc_feature: Pfam annotation: Pfam_ID=Clat_adaptor_s; Match level="Score=-64.6, E -value=0.062, Copies=1"; Pfam description=Clathrin adaptor complex small chain
MVLIAAAVCTKAGKTIVSRQFVEMTKARIEGLLAAFPKLIPTGTQHTFVETDSVRYVYQPLEKLYMVLITTRASNILEDLETLRLFARVIPEYCKSLDENEIAENAFSLIFAFDEIVALGYRESVNLSQIRTFVEMDSHEEKVYQAVRQTQEREAKNMMREKAKELQRQKIEAAKKGGKTSFGSSGGFGSSTGYTPTPSVGDVANQTNDVKTSSYTPAPAQKPRGMKLGGKGRDVESFVDQLKSEGENVITPKQNSISQPGTAPAIKTDIDDV

SEQ ID NO: 20715 - protein, 391 aa, Diabrotica virgifera
  misc_feature: Coding regions on vcDNA: vcDNA=SeqID_412; Strand=+; Position=26-1201
  misc_feature: Homolog annotation: Hit_ID=CAA77014.1; Match level="QueryCoverage =97%, HitCoverage=98%, E-value=1e-130, Identity=56%"; Hit description= chitinase [Phaedon cochleariae]
  misc_feature: Gene Ontology Annotation: Molecular function=chitinase activity; Cellular component=extracellular space; Biological process=response to bacteria
  misc_feature: Pfam annotation: Pfam_ID=Glyco_hydro_18; Match level="Score=420.6, E -value=1.9e-123, Copies=1"; Pfam description=Glycosyl hydrolases family 18
  misc_feature (382)..(382): Xaa can be any naturally occurring amino acid
MKVLVLLSVLSAFLVCQTSGAEKRVVCYFASWTIYRAGKGAFDVSNIDPSLCTHINFAFLGLNEDGSIHILDSWESSDAGGHEGFKHLVELKKTNPDLKVCVSMGGWNEGSKQYSAVASDPAKRVKLADEVLAFIENWGFDGFDLDWEYPGLRGGNETIDKENYVELLKALSDVLEPKGYLLSVATAGAVEKIDVGFDVSVINELVDMINVMVFDFHGAFENFVGHVSPLFPAQVDYEYEANSTYNVDTGIQHWILSGADPAKINLGIVTYGRTYTLADKTNTSLYANVTGGGNTGPYSAQSGYLGYNEICEFYLNSTYVWDDQQKVPHRYWDDQWVGFEDERSITEKVNYARDNELGGMMVWSLDYDDFRGTCGEKYILLXAINKIHDQF

SEQ ID NO: 20716 - protein, 80 aa, Diabrotica virgifera
  misc_feature: Coding regions on vcDNA: vcDNA=SeqID_413; Strand=-; Position=844-1086
ILPSRTSFGSSLSRSTNRWWLYNMDACSFSLEMNHFGLDTLFSDGSSKPWFRSFSTFLNHNVYSPEATFLWHLNTIYYFY

SEQ ID NO: 20717 - protein, 459 aa, Diabrotica virgifera
  misc_feature: Coding regions on vcDNA: vcDNA=SeqID_414; Strand=+; Position=1-1381
  misc_feature: Homolog annotation: Hit_ID=NP_037125.1; Match level="QueryCoverage =99%, HitCoverage=39%, E-value=1e-107, Identity=41%"; Hit description= n-arginine dibasic convertase 1 [Rattus norvegicus] sp|P47245|NRDC _RAT Nardilysin precursor
  misc_feature: Gene Ontology Annotation: Molecular function=signal transducer activity; Cellular component=soluble fraction; Biological process =cell-cell signaling
  misc_feature: Pfam annotation: Pfam_ID=Peptidase_M16_C; Match level="Score=71.9, E -value=1.7e-18, Copies=1"; Pfam description=Peptidase M16 inactive domain
  misc_feature (30)..(30): Xaa can be any naturally occurring amino acid
  misc_feature (76)..(76): Xaa can be any naturally occurring amino acid
  misc_feature (386)..(386): Xaa can be any naturally occurring amino acid
  misc_feature (405)..(405): Xaa can be any naturally occurring amino acid
  misc_feature (449)..(449): Xaa can be any naturally occurring amino acid
EKFPAENDFDSFIKKRGGTDNASTDTETTXYYFECLEKKLHEALDKFAQFFISPLMKKGAMTREREAIESEFQMAXPSDPHRKEQLLLQLAKPESPVNAFGWGNLKTLRDDIDDDKLYEGVHAFRKRHYSAHRMTLAIQARLPLDTLQEYVVGCFSNVPNSHLDKDDFSAFKEGVFDTPEFSRIYYIKPLQQVIKLDLNWSLPSLKHMYKSKPMGYVSCLIGDEGKGSLLSYLKSKSWATSMQAGNEDSGSEHNSMYAIFNVSIVLTENGLKQIYSVIEAVFSYINMLRNVGPQRRIFDEQKLIADTTFRFAAELTPVDNVENLCEAMQFYPPEDYLAGSELFYEYDPKAITMVVDSLVPKKVNIMVTTKDLPDGLVFDKTEKWVXAEYTAIDIPKDLITQWGNXKPYSELNIPPVNPYLSTNFSILPKSPKHPDYPQKIMDTPRVEMXYRKDEKVQLP

SEQ ID NO: 20718 - protein, 328 aa, Diabrotica virgifera
  misc_feature: Coding regions on vcDNA: vcDNA=SeqID_415; Strand=+; Position=198-1182
  misc_feature: Homolog annotation: Hit_ID=BAB86852.1; Match level="QueryCoverage =92%, HitCoverage=68%, E-value=1e-150, Identity=84%"; Hit description= beta-tubulin [Bombyx mori]
  misc_feature: Gene Ontology Annotation: Molecular function=structural constituent of cytoskeleton; Cellular component=tubulin; Biological process =microtubule-based process
  misc_feature: Pfam annotation: Pfam_ID=Tubulin; Match level="Score=362.7, E-value =5e-106, Copies=1"; Pfam description=Tubulin/FtsZ family, GTPase domain
  misc_feature (267)..(267): Xaa can be any naturally occurring amino acid
MREIVHVQVGQCGNQIGSKFWEIISDEHGIDPQGRYVGDSQLQLDRINVYYTEASGGNYVPRAILVDLEPGTMDSARSGPYGALFRPDNFVFGQSGAGNNWAKGHYTEGAELVDAVMDVIRKESESCDCLQGFQLAHSLGGGTGSGMGTLLIAKIREEYPDRIMNTFSVVPSPKVSDTVVEPYNATLSVHQLIENTDETYCIDNEALYDIGMHTLKLPSPSYGDLNYLVSLTMSGVTTCLRFPGQLNADLRKLAVNMVPFPRLHFFXPGFVPLTPKQSIKYRALTVAKLHNRCLMQNMMVACDLPRKWKGNFKKFAPRVSPRVTLFPL

SEQ ID NO: 20719 - protein, 441 aa, Diabrotica virgifera
  misc_feature: Coding regions on vcDNA: vcDNA=SeqID_416; Strand=+; Position=59-1384
  misc_feature: Homolog annotation: Hit_ID=XP_313023.1; Match level="QueryCoverage =92%, HitCoverage=97%, E-value=1e-149, Identity=64%"; Hit description= ENSANGP00000011707 [Anopheles gambiae]
  misc_feature: Gene Ontology Annotation: Cellular component=cytosol; Biological process=aspartate catabolism
  misc_feature: Pfam annotation: Pfam_ID=Aminotran_1_2; Match level="Score=309.4, E -value=5.6e-90, Copies=1"; Pfam description=Aminotransferase class I and II
SKRFLINARQLRSAILNCIYTFVSRFKIQVPETMSWFSEVELGPPVEVFALTKAYNDDTFDKKVNLGVGAYRNTEGKPWVLPVVRTAEKALANDESLNKEYLPILGLEAFSTAATTMLLGQDSPAIREGRAFGVQSLSGTGALRVGAEFLARVLGKKTFYISDPTWENHKLLFKNAGFTEERSYRYWDNKTRGLDFNGMIEDLKNAPEGAVIILHACAHNPTGTDPTPEQWTAIAAVLKERKLFPFFDCAYQGFASGNLVKDAAVVRKFAAEGYEFFCAQSFAKNFGLYNERVGNLTVAVSKPDLMAPVKSQLTLIVRGMYSNPPSHGARIVSFVLNNPDLAKQWQDNITTMSSRIIEMRTLLRNALEELGTPGDWSHLTKHIGMFSYTGLNEIQSEHLVKKHHVYLLRSGRISISGLNNDNVNYVAKAIHETVTTLPSKI

SEQ ID NO: 20720 - protein, 421 aa, Diabrotica virgifera
  misc_feature: Coding regions on vcDNA: vcDNA=SeqID_417; Strand=+; Position=161-1423
  misc_feature: Homolog annotation: Hit_ID=EAA04252.2; Match level="QueryCoverage =99%, HitCoverage=81%, E-value=1e-133, Identity=58%"; Hit description= ENSANGP00000012802 [Anopheles gambiae str. PEST] ref|XP_565315.1| ENSANGP00000012802 [Anopheles gambiae s
  misc_feature: Pfam annotation: Pfam_ID=LMBR1; Match level="Score=273.2, E-value =4.3e-79, Copies=1"; Pfam description=LMBR1-like membrane protein
  misc_feature (392)..(392): Xaa can be any naturally occurring amino acid
MEEYEDEPDINEQIFHNNVREQIIFLLLFIILYVSSFALLCRFKRRGKEDYFSTDEDEVTVYRISTWLCSFSLAVSILAVLLLPISIVSNEVLVNYPNSYYIKWLNSSLIQGLWNYVFLFSNLSLFIALPFAYLFTESEGFFGHRKGLISRVYETFTVLGLLALVVLGMTYVISALIDKDKSSIQTILSLWTYYLPFLYSCISFFGVLMLLVCTPLGFVRLFDVVGQFLVKPQFLRDLNEEYFSCALEEECLRRRFKQAQKTGKSYVDPAPMSIYTEGPIKDADYQLPDNLLRLRNGELQFGLAKRLTEIEKRRLILDKQRQTSSFRRNVVYPIAMLLLLSLTVIAVLLVVQNTLSLLIGIKALPISSKQFTLGVSSLSKLGLFGASLEIVXIVYLIVTSSIELYTATCMKRIRQSLRVPP

SEQ ID NO: 20721 - protein, 48 aa, Diabrotica virgifera
  misc_feature: Coding regions on vcDNA: vcDNA=SeqID_418; Strand=-; Position=590-736
QHTNHQFPTFYNSFHLPYYYIFHHRKIIRHVNSTKLYTNNSFSNILYC

SEQ ID NO: 20722 - protein, 435 aa, Diabrotica virgifera
  misc_feature: Coding regions on vcDNA: vcDNA=SeqID_419; Strand=+; Position=96-1401
  misc_feature: Homolog annotation: Hit_ID=AAV91432.1; Match level="QueryCoverage =90%, HitCoverage=77%, E-value=2e-46, Identity=29%"; Hit description =serine protease 1 [Lonomia obliqua]
  misc_feature: Gene Ontology Annotation: Molecular function=scavenger receptor activity; Cellular component=brush border; Biological process =proteolysis and peptidolysis
  misc_feature: Pfam annotation: Pfam_ID=Trypsin; Match level="Score=97.6, E-value =3.2e-26, Copies=1"; Pfam description=Trypsin
  misc_feature (348)..(348): Xaa can be any naturally occurring amino acid
MDVHCVLFCLLFIFKGFTSEQLESNNNYSTLRQRRQSSFKCTLPPQLQNGRWLITEADVKPGDQVEVNSILRLECHEGYQLQPNTPFLVCDTNWEGIKIPTCKKKCPPFYSTVTTQLLCKDKDENTVTCDKAIDGTYLTYECAAYYEIPPGGRNVLYCNNGIWDFPKPICQPKCGKKFNKETIALTWGGNDVKDFEYPWVIALYKNAGGRYRNVCGGTLISRRVVITAAHCVTDDYGNAIGRENFQVAAGKYYNAFGDQRDTKAQYRKISQVIVHKGYRGVSQRYIGDLALLITQELFKLDPVVQPVCTDNVNNMFLTNYQMGEVAGWGLTENDKPSDRLRVIRIPYXKVAHGARELPASWEQEYNFLDKICAGRQNESIAVCQGDSGSGLVFQNREDNRYYIHGIVSIAPNLYTASCNNRTNALYTSVIFYYAF

SEQ ID NO: 20723 - protein, 288 aa, Diabrotica virgifera
  misc_feature: Coding regions on vcDNA: vcDNA=SeqID_420; Strand=+; Position=159-1025
  misc_feature: Homolog annotation: Hit_ID=XP_392611.1; Match level="QueryCoverage =85%, HitCoverage=23%, E-value=2e-63, Identity=54%"; Hit description =similar to TUWD12 [Apis mellifera]
MPSAASVKIDKQINPENALAESAQNLTPLRQAITVIEHKIRNLEKRKSKLESYKDLQNAGKELNADQKTAVAKFNEVTNTLDFARDLCKQFLGIAVASEKEAKKIAKKEAAAKYQAELARLREILLVQDALNQMGNETVREDFLQGRNGAAQLTESDLKLLDDLYPEVTPKHEAGNATAFMNEVQAAAEHLLAAVDGKPKEVFGGSYSQIKEILGKIHESGYFDQAQVYEEFAVVEPELVEKTRGLPSEPLNNHENWELVMGPPPPQPLPKTHTADDNSAPTRHAVDL

SEQ ID NO: 20724 - protein, 314 aa, Diabrotica virgifera
  misc_feature: Coding regions on vcDNA: vcDNA=SeqID_421; Strand=+; Position=15-956
TMKLVLGTLFLGVLIFNKASPRQISYGKLERLQDALKRFSINDINLLPNENDRLKQTTPEKRGCMYLIGESCSNGRVPGAGADSDWIRNGGNVPGKRTWKLFDFHNLPILSGKRCVNLLDESCSNGGASGAGDDSDWINGGNSPGKRSLNVMDDHNVPFVPYSGRITPGKRCVNLLDESCSNGGASGAGDDSDWINGGNSPGKRSLNVMDDHNVPFVPYSDRITPGKRCVNLLDESCSNGGASGAGDDSDWINGGNSPGKRSLNVMDDHNVPFVPYSGRITPGKRCVNLLDESCSNGGASGAGDDSDWINGGNS

SEQ ID NO: 20725 - protein, 262 aa, Diabrotica virgifera
  misc_feature: Coding regions on vcDNA: vcDNA=SeqID_422; Strand=+; Position=163-949
  misc_feature: Homolog annotation: Hit_ID=CAG31730.1; Match level="QueryCoverage =95%, HitCoverage=51%, E-value=1e-68, Identity=52%"; Hit description =hypothetical protein [Gallus gallus]
  misc_feature: Gene Ontology Annotation: Molecular function=metallocarboxypeptidase D activity; Biological process=amino acid metabolism
  misc_feature: Pfam annotation: Pfam_ID=AMP_N; Match level="Score=126.7, E-value =5.6e-35, Copies=1"; Pfam description=Aminopeptidase P, N-terminal domain
  misc_feature (198)..(198): Xaa can be any naturally occurring amino acid
MANKHVGKLSMGAHTFEIPPILYETNRKRLVERLKKDIANSVVVLQGGSEVSIYDSDTTYLFRQEAYFNWCFGVAEPDCYGIIDVVTGDSHLFFPRLPVEYAVWMGPLTPLDEFKKKYKSHHVHYVDELKQVLENLNRETLLTLSGVNSDSGLTAKTATFEGIEKFKVNNKALFPIIADLRVIKTSYELDVLKYVTDXASAAHTHVMRFAKAGTFEYQSQSQFLNHCYNHGLCIHDEYTCICGSKIDGDVLHYVHAGAPNNF

SEQ ID NO: 20726 - protein, 263 aa, Diabrotica virgifera
  misc_feature: Coding regions on vcDNA: vcDNA=SeqID_423; Strand=-; Position=150-940
  misc_feature: Homolog annotation: Hit_ID=XP_310951.1; Match level="QueryCoverage =93%, HitCoverage=36%, E-value=1e-82, Identity=61%"; Hit description =ENSANGP00000019421 [Anopheles gambiae]
  misc_feature: Gene Ontology Annotation: Molecular function=electron transporter activity; Cellular component=cytosol; Biological process=malate metabolism
  misc_feature: Pfam annotation: Pfam_ID=Malic_M; Match level="Score=224.2, E-value =2.5e-64, Copies=1"; Pfam description=Malic enzyme, NAD binding domain
  misc_feature (34)..(34): Xaa can be any naturally occurring amino acid
  misc_feature (44)..(44): Xaa can be any naturally occurring amino acid
  misc_feature (50)..(50): Xaa can be any naturally occurring amino acid
VSCCLKLRWFRFGRVGEGTSESDARKKIWMVDSXKGLIVKDRPXGGINPXTKEMYAHAPPHPVKTLTEVVKSIKPSTRPGAAAIGGAFTSEILREMAKNNKRPVIFALSNPTHKAECTAEECYRETNGTAIFASGSPFDPVTLNGKTFYPGQGNNSYIFPGVGLATVTAGIQKISEEHFLVAAEALANLVTEDNLENGRIYPPLESIVACSLRIATRLLEYAYEEGNATVLPEPKDKEAFIKAQMYNTDYQPALPAVYAFPKL

SEQ ID NO: 20727 - protein, 307 aa, Diabrotica virgifera
  misc_feature: Coding regions on vcDNA: vcDNA=SeqID_424; Strand=+; Position=23-945
  misc_feature: Homolog annotation: Hit_ID=XP_396382.1; Match level="QueryCoverage =100%, HitCoverage=58%, E-value=1e-120, Identity=66%"; Hit description=similar to EG:25E8.3 [Apis mellifera]
  misc_feature: Gene Ontology Annotation: Molecular function=snoRNA binding; Cellular component=small nucleolar ribonucleoprotein complex; Biological process=rRNA processing
  misc_feature: Pfam annotation: Pfam_ID=WD40; Match level="Score=105.8, E-value=1.1e- 28, Copies=5"; Pfam description=WD domain, G-beta repeat
  misc_feature (281)..(281): Xaa can be any naturally occurring amino acid
MPAFKKLNTKIYQKSGPVITPEYIYWKKLSVPVLVKEFGPIDYIDFSPIEPHHFAVTCSVRVQVYNPITKLVVKNLSRFRENAYGAVFRSDGKLILAGGEETNVKLFDVSSKSLLRLFKGHTAPVHRVHFLHGKPQISTFSDDKTVKIWDIPTEKNLFTYTGHTDYIRAGTTCAAVPDIVLSGGYDHKVKMFDTRTEKEVITVDHGSPVESLLFLPAGGIFLSAGGTEIKIWDSLAGGRLLGNISQHHKTITCLQLASDNKRYLSGSLDRHVKIYDVSTFXTVHTLDFPNASLSLGVSKPDDTLLLG

SEQ ID NO: 20728 - protein, 167 aa, Diabrotica virgifera
  misc_feature: Coding regions on vcDNA: vcDNA=SeqID_425; Strand=+; Position=477-980
  misc_feature: Homolog annotation: Hit_ID=EAL42012.1; Match level="QueryCoverage =70%, HitCoverage=79%, E-value=2e-19, Identity=40%"; Hit description =ENSANGP00000027161 [Anopheles gambiae str. PEST] ref|XP_565570.1| ENSANGP00000027161 [Anopheles gambiae st
MTTNGYNVINFTIIAVCVIGITNIPNVESAVRCFKCLPALPQYYTNETIRLCKDFDYSDKFIVDCPYSTYCVKKITSAKIPTAINGTERNCANQKHVIQNYHHGQWHQEVSVEEPYTPGCHKINDKGARTSSMEYCYCNSDLCNSASSYNVQLGVGFVIALIIFLLP

SEQ ID NO: 20729 - protein, 177 aa, Diabrotica virgifera
  misc_feature: Coding regions on vcDNA: vcDNA=SeqID_426; Strand=-; Position=65-598
  misc_feature: Homolog annotation: Hit_ID=XP_310736.1; Match level="QueryCoverage =98%, HitCoverage=84%, E-value=1e-27, Identity=38%"; Hit description =ENSANGP00000010123 [Anopheles gambiae]
  misc_feature: Pfam annotation: Pfam_ID=DUF1690; Match level="Score=-51.9, E-value =0.1, Copies=1"; Pfam description=Protein of Unknown function (DUF1690)
MGASSSATRKLTVENDDPTSVIKVSEEVVDRLKGSQVVRNEFKQQAVPPPVQGGSFPIFINEPSLTSYQLRQANVAELKKNDEYWQQRLKNLEEKHKKMNDVLDQEYQKALEEMSSGKLGRYAQNIPPCKDTERAVMECYKCNPHEPMKCARVVQAFQECVDLKRNCLLANRTIASN

SEQ ID NO: 20730 - protein, 68 aa, Diabrotica virgifera
  misc_feature: Coding regions on vcDNA: vcDNA=SeqID_427; Strand=+; Position=200-406
EAPFFFFFFLFINIKKRVLRVKKVFFILFTKETRCSSIYHFPNPKVCVVSCLVCVVLEKNSQFCSTIY

SEQ ID NO: 20731 - protein, 269 aa, Diabrotica virgifera
  misc_feature: Coding regions on vcDNA: vcDNA=SeqID_428; Strand=+; Position=77-887
  misc_feature: Homolog annotation: Hit_ID=AAU81605.1; Match level="QueryCoverage =94%, HitCoverage=44%, E-value=2e-50, Identity=43%"; Hit description =juvenile hormone esterase [Apis mellifera] dbj|BAC54130.1| esterase [Apis mellifera]
  misc_feature: Gene Ontology Annotation: Molecular function=cholinesterase activity; Cellular component=extracellular space; Biological process=ceramide catabolism
  misc_feature: Pfam annotation: Pfam_ID=COesterase; Match level="Score=-44.2, E -value=2.6e-09, Copies=1"; Pfam description=Carboxylesterase
  misc_feature (244)..(244): Xaa can be any naturally occurring amino acid
MKFLRYVTSKILLVALATNFVTGDYANLEDANDHLVVQLASHEGKVRGHTLQSTKGNTYYAFQDIPYAAPPVGKLRFKVPQAHPGWTGTINATSNTRVCHQPIPTDLPQSEDCLLINVYTPVKPDPDAKLAVYAWIHGGGYVVWDGTIHRYGPAHLIDYNIIVVTFNYRLGVLGFLTTNDGVIPGNLGLRDQNLALQWVNKNIHKFGGDPDKVTIGGESAGSGSVSSQILSKMSRGLFRGAILXSGSALNTFSNVPNPSQYAFKLAQRG

SEQ ID NO: 20732 - protein, 98 aa, Diabrotica virgifera
  misc_feature: Coding regions on vcDNA: vcDNA=SeqID_429; Strand=+; Position=3-299
HTEELQYMWKGDTDKYVNDYQPIYRNVVCKLWSNFVKHLNPTPEKDEDLGNVIWPKVKSNNIKFMSIDKTLEVKTHPKRYKETREIFDVYLRPPFYSY

SEQ ID NO: 20733 - protein, 568 aa, Diabrotica virgifera
  misc_feature: Coding regions on vcDNA: vcDNA=SeqID_430; Strand=+; Position=138-1844
  misc_feature: Homolog annotation: Hit_ID=NP_732874.1; Match level="QueryCoverage =88%, HitCoverage=81%, E-value=7e-65, Identity=33%"; Hit description =CG10175-PA, isoform A [Drosophila melanogaster] gb|AAF56142.2| CG10175-PA, isoform A [Drosophila
  misc_feature: Gene Ontology Annotation: Molecular function=carboxylesterase activity; Cellular component=synaptic junction; Biological process =ceramide catabolism
  misc_feature: Pfam annotation: Pfam_ID=COesterase; Match level="Score=447.4, E -value=1.6e-131, Copies=1"; Pfam description=Carboxylesterase
MSATVNFVVGISVAYIAYLFIFNDYANLEDANDHLVVQLASHEGKVRGHTLQSTKGNTYYAFQDIPYAAPPVGKLRFKVPQAHPGWTGTINATSNTRVCYQPIPTDLPQSEDCLLINVYTPVKPDPDAKLAVYAWIHGGGYVVWDGTIHRYGPAHLIDYNIIVVTFNYRLGVLGFLTTNDGVIPGNLGLRDQNFALQWVNKNIHKFGGDPDKVTIGGESAGSGSVSSQILSKMSRGLFRGAILESGSALNTFSNVPNPGQYAFKLAQRLDSTLDDKDTTRLLEVLQNVPVKDIVDLSATLVDDKATQTVSIIPDLIWAPSVEEEYIEEPFLTKPQHQAFLDGDFNHATLLAGYTSQELLWFIPSSSVRTPWSVDTWEEFDAKSKYADGDPSRLVHPELNVAEADRATVGALLKQLYTNTTFLENRTTLIEFNSEYFFTNGVIRQADLTSQYAPAYLFEFAYTPTNQIGVEHTEELQYMWKGDTDKYVNDYQPIYRNVVCKLWSNFVKHLNPTPEKDEDLGNVIWPKVKSNNIKFMSIDKTLEVKTHPKRYKETREIFDVYLRPPFYSY

SEQ ID NO: 20734 - protein, 279 aa, Diabrotica virgifera
  misc_feature: Coding regions on vcDNA: vcDNA=SeqID_431; Strand=+; Position=154-990
  misc_feature: Homolog annotation: Hit_ID=XP_393534.1; Match level="QueryCoverage =88%, HitCoverage=55%, E-value=1e-95, Identity=68%"; Hit description =similar to ENSANGP00000003194 [Apis mellifera]
  misc_feature: Gene Ontology Annotation: Molecular function=1-phosphatidylinositol 4- kinase activity; Cellular component=plasma membrane; Biological process=actin filament organization
  misc_feature: Pfam annotation: Pfam_ID=PI3_PI4_kinase; Match level="Score=1.6, E -value=6.4e-07, Copies=1"; Pfam description=Phosphatidylinositol 3- and 4-kinase
  misc_feature (225)..(225): Xaa can be any naturally occurring amino acid
MSASETIPILINTSGSEPETHGALSIVCSDSEDVQLVPEVVFESTLDSPGFRESQPLLGGLDVSYNQFPDDPAFSDLVWQAEAAIDHGIFPERISQGSSGSYFVKNQSGKTISVFKPKDEEPYGRLNPKWTKWTHKLCCPCCFGRSCLIPNQGYLSEAAASLVDQKLNLNIVPKTRVVKLVSETFNYLRIDRQKARVKRAIMEQFPNVGLRFNRIGLPPKVGTFXLFVYGGPDADYCIRRFEVEPFTPSLARKFNCSLSDWKFLNYIIKEHWIGGNDNL

SEQ ID NO: 20735 - protein, 342 aa, Diabrotica virgifera
  misc_feature: Coding regions on vcDNA: vcDNA=SeqID_432; Strand=+; Position=174-1202
  misc_feature: Homolog annotation: Hit_ID=XP_317807.1; Match level="QueryCoverage =98%, HitCoverage=90%, E-value=1e-107, Identity=57%"; Hit description= ENSANGP00000014912 [Anopheles gambiae]
  misc_feature: Gene Ontology Annotation: Molecular function=UDP-N-acetylglucosamine transporter activity; Cellular component=endoplasmic reticulum; Biological process=UDP-N-acetylglucosamine transport
  misc_feature: Pfam annotation: Pfam_ID=DUF250; Match level="Score=-3.0, E-value =0.0033, Copies=1"; Pfam description=Domain of unknown function, DUF250
MSAKAAQAIVLTLTGCMLNNVFLEYIIKLDPGAGHLITLCQFLFIAVHGLIFTSKFGTVKPKIPLSGYMTLVVLFFTTSVVNNWAFAFNIPVPLHMIFRAGSLIANMIMGIIVLKKKYTLEKYISVLLITLGIIICTIYSSSEKPKVCADCELGVETHSDAVADHFFWWIIGIILLTGALLLSAGMGIFQEGLYKKYDKHPEEALFYTHLYPLPGFLIYSSSLIEHIGIANKSDLINIPIVNFAVPVLWALLFLNVVTQFVCISNVYVLTSECASLTVTLVITLRKFFSLVFSIIYFQNPFTIVHWIGTIMVFAGTLMFSETHHKIKNLMVSSDQDKTKKKN

SEQ ID NO: 20736 - protein, 294 aa, Diabrotica virgifera
  misc_feature: Coding regions on vcDNA: vcDNA=SeqID_433; Strand=+; Position=114-998
  misc_feature: Homolog annotation: Hit_ID=XP_414437.1; Match level="QueryCoverage =100%, HitCoverage=62%, E-value=3e-18, Identity=25%"; Hit description= PREDICTED: similar to cereblon; protein x 0001 [Gallus gallus]
  misc_feature: Pfam annotation: Pfam_ID=LON; Match level="Score=-22.6, E-value=1.7e -05, Copies=1"; Pfam description=ATP-dependent protease La (LON) domai
MSQYQENVETEDEEELSDYMVLDQIANGHVDSDTSDDDIPISQEGDFDLDLPTTHRYLGKLDNVRGYTLFEDGVVINTLAIYTTTMVFPGFTLPLVINIYMENSIIKKFLEKENVFVLLCANANHTGVYEYGVTMEVFETQDKHYALSIKARGRQRCMLVPGMEQKALTGRLKKVTVQILPEPNISTPLCDTQMLNLKQKRLFTSTDFNDVKKNYKYRRYHLAQFPFSSWVYDNNEISYYVKSILKYLSHYSAEYVPQDPIKLSYWFVQNYQLSHDERLYILKLNSALERAELE

SEQ ID NO: 20737 - protein, 224 aa, Diabrotica virgifera
  misc_feature: Coding regions on vcDNA: vcDNA=SeqID_434; Strand=+; Position=190-864
  misc_feature: Homolog annotation: Hit_ID=BAC98835.1; Match level="QueryCoverage =95%, HitCoverage=78%, E-value=7e-16, Identity=27%"; Hit description =juvenile hormone acid methyltransferase [Bombyx mori]
MISDVWIKGNCVTQILTKQKFEKYGHLLKWKKNESILEFGAADGNTSVNSVLPVLPKDYKEYVLTDISPNMVEHMKKNLNIPRSKIMQHDIGTIRLQDDLKNRFDHIFGIFVMHMVPDPRQGFINIKAMLKPGGQAFVSILERTPMDHAFDALLKYPKWSRYGHMLSPHYYSDNIEEAYKKDIEAAEFESYSFHVQKDYPIWFESEDSRRGLLAGINNVLPRIP

SEQ ID NO: 20738 - protein, 410 aa, Diabrotica virgifera
  misc_feature: Coding regions on vcDNA: vcDNA=SeqID_435; Strand=+; Position=53-1282
  misc_feature: Homolog annotation: Hit_ID=XP_320129.1; Match level="QueryCoverage =85%, HitCoverage=75%, E-value=8e-51, Identity=35%"; Hit description =ENSANGP00000008931 [Anopheles gambiae] gb|EAA00711.1| ENSANGP00000008931 [Anopheles gambiae
  misc_feature: Gene Ontology Annotation: Molecular function=cell adhesion molecule activity; Cellular component=plasma membrane; Biological process =cell adhesion
  misc_feature: Pfam annotation: Pfam_ID=LRR_1; Match level="Score=93.6, E-value=5e -25, Copies=10"; Pfam description=Leucine Rich Repeat
MKNLGIFAVFTILLVYTRADNLDDFPLCKACGCSFNSNNTEANVTCTKQNPSQLLQDYFWIKKGTNNSIPYNRVMINNEKFINFTYVFPSSPLVYLNLAYNNIFNISDSIFKNLQNMQVLILSYNDLEVIHPDTFKGLYLPERLMPLKSLIELRLDHNKLHTLNQDTFDHTTDIQILDLSYNPLEVIDHHTLIAINELLYLRELYLQNTEIKTLPDNMLHTPQYLRVLDLSGNHGIEKIPETLYQGRNLEKLYLNNTGFVNLTEKNGFPPLPSLQVLHLCRNEHLHRIARFAFAGLTNLTDLRLCDNIDLTTIDDFAFAKSTNVSGGVIWPPLKKLYIGNNKLSYVDSDIVARWDSLTELDIRDNPWTCDCENQWRVEKKKNIYIKLDKNSKKQGTCAAPRGGDPPSLHQ

SEQ ID NO: 20739 - protein, 375 aa, Diabrotica virgifera
  misc_feature: Coding regions on vcDNA: vcDNA=SeqID_436; Strand=+; Position=34-1161
  misc_feature: Homolog annotation: Hit_ID=XP_311704.1; Match level="QueryCoverage =89%, HitCoverage=79%, E-value=1e-104, Identity=52%"; Hit description= ENSANGP00000014991 [Anopheles gambiae]
  misc_feature: Gene Ontology Annotation: Molecular function=stearoyl-CoA desaturase activity; Cellular component=integral to membrane; Biological process=lipid metabolism
  misc_feature: Pfam annotation: Pfam_ID=FA_desaturase; Match level="Score=241.0, E -value=2.2e-69, Copies=1"; Pfam description=Fatty acid desaturase
MPSSPEETTFPQRLQSSNNLGEQNSKDQIKKNGYFEQDLVWRNVIIYIVLHYLLIFAIWRLLTGQMKLGTFIFHCIYATASVLGITAGNHRLWAHRTYKAKLPLRIFLMLMQTTTIQNNIYVWARDHRLHHKYTDTAADPHNSNRGFFFSHVGWLLMKKNPEVKNKGKNIDMSDVAADPVVQFQIKYYGRLALLMAYILPAICTMYLFGETFANSLLVSNIRHLLGLNFTWSVNSAAHLWGWRPYDSSINPVENPSVALITLGEGWHNYHHTFPWDYKAAELGNYALNGTTAFLDLMAYLGQAYDLKTVSPEMVRKRVARTGDGSYKHGKVPLQNGNAKDHQDTTTKDEGFVWGWDDKDMKVEDIKDATITFKSS

SEQ ID NO: 20740 - protein, 71 aa, Diabrotica virgifera
  misc_feature: Coding regions on vcDNA: vcDNA=SeqID_437; Strand=-; Position=417-632
LQSQVSLCYIKPITLLFTSKSFTALNSYSTKYEDGNSSISFLAHLVEIRYLTFNSSKSNAIAPSILNKVFH

SEQ ID NO: 20741 - protein, 196 aa, Diabrotica virgifera
  misc_feature: Coding regions on vcDNA: vcDNA=SeqID_438; Strand=+; Position=38-628
  misc_feature: Homolog annotation: Hit_ID=NP_728587.1; Match level="QueryCoverage =66%, HitCoverage=72%, E-value=2e-11, Identity=28%"; Hit description =CG9134-PC, isoform C [Drosophila melanogaster] ref|NP_728586.1| CG9134-PA, isoform A [Drosophila
  misc_feature: Pfam annotation: Pfam_ID=Lectin_C; Match level="Score=41.6, E-value =2.2e-09, Copies=1"; Pfam description=Lectin C-type domain
MTISAKCLIVVFVFVSISEAYIQDDGNTAHTVPVHVSSRPQWEKNFENGVKSALPLVRFENKLYYFGGHTPLSWMESLNFCETIHMKLASINSARENNKIAQFARQAGISNLYWIGGARFVDNVKWLWIPYGREVDYSNWAAGHPVKNTLNCILGSNWGVGEQFTWVVGDCYARLNFICERYVDDVGSTLGGATLS

SEQ ID NO: 20742 - protein, 277 aa, Diabrotica virgifera
  misc_feature: Coding regions on vcDNA: vcDNA=SeqID_439; Strand=+; Position=192-1025
  misc_feature: Homolog annotation: Hit_ID=XP_393041.1; Match level="QueryCoverage =42%, HitCoverage=44%, E-value=1e-24, Identity=47%"; Hit description =similar to CG8886-PB [Apis mellifera]
  misc_feature: Pfam annotation: Pfam_ID=Transthyretin; Match level="Score=111.9, E -value=1.6e-30, Copies=1"; Pfam description=Transthyretin precursor (formerly pre
METEEVEVVEVNKVNQEDTEYFIPVLLPTSSTKPTLSIHSRGKYYKQTYRAAWEHMPDFKGWLKGVEGEPTRAYCTYCHKNLHAHMNSLLKHTCTIRHQKAAQLNSARKSKIAINMKESISGNEDDKDVSNEESELEEEDDERSRELKPISESTADQNVEIKLFPEKPPISTQVMDMTKGKPISGLQVSLYKLIDGRWTFVNEGMTNSTGKFSEFMDRPDFTNGRYKLHYDVDRYFEAKKQETIYPFIEIIFNAGCTESHHIPLLLSPFGYTTYKGT

SEQ ID NO: 20743 - protein, 318 aa, Diabrotica virgifera
  misc_feature: Coding regions on vcDNA: vcDNA=SeqID_440; Strand=+; Position=128-1080
  misc_feature: Homolog annotation: Hit_ID=XP_393931.1; Match level="QueryCoverage =99%, HitCoverage=68%, E-value=5e-92, Identity=52%"; Hit description =similar to ENSANGP00000009426 [Apis mellifera]
  misc_feature: Gene Ontology Annotation: Molecular function=carboxypeptidase C activity; Cellular component=cellular_component unknown; Biological process=biological_process unknown
  misc_feature: Pfam annotation: Pfam_ID=Peptidase_S10; Match level="Score=146.5, E -value=5.9e-41, Copies=1"; Pfam description=Serine carboxypeptidase
  misc_feature (271)..(271): Xaa can be any naturally occurring amino acid
MKKVLVLTCICLIQISHSAFPNFYPKIAVEPITDDPGVPLLLTPLIEQNKITEAVAASKVYFNGFKKIESYSGYFTVDKTFGSNLFFWFFPAATNYENAPVVLWLQGGPGASSLIGLFTENGPFKAKSKKGLKLRPYSWSTTHSMIYIDSPAGTGYSFTNGGFAQNETKVGQDLYSALTQFFTMFPNLQKNDFYVTGESYGGKYVPAISYTIHKNNPDANLKINLKGLAIGNGLINPEFQLNYGDYLYQLGFVDVNGQQVFKQAEQEAVNXIQNKQFDKAQDIFHKLLDDDYDNHSSTFTNITGFTNYYDYLYPIDPH

SEQ ID NO: 20744 - protein, 234 aa, Diabrotica virgifera
  misc_feature: Coding regions on vcDNA: vcDNA=SeqID_441; Strand=+; Position=183-884
  misc_feature: Homolog annotation: Hit_ID=EAL27932.1; Match level="QueryCoverage =93%, HitCoverage=14%, E-value=1e-107, Identity=73%"; Hit description= GA16040-PA [Drosophila pseudoobscura]
  misc_feature: Gene Ontology Annotation: Molecular function=diacylglycerol kinase activity; Cellular component=rhabdomere; Biological process=signal transduction
  misc_feature: Pfam annotation: Pfam_ID=C1_1; Match level="Score=131.5, E-value=2.1e- 36, Copies=3"; Pfam description=Phorbol esters/diacylglycerol binding
MASVAGSQEQPPAAHGHSFCKKTFHKPTYCHHCSDMLWGLIQQGFICEVCNFVVHDRCLRTVVSPCSSVSASQIRNPVAHCWSESFHHKRKFCNVCRKRLDDSESIHCEICEYFVHVECQDFAVADCKENATYLPGKQLTFVRHQHHWREGNLPSNSKCALCKKTCWTTECLSGYRCEWCGMTSHASCHTSINSECTFWILEPIYLPPHAVSIPRTEVPMEAIIGVQVRRKDTL

SEQ ID NO: 20745 - protein, 297 aa, Diabrotica virgifera
  misc_feature: Coding regions on vcDNA: vcDNA=SeqID_442; Strand=+; Position=71-963
  misc_feature: Homolog annotation: Hit_ID=XP_314010.1; Match level="QueryCoverage =80%, HitCoverage=49%, E-value=1e-101, Identity=73%"; Hit description= ENSANGP00000010016 [Anopheles gambiae]
  misc_feature: Gene Ontology Annotation: Molecular function=translation elongation factor activity; Cellular component=mitochondrion; Biological process=translational elongation
  misc_feature: Pfam annotation: Pfam_ID=GTP_EFTU; Match level="Score=290.8, E-value =2.3e-84, Copies=1"; Pfam description=Elongation factor Tu GTP binding doma
  misc_feature (273)..(273): Xaa can be any naturally occurring amino acid
MLTYSICRTFTKEIVKSKYPLKISVLDCVKHFSQFSQNKGNHSLPLPKLILNYCTDIKKNINVGTIGHVDHGKTTLTAAITKVLQKDGLAKYVSYDEIDRAPEEKARGITINAAHIGYSTKKRSYAHTDCPGHADFIKNMISGVSQMDGAILVVAATDGQMPQTREHLLLAKQVGVTKVIVFVNKADLVDQEILDLVELEIRELLEDFGFDGTNTPFIFGSALEAMNDKETKFGIPAIKELIACLDSYIPDPQRDVTSPFMLPIDNAFTVPGXGTVVVGTIFRGVMKKLQEANLLGF

SEQ ID NO: 20746 - protein, 292 aa, Diabrotica virgifera
  misc_feature: Coding regions on vcDNA: vcDNA=SeqID_443; Strand=+; Position=140-1018
  misc_feature: Homolog annotation: Hit_ID=NP_651718.1; Match level="QueryCoverage =94%, HitCoverage=93%, E-value=5e-91, Identity=56%"; Hit description =CG7598-PA [Drosophila melanogaster] gb|AAF56928.1| CG7598-PA [Drosophila melanogaster]
  misc_feature: Gene Ontology Annotation: Molecular function=chaperone activity; Cellular component=respiratory chain complex I (sensu Eukarya); Biological process=mitochondrial electron transport, NADH to ubiquinone
MFFMWKFVQYPLCRQGKRTFHTSPTLNVFWERDDKGGYRNLDNMPPLKDRLREGLHELKNEIKLWTQEVKERFEDDPILIFRPGEVDVKWRFGNEESLKNWNITSDSDNKEGFSKASLTLTEQGKALFSGNLSMRVPKDGRVKRSGYCSMKTHRARKSFKRDGHLDWTAYNMLVMKVRGDGRSYLLNIHCKGYYDLTWNDMYHYVLFTRGGPYWQVARIPFSKFFFGSKGRVQDMQRQVQLDRVASFGITAGERYGGDFALEIDYIGLEFDPNHREEFAYEMYRTDSYIAST

SEQ ID NO: 20747 - protein, 302 aa, Diabrotica virgifera
  misc_feature: Coding regions on vcDNA: vcDNA=SeqID_444; Strand=+; Position=51-959
  misc_feature: Homolog annotation: Hit_ID=XP_320827.1; Match level="QueryCoverage =92%, HitCoverage=76%, E-value=4e-42, Identity=36%"; Hit description =ENSANGP00000017991 [Anopheles gambiae]
  misc_feature: Gene Ontology Annotation: Molecular function=phospholipase A1 activity; Cellular component=extracellular space; Biological process= lipid metabolism
  misc_feature: Pfam annotation: Pfam_ID=Lipase; Match level="Score=123.9, E-value=4e- 34, Copies=1"; Pfam description=Lipase
MKSNVVLVLLVTFFFTLSLSDPSSDDVIFNFYKEPKISTEIIISKIDELKDAGFDATHDTVLLIYSYGDPSDLETKWKLSSSIFGVVADLNIFVVDWSKATTKDYFEAQKDVTTVGGYITEFLNALVSKYTLNLDRVTIIGWDLGAHIAGTAGKKMDKKLSTIIGLDPAGPLFVNKDTSNRLLATDANYVQVIHTNALINGFSYPCGTADYYPNGGENQTSCGNDITGVCSHQRSLAFYVESLTSDKFVSYKCDDYDSYKNGTCKLQDDNKSIMGQFTTKIDTKASGTYFLDTNDKPPYAKG

SEQ ID NO: 20748 - protein, 236 aa, Diabrotica virgifera
  misc_feature: Coding regions on vcDNA: vcDNA=SeqID_445; Strand=+; Position=164-871
  misc_feature: Homolog annotation: Hit_ID=XP_397563.1; Match level="QueryCoverage =70%, HitCoverage=79%, E-value=7e-15, Identity=26%"; Hit description =hypothetical protein XP_397563 [Apis mellifera]
MIYPKFTPSRCLLSITLTSLVVVLLFISSSNDSTSEVISPGRIFNNEIKPGRNYTPGDFVNYLYPEPSNESYCTFNYNVPKDFNYGNADVDFGPELGKETSYRIVYNVLMAQMADGIPEVTYATHVSADFMYFLPELVRYWDGFISITAFVPDLDVSHVIEQVNQYCYCLPGMSRVSLHFVFDRFVSPSRKDVYFTKPNNCELIDSSKIKTYRHADDSVMYPITVCRNASENCCSN

SEQ ID NO: 20749 - protein, 306 aa, Diabrotica virgifera
  misc_feature: Coding regions on vcDNA: vcDNA=SeqID_446; Strand=+; Position=31-951
  misc_feature: Homolog annotation: Hit_ID=NP_995645.1; Match level="QueryCoverage =78%, HitCoverage=81%, E-value=4e-43, Identity=42%"; Hit description =CG7231-PC, isoform C [Drosophila melanogaster] gb|AAS64653.1| CG7231- PC, isoform C [Drosophila
MKQNFRFGESRLCSALCVLQTVLISVTYAMSTNTDIKTFFPQINGNFSLVTWAHAVNDKEYLKKVLNNDKIMMIEADIVIGKLSNQEDNIPIMAHPPNKTSDLSLEDFLDQISDFNEQAGINNRQGKGVKLDFKETVAFTSSIEILKRLKKRHYPLWLNADILAGYFGTANKTEPVDAKTFLAYANNVEQVTLSLGWTTCKCVPDQTYGNIQIQEMIDTIHSNHVINTITFAVRACLIANTNRDKMKELLDSTKNNNSSFTIWSHHQDEVNIDSLKKIIAQFGVESCSLTYSRIARTVRLIHKINC

SEQ ID NO: 20750 - protein, 83 aa, Diabrotica virgifera
  misc_feature: Coding regions on vcDNA: vcDNA=SeqID_447; Strand=+; Position=724-975
  misc_feature (68)..(68): Xaa can be any naturally occurring amino acid
SRKKSNNFDMLCYTLLICIVYYLKYFVSKKYSRFKQLRELNITEMIWISEDKIIPIFELIFTIFYLLXFFSLLKLFMLFYKMV

SEQ ID NO: 20751 - protein, 63 aa, Diabrotica virgifera
  misc_feature: Coding regions on vcDNA: vcDNA=SeqID_448; Strand=+; Position=1423-1614
TDYFPKCILHIKSKPPIWQNIFRRNFGNISVNKTHTIWKGYLWIISFQILFLKKPTYPTQTLN

SEQ ID NO: 20752 - protein, 146 aa, Diabrotica virgifera
  misc_feature: Coding regions on vcDNA: vcDNA=SeqID_449; Strand=+; Position=69-509
  misc_feature: Homolog annotation: Hit_ID=XP_314752.1; Match level="QueryCoverage =95%, HitCoverage=86%, E-value=8e-56, Identity=65%"; Hit description =ENSANGP00000013247 [Anopheles gambiae]
  misc_feature: Pfam annotation: Pfam_ID=Complex1_17_2kD; Match level="Score=187.1, E- value=3.8e-53, Copies=1"; Pfam description=NADH:ubiquinone oxidoreductase 17.2 k
RATRINMAKYFGIDKFFVFLNTIKEAGGIRASLYKLYRMDNLRPGTLVGTDKYGNKYYENPHYFYGRNRWIEYAPYYGLDYDGSQVPAEWFGWLHYKTDLTPDKDPSRPKYKWMADHTENLSGTPGQYMPYSTTRPKIEAWTPPGK

SEQ ID NO: 20753 - protein, 49 aa, Diabrotica virgifera
  misc_feature: Coding regions on vcDNA: vcDNA=SeqID_450; Strand=-; Position=102-249
  misc_feature (23)..(23): Xaa can be any naturally occurring amino acid
MNVKNNNLNLYSQLRCRCCCCCXCRATCKACCSSGARDWTTLWKNDSFD

SEQ ID NO: 20754 - protein, 134 aa, Diabrotica virgifera
  misc_feature: Coding regions on vcDNA: vcDNA=SeqID_451; Strand=+; Position=80-484
  misc_feature: Homolog annotation: Hit_ID=EAL28521.1; Match level="QueryCoverage =99%, HitCoverage=12%, E-value=9e-31, Identity=50%"; Hit description =GA10419-PA [Drosophila pseudoobscura]
TSLGKFNQIMKYNNSQINLDEIIPLWFSWLPVIEDVDESPHIYGYMCDLIEQNNQHILGVNNSNIPRIISIIAQEAFVKEAMEPSKPEGFRMVNIVRQVQSNESFFQSVVQSLAPELQQALHVALHTTAAAATS

SEQ ID NO: 20755 - protein, 773 aa, Diabrotica virgifera
  misc_feature: Coding regions on vcDNA: vcDNA=SeqID_452; Strand=+; Position=1-2322
  misc_feature: Homolog annotation: Hit_ID=XP_310308.1; Match level="QueryCoverage =100%, HitCoverage=66%, E-value=0.0, Identity=67%"; Hit description =ENSANGP00000015236 [Anopheles gambiae]
  misc_feature: Gene Ontology Annotation: Molecular function=protein carrier activity; Cellular component=nuclear pore; Biological process =protein-nucleus import
  misc_feature: Pfam annotation: Pfam_ID=HEAT; Match level="Score=86.6, E-value=6.8e -23, Copies=4"; Pfam description=HEAT repeat
VAEAALDRLACGLGGKIILPLVTQSVPSMLASPDWKQRHAALMALSAVGEGCHKQMEGMLQQIMNGVPGVMDGVIRYLQDPHPRVRYAACNAVGQMATDFAPVFEKKFHNQVVPGLLMLLDDNANPRVQAHAGAALVNFAEDCPKHILNGYLEPLMSKLEGILTAKFKELVEKGTKLVLEQVVTTIASVADTAETEFIAYYDRLMPCLKYIIQNANKDELKLLRGKAIECVTLIGMAVGSEKFSIDATEVMDMLLKTHGDGAELPDDDPQTSYLISAWSRICKVLGKNFEQYLPLVMGPVIRTAAMKPDVALLDNDDMQGVEGDDDWQFVSLGEQKNFGIRTAGLEDKAAACSMLVCYARELKESFSNYAEEVVKLMVPMLKFYFHDGVRNAAAESLPWLLECATNKGPAFLGGMWSFICPELLKAIDTEPESEVLMVMLDSLSRCIQKLGPSYIDQESMTEILRIIDKLMKEHFERANDRHKKHLDEDYDEEVQEQLEDEESDDIYVLSKIADVIHSLFLVYRESFLPLFDQICSHFVNLLTPNRSWADRQWGICVFDDVIEFTGPACSKYQGYFLQPLALYMKDKTTEVRQAVAYGWGVLAQFGGEQFAGELAKAVPMLVEVINEPESKDPRNINATENAISAVTKIMKYNNSQINLDEIIPLWFSWLPVIEDVDESPHIYGYMCDLIEQNNQHILGVNNSNIPRIISIIAEAFFREAMEPSKPEGFRMVNIVRQVQSNESFFQSVVQSLAPELQQALHVALHTTAAAATS

SEQ ID NO: 20756 - protein, 389 aa, Diabrotica virgifera
  misc_feature: Coding regions on vcDNA: vcDNA=SeqID_453; Strand=+; Position=1-1168
  misc_feature: Homolog annotation: Hit_ID=AAC24982.2; Match level="QueryCoverage =97%, HitCoverage=40%, E-value=6e-54, Identity=34%"; Hit description =reverse transcriptase [synthetic construct]
  misc_feature: Pfam annotation: Pfam_ID=RVT_1; Match level="Score=0.2, E-value =0.00013, Copies=1"; Pfam description=Reverse transcriptase (RNA -dependent
  misc_feature (4)..(4): Xaa can be any naturally occurring amino acid
  misc_feature (20)..(24): Xaa can be any naturally occurring amino acid
  misc_feature (30)..(30): Xaa can be any naturally occurring amino acid
  misc_feature (52)..(53): Xaa can be any naturally occurring amino acid
QAGXRPDLSCIDHINTVRYXXXXXVNGHTXYTWFVDFERAFDSLSHAAIWKXXELRNILHKIISIIKSLYTEATCSVTHNGINSDEFDVLTGVRQGCVLSPFLFNIALDYVLSKLDFDTKGIRWTLTTRLSDLEYADDICLLGQRFQDVADQLETLSTEANKIGLKINISKTKSMRINARNNTLFNIDNMQIENVENFTYLGSVITESGGTEDDIRMRIRKAQQAFSMLNPVWRSGEYTTRTKIRIFQSNVMSVLLYGCETWKVTKYLTDKLQVFVNKCLRRIVRIFWPNTIRNEDLLHLTQQKRVENEIKYRKWGWIGHTLRKDSSSIAKNALEWNPQGKRKRGRPAQTWRRSIMDEIRSQGKSWNEVKALAQNRTRWRVFTEALCST

SEQ ID NO: 20757 - protein, 193 aa, Diabrotica virgifera
  misc_feature: Coding regions on vcDNA: vcDNA=SeqID_454; Strand=+; Position=150-731
  misc_feature: Homolog annotation: Hit_ID=EAL30029.1; Match level="QueryCoverage =95%, HitCoverage=97%, E-value=2e-61, Identity=63%"; Hit description =GA18908-PA [Drosophila pseudoobscura]
  misc_feature: Gene Ontology Annotation: Molecular function=signal sequence binding; Cellular component=integral to membrane; Biological process =cotranslational membrane targeting
  misc_feature: Pfam annotation: Pfam_ID=TRAP_beta; Match level="Score=279.7, E-value= 5e-81, Copies=1"; Pfam description=Translocon-associated protein beta (T
MKSGLLFLVLALFSFAHCESEDDTGPRLLVSKQILNRYLVETKDIEVKYTIFNVGTSAAVNVQLVDNGFHHEAFEVVGGHLQSKFERIPPQSNVTHVVVVRPLRYGYFNFTSAEVSYKASDDASVKIKRSLSSEPGEGGIIAFREYNKKFSSHYWDWLAFALMTTPSLVIPLVLWYSSKSKYEKLGKPSKKIH

SEQ ID NO: 20758 - protein, 206 aa, Diabrotica virgifera
  misc_feature: Coding regions on vcDNA: vcDNA=SeqID_455; Strand=+; Position=101-721
  misc_feature: Homolog annotation: Hit_ID=XP_392405.1; Match level="QueryCoverage =98%, HitCoverage=96%, E-value=1e-74, Identity=68%"; Hit description =similar to CG14207-PB [Apis mellifera]
  misc_feature: Gene Ontology Annotation: Molecular function=enzyme activator activity; Cellular component=cytosol; Biological process=response to stress
  misc_feature: Pfam annotation: Pfam_ID=HSP20; Match level="Score=93.1, E-value=7.3e- 25, Copies=1"; Pfam description=Hsp20/alpha crystallin family
MSNRNIPIKMGDFSVIDTEFSSIRERFDAEMRKMEEEMNKFRSELTSREANNFFRSTTRSYESETVTGGNKSSSTSSSTTQQSSTGSDLAHRAPSGDVRTWYDDLNSPLIQQDGNEKSLKLRFDVSQYAPEEIVVKTVDNKLLVHAKHEEKTESKSVYREYNREFLLPKGTNPEHIKSSLSKDGVLTVEAPLPAITSGEKLIPIQH

SEQ ID NO: 20759 - protein, 188 aa, Diabrotica virgifera
  misc_feature: Coding regions on vcDNA: vcDNA=SeqID_456; Strand=+; Position=108-674
  misc_feature: Homolog annotation: Hit_ID=XP_392405.1; Match level="QueryCoverage =98%, HitCoverage=96%, E-value=5e-72, Identity=67%"; Hit description =similar to CG14207-PB [Apis mellifera]
  misc_feature: Gene Ontology Annotation: Molecular function=enzyme activator activity; Cellular component=cytosol; Biological process=response to stress
  misc_feature: Pfam annotation: Pfam_ID=HSP20; Match level="Score=93.1, E-value=7.3e- 25, Copies=1"; Pfam description=Hsp20/alpha crystallin family
MSNRNIPIKMGDFSVIDTEFSSIRERFDAEMRKMEEEMNKFRSELTSREANNFFRSTTSSTTQQSSTGSDLAHRAPSGDVRTWYDDLNSPLIQQDGNEKSLKLRFDVSQYAPEEIVVKTVDNKLLVHAKHEEKTESKSVYREYNREFLLPKGTNPEHIKSSLSKDGVLTVEAPLPAITSGEKLIPIQH

SEQ ID NO: 20760 - protein, 198 aa, Diabrotica virgifera
  misc_feature: Coding regions on vcDNA: vcDNA=SeqID_457; Strand=+; Position=855-1448
  misc_feature: Homolog annotation: Hit_ID=NP_067394.1; Match level="QueryCoverage =51%, HitCoverage=20%, E-value=6e-21, Identity=44%"; Hit description =ring finger protein 8 [Mus musculus] gb|AAH21778.1| Ring finger protein 8 [Mus musculus]
  misc_feature: Pfam annotation: Pfam_ID=zf-C3HC4; Match level="Score=39.1, E-value =1.3e-08, Copies=1"; Pfam description=Zinc finger, C3HC4 type (RING finger)
MVTVETVCSVEVQSSKINNSQTACTSDTNMGQIESHKPESDSNMMSESQMENELQCAICAEMFVKASTLNCSHTFCKFCIDKWKEKQTICPICRTKITSQVPTLVLDNFIEKIIQGSAQDIQDHRRELLNERAQMQKHQQNLLEQQQQPRSDTRRQGRSRRVQVAFDPEPVVMDGDDSSSSSDTTSTESDSGQEDAEF

SEQ ID NO: 20761 - protein, 211 aa, Diabrotica virgifera
  misc_feature: Coding regions on vcDNA: vcDNA=SeqID_458; Strand=+; Position=362-997
  misc_feature: Homolog annotation: Hit_ID=XP_317504.1; Match level="QueryCoverage =91%, HitCoverage=60%, E-value=4e-64, Identity=66%"; Hit description =ENSANGP00000010167 [Anopheles gambiae]
  misc_feature: Gene Ontology Annotation: Molecular function=hydrogen-transporting ATP synthase activity, rotational mechanism; Cellular component =proton-transporting ATP synthase, central stalk (sensu Eukarya); Biological process=ATP synthesis
  misc_feature: Pfam annotation: Pfam_ID=ATP-synt; Match level="Score=7.3, E-value=6e- 13, Copies=1"; Pfam description=ATP synthase
MLVRFGNFGNVVPLLVQNGQQQQQRGMATLKAISIRLKSVKNIQKITQSMKMVSAAKYARAERELKAVRPIGDGASQFYEKAEIQPLADVPQKLVIAITSDRGLCGAVHTSVSRYIRTELGKDDQNIKVVCVGDKSRSILQRIYGKNIMLACNEVGRLPPTFIDASKLADAVLKSDYKFSTGEIVDNKFKSVRFLQHTDIYACTAAPKLSV

SEQ ID NO: 20762 - protein, 279 aa, Diabrotica virgifera
  misc_feature: Coding regions on vcDNA: vcDNA=SeqID_459; Strand=+; Position=45-884
  misc_feature: Homolog annotation: Hit_ID=XP_317504.1; Match level="QueryCoverage =97%, HitCoverage=83%, E-value=1e-112, Identity=76%"; Hit description= ENSANGP00000010167 [Anopheles gambiae]
  misc_feature: Gene Ontology Annotation: Molecular function=hydrogen-transporting ATP synthase activity, rotational mechanism; Cellular component =proton-transporting ATP synthase, central stalk (sensu Eukarya); Biological process=ATP synthesis
  misc_feature: Pfam annotation: Pfam_ID=ATP-synt; Match level="Score=325.6, E-value =7.3e-95, Copies=1"; Pfam description=ATP synthase
MLVRFGNFGMATLKAISIRLKSVKNIQKITQSMKMVSAAKYARAERELKAVRPIGDGASQFYEKAEIQPLADVPQKLVIAITSDRGLCGAVHTSVSRYIRTELGKDDQNIKVVCVGDKSRSILQRIYGKNIMLACNEVGRLPPTFIDASKLADAVLKSDYKFSTGEIVYNKFKSVVSYNTQTLPMFSLAAVTAAPKLSVYDSLDDEVVQSYLEFSLASLLFYSMKEGACSEQSSRMTAMDNASKNAGEMIDKLTLTFNRTRQAVITRELIEIISGASAL

SEQ ID NO: 20763 - protein, 296 aa, Diabrotica virgifera
  misc_feature: Coding regions on vcDNA: vcDNA=SeqID_460; Strand=+; Position=325-1215
  misc_feature: Homolog annotation: Hit_ID=XP_317504.1; Match level="QueryCoverage =97%, HitCoverage=90%, E-value=1e-114, Identity=74%"; Hit description= ENSANGP00000010167 [Anopheles gambiae]
  misc_feature: Gene Ontology Annotation: Molecular function=hydrogen-transporting ATP synthase activity, rotational mechanism; Cellular component =proton-transporting ATP synthase, central stalk (sensu Eukarya); Biological process=ATP synthesis
  misc_feature: Pfam annotation: Pfam_ID=ATP-synt; Match level="Score=325.6, E-value =7.3e-95, Copies=1"; Pfam description=ATP synthase
MLVRFGNFGNVVPLLVQNGQQQQQRGMATLKAISIRLKSVKNIQKITQSMKMVSAAKYARAERELKAVRPIGDGASQFYEKAEIQPLADVPQKLVIAITSDRGLCGAVHTSVSRYIRTELGKDDQNIKVVCVGDKSRSILQRIYGKNIMLACNEVGRLPPTFIDASKLADAVLKSDYKFSTGEIVYNKFKSVVSYNTQTLPMFSLAAVTAAPKLSVYDSLDDEVVQSYLEFSLASLLFYSMKEGACSEQSSRMTAMDNASKNAGEMIDKLTLTFNRTRQAVITRELIEIISGASAL

SEQ ID NO: 20764 - protein, 109 aa, Diabrotica virgifera
  misc_feature: Coding regions on vcDNA: vcDNA=SeqID_461; Strand=+; Position=110-439
  misc_feature: Homolog annotation: Hit_ID=S13329; Match level="QueryCoverage=80%, HitCoverage=9%, E-value=4e-14, Identity=43%"; Hit description =hypothetical protein 2 - fruit fly (Drosophila melanogaster)
MFCFAKNRFYVIPRTYGIQIWGTASETNLLKIQRFQSKVLRQLCQAPWYISNDNIHRDLQVQTVKEEIVSLCSKYHNRQVHPNILVTNLLTPLQNRRLKRTDTLDVNTN

SEQ ID NO: 20765 - protein, 467 aa, Diabrotica virgifera
  misc_feature: Coding regions on vcDNA: vcDNA=SeqID_462; Strand=+; Position=133-1536
  misc_feature: Homolog annotation: Hit_ID=XP_316059.1; Match level="QueryCoverage =76%, HitCoverage=68%, E-value=2e-77, Identity=40%"; Hit description =ENSANGP00000010697 [Anopheles gambiae]
  misc_feature: Gene Ontology Annotation: Molecular function=transcription factor activity; Cellular component=nucleus; Biological process=circadian rhythm
  misc_feature: Pfam annotation: Pfam_ID=HLH; Match level="Score=48.4, E-value=2.1e -11, Copies=1"; Pfam description=Helix-loop-helix DNA-binding domain
MYSSVLTSSTVTLDMMENPWYPPTRQAFLVDTTPPSNSREQRNKAEKQRRDRLNSYIGELASLVPMVARSAKRLDKTSILRLTATHLRIKQLLNNSRIVPNMGFPRHIDQILLEQLIYEQMGGFLLIVLANGKIVFVSSTVENLLGHLQTDLMGQSLFNITSPDDQDRLKIFLQCEGDIEQEWRKCFNIKLKRAGPRSETSVYEQVRMMGMHRQGTPTGIHQNSMLSSSSSSSSSSSSSSSSVNADDILIFFAKICRPEPFIERLIEASKEEYVTRHLIDGRIIDCDQRISIIAGYMTEEVLSHSAFLYMHRDDVRWVMIALRQMYDRGEMRGWSCYRLQSRNGQFIFLRTNGFLEIDDQGIVESFICVNTLVSEMEGMQLIDDMKKRYSALCSLEVSSVGCRVSPLIHFFHALLLMTRFFISFILMCLLIQLCGSASRSISTSWRDSIENSRISQCTVVLPDDISS

SEQ ID NO: 20766 - protein, 633 aa, Diabrotica virgifera
  misc_feature: Coding regions on vcDNA: vcDNA=SeqID_463; Strand=+; Position=2-1903
  misc_feature: Homolog annotation: Hit_ID=XP_312489.1; Match level="QueryCoverage =97%, HitCoverage=90%, E-value=0.0, Identity=42%"; Hit description =ENSANGP00000021340 [Anopheles gambiae]
  misc_feature: Gene Ontology Annotation: Molecular function=protein binding; Cellular component=endomembrane system; Biological process=receptor mediated endocytosis
  misc_feature: Pfam annotation: Pfam_ID=Dynamin_N; Match level="Score=10.0, E-value =1.5e-06, Copies=1"; Pfam description=Dynamin family
DDSKEDEHERHKRSIDDAQDDGIESKEEEATLKEDASKEDSKEDEAATKEEVDDKQQEEVEEVAESKEDDVDSKEGTTEDADKSDEKVEPQSDENTEDNKQESAENKDDDQKDGDSKEDDTKSTEQDDKDDKDDDVKGDSREENADDKSVEAEKDGDESRENDSTDDNKSGEDGAPVEELSLDTEIPSDLRPRDHVEQLLKLDEQSSDTETIINRVSEITLRDLKKLYENAIKPLEVLYKYRDLSNRHFGDSEIFSKPLILFMGPWSGGKSSIINYLTNNEYNETSLRTGAEPSPAYFNILMYGEEPEVIDGSELAADFTFSGLQKFGQGLEERLRGVKLPSKLLEKVNIVEIPGILEVRKQVSRVFPFNDACQWFIDRGDIIFLVYDPSKLDVGPETEAILDQLKGREHQTRIILNKADRVKPEELLRVQGALIWNISPLMSSPQPPIMYTTSLWSRPYEPWAPVRLLQAQERAFLRDLRGAVDKRIENKIASARRFAVRVRNHAKMVDCYLTTYYNHKSVFGNRKQVADAIIEHPQDYHIYEGLSTLTNISRYDLPDPDVYKDFFKLNPLYEFQQLSATCTYFRGCPINRLDIAIAYDLPELLGTHRKRVESALTEEKSGSKQQTSTTPGS

SEQ ID NO: 20767 - protein, 256 aa, Diabrotica virgifera
  misc_feature: Coding regions on vcDNA: vcDNA=SeqID_464; Strand=+; Position=90-857
  misc_feature: Homolog annotation: Hit_ID=XP_392063.1; Match level="QueryCoverage =46%, HitCoverage=18%, E-value=6e-45, Identity=75%"; Hit description =similar to ENSANGP00000016235 [Apis mellifera]
  misc_feature: Gene Ontology Annotation: Molecular function=molecular_function unknown; Cellular component=nucleus; Biological process=cystoblast cell division
MMTSFQQQRLMMSASAKAHPPTQTISAPPPILPPPGLPPSVLAQSMPLPPMLPPSMQALGIPPPPMPPMPLNTVSDQIPQPPMSVDPDPPLDAEPELSPQPEMEPDPMLEYEPPAPGTEEIPEIPIDPARLCEGYEYIYDLIQIGEVITGPGARSSTIAGILGGALPKLSSDDADAVSKAKKYAMEQSIRMGLMKQTIAYQQQQEAGQRNLIQRQQALALMCRVYVGSISFELKEDTIRSAFLPFGPIKSINMSWD

SEQ ID NO: 20768 - protein, 404 aa, Diabrotica virgifera
  misc_feature: Coding regions on vcDNA: vcDNA=SeqID_465; Strand=+; Position=1-1212
  misc_feature: Homolog annotation: Hit_ID=XP_313721.1; Match level="QueryCoverage =98%, HitCoverage=49%, E-value=1e-105, Identity=49%"; Hit description= ENSANGP00000003808 [Anopheles gambiae] gb|EAA09238.1| ENSANGP00000003808 [Anopheles gambiae
  misc_feature: Gene Ontology Annotation: Molecular function=protein binding; Cellular component=histone acetyltransferase complex; Biological process=chromatin modeling
  misc_feature: Pfam annotation: Pfam_ID=PCAF_N; Match level="Score=113.3, E-value =6.1e-31, Copies=1"; Pfam description=PCAF (P300/CBP-associated factor) N-t
NRLLSMAVDMDNMYTAMSTEKNPETNKVYLYLFRLLRKCVLTLDKPVVEGPLGQPPFQKPSIHKAVTNLLIYKFSHIGQQELKTMYELVKILFHCLNTWDFPSPSSQKHIVNQEEAMKYKIEYTRWLVFCYVPTFCDSLQHFDTTMVFGRTLLRAVFKYIRKQIMDQFYKERDTMPPERRQLLLTNFPPFLNQLDEEIYAAHSPIWDPEFKSTSVHFQSLLDSRLKAGPSSSKKGEFEKVSLGKSDREGFTTIPLAPGKSIRATEMPSREVKRRKIAQDEKFEDMPKETVAQIVATIDDPNYMTGPDMVFSENAPATDEAPKLEEQRNIIQLHVVGNSLTTPVSKQTMLWLIGLQNVFSHQLPRMPIEYITQLLFDPKHRTIALVKENRPIGGICFRPFSNAKD

SEQ ID NO: 20769 - protein, 314 aa, Diabrotica virgifera
  misc_feature: Coding regions on vcDNA: vcDNA=SeqID_466; Strand=+; Position=64-1008
  misc_feature: Homolog annotation: Hit_ID=XP_313721.1; Match level="QueryCoverage =84%, HitCoverage=36%, E-value=1e-69, Identity=46%"; Hit description =ENSANGP00000003808 [Anopheles gambiae] gb|EAA09238.1| ENSANGP00000003808 [Anopheles gambiae
  misc_feature: Gene Ontology Annotation: Molecular function=protein binding; Cellular component=histone acetyltransferase complex; Biological process=chromatin modeling
  misc_feature: Pfam annotation: Pfam_ID=PCAF_N; Match level="Score=266.2, E-value =5.6e-77, Copies=1"; Pfam description=PCAF (P300/CBP-associated factor) N-te
  misc_feature (242)..(242): Xaa can be any naturally occurring amino acid
  misc_feature (253)..(253): Xaa can be any naturally occurring amino acid
  misc_feature (265)..(265): Xaa can be any naturally occurring amino acid
  misc_feature (289)..(289): Xaa can be any naturally occurring amino acid
MSEQSVENIDGSASNSSEHATHGQKSTTNQTKSETNASPLNNLQRIQQKKQAVVSLPYNKKLLKLAVYSKCQAEKCDCIGWKRVESNQQNPTFTDPCRCEHLLEMHISHLVDKPEQELNRLLSMAVDMDNMYTAMSTEKNPETNKVYLYLFRLLRKCVLTLDKPVVEGPLGQPPFQKPSIHKAVTNLLIYKFSHIGQQELKTMYELVKILFHCLNTWDFPSPSSQKHIVNQEEAMKYKIEYXPRGLVFCYVPXTFCDSLQHFDTXMVFWKKHLLRAVFKYIRKQIMDQXTRKKDTMPPERRQLLLSHYLPFSFF

SEQ ID NO: 20770 - protein, 206 aa, Diabrotica virgifera
  misc_feature: Coding regions on vcDNA: vcDNA=SeqID_467; Strand=+; Position=2-623
  misc_feature: Homolog annotation: Hit_ID=AAH83267.1; Match level="QueryCoverage =94%, HitCoverage=73%, E-value=5e-24, Identity=31%"; Hit description =Interferon gamma inducible protein 30 [Danio rerio] ref|NP _001006057.1| interferon gamma inducible protein
  misc_feature: Gene Ontology Annotation: Biological process=regulation of protein activity, epigenetic
  misc_feature: Pfam annotation: Pfam_ID=GILT; Match level="Score=90.4, E-value=4.6e -24, Copies=1"; Pfam description=Gamma interferon inducible lysosomal
  misc_feature (48)..(48): Xaa can be any naturally occurring amino acid
  misc_feature (66)..(66): Xaa can be any naturally occurring amino acid
PPAPTADLLPLSTHASADLNVTLFYEGLCPYCHNFIVDQLYPGYQKLXDSFKLDVVPYGWETYKKXADGTIQYTCQHGENECTVNRIHACVIDQNPTQSDLISFMQCHLSQASAYNIYEELMDMAKDCSGGTISFDRVQNCVEGSHADELLMAYSERQSKLYPALPFVPNIRFNGVYDTELEDEATKDFFATICKVLKDNKPEVCG

SEQ ID NO: 20771 - protein, 273 aa, Diabrotica virgifera
  misc_feature: Coding regions on vcDNA: vcDNA=SeqID_468; Strand=+; Position=3-824
  misc_feature: Homolog annotation: Hit_ID=CAE59553.1; Match level="QueryCoverage =32%, HitCoverage=32%, E-value=8e-13, Identity=41%"; Hit description =Hypothetical protein CBG02950 [Caenorhabditis briggsae]
  misc_feature: Gene Ontology Annotation: Biological process=regulation of protein activity, epigenetic
  misc_feature: Pfam annotation: Pfam_ID=GILT; Match level="Score=84.3, E-value=3.2e -22, Copies=1"; Pfam description=Gamma interferon inducible lysosomal
DHASAHASAHASAHASAHASAHASVFLKVILVLAASLCISCSAQDSDLNVTLFYEGLCPYCHNFIVDQLYPGYQKLGDSFKLDVVPYGWETYKKLADGTIQYTCQHGENECTVNRIHACVIDQNPTQSDLISFMQCHLSQASAYNIYEELMDMAKDCSGTIQYTCQHGENECTVNRIHACVIDQNPTQSDLISFMQCHLSQASAYNIYEELMDMAKDCSGGTISFDRVQNCVEGSHADELLMAYSERQSKLYPALTFVPNIQFNGVYDTEIGE

SEQ ID NO: 20772 - protein, 152 aa, Diabrotica virgifera
  misc_feature: Coding regions on vcDNA: vcDNA=SeqID_469; Strand=+; Position=721-1179
  misc_feature: Gene Ontology Annotation: Molecular function=molecular_function unknown; Cellular component=cellular_component unknown; Biological process=N-linked glycosylation
  misc_feature (84)..(84): Xaa can be any naturally occurring amino acid
  misc_feature (116)..(116): Xaa can be any naturally occurring amino acid
QSKKRKSDDENTKYKKKLKTQGEIKSEDNVNKSNHQGENKSKHTVNKKGKKDQSKKQKGDNQPKKIIKENLTELLKKEKTKKNXKQVEKKKRIKAELQKQKEEKRKIKGKKNGGKXGKIKKFLKGKKKNKKKTKKIKILFSPLGEKKKKKFF

SEQ ID NO: 20773 - protein, 304 aa, Diabrotica virgifera
  misc_feature: Coding regions on vcDNA: vcDNA=SeqID_470; Strand=+; Position=18-929
  misc_feature: Homolog annotation: Hit_ID=CAE47497.1; Match level="QueryCoverage =99%, HitCoverage=95%, E-value=3e-97, Identity=56%"; Hit description =cathepsin L-like proteinase [Diabrotica virgifera virgifera]
  misc_feature: Gene Ontology Annotation: Molecular function=cathepsin S activity; Cellular component=extracellular space; Biological process =proteolysis and peptidolysis
  misc_feature: Pfam annotation: Pfam_ID=Peptidase_C1; Match level="Score=278.5, E -value=1.1e-80, Copies=1"; Pfam description=Papain family cysteine protease
MKIFILLCACLLVASAQLSANKQWVTFKKSFQRSYKLGEEKLRFQVFQKNLRKINEHNSKYEKGETSYFLKITKFADWTDEELNAMLNPKIVAKSHHKNTKTLVRDPNFSRPASIDWRDTAVLAVKDQAACGSCWAFSTTGALEGQLAIHKNQTIPLSEQELMDCDDENYACSGGYADVAFEYIEANGISSESQYEYTQKKGECRKVENKPVSSISGWLGVPSDEDALIEAVAQYGPVSVSVFANNDWSLYGGGIFDHDDCRSNPNHAVLAVGYTGNSWIVKNSWGASWGEEGYIRLALGKNEW

SEQ ID NO: 20774 - protein, 278 aa, Diabrotica virgifera
  misc_feature: Coding regions on vcDNA: vcDNA=SeqID_471; Strand=+; Position=60-892
  misc_feature: Homolog annotation: Hit_ID=XP_313043.1; Match level="QueryCoverage =97%, HitCoverage=41%, E-value=1e-116, Identity=72%"; Hit description= ENSANGP00000011712 [Anopheles gambiae]
  misc_feature: Gene Ontology Annotation: Molecular function=electron transporter activity; Cellular component=cytosol; Biological process=pyruvate metabolism
  misc_feature: Pfam annotation: Pfam_ID=malic; Match level="Score=294.7, E-value =1.5e-85, Copies=1"; Pfam description=Malic enzyme, N-terminal domain
  misc_feature (263)..(263): Xaa can be any naturally occurring amino acid
MLSFIPRSLRSVTANAGHKTILNQIPRTINAEDQHKRHLTGDVISPGQVMGIEHLRDPRLNKGLGFTLEERQALGIHGLQPARFKTQEQQLELCRISVERYQEDLNKYIYLTELQDRNEKLFFRLLSENIETLMPIVYTPTVGLACQKFGLIYRRPRGLFITINDIGHVYDVVKNWPEPDVKAVVVTDGERILGLGDLGACGMGIPVGKLALYTALAGIKPHECLPVVLDVGTNNQALLEDPLYVGLRQKRSTGKLYDDFLDXFMEAIVTRYGQTTLI

SEQ ID NO: 20775 - protein, 260 aa, Diabrotica virgifera
  misc_feature: Coding regions on vcDNA: vcDNA=SeqID_472; Strand=+; Position=85-867
  misc_feature: Homolog annotation: Hit_ID=AAR22385.1; Match level="QueryCoverage =89%, HitCoverage=96%, E-value=3e-64, Identity=49%"; Hit description =cellulase II [Apriona germari]
  misc_feature: Pfam annotation: Pfam_ID=Glyco_hydro_45; Match level="Score=282.5, E -value=7.2e-82, Copies=1"; Pfam description=Glycosyl hydrolase family 45
MYTGIVNISDAWVAIVTASSKESSPDIVAIPGGLRGDAITTRYWDCCVVSCSWDANVHTKNRQPVKSCQKNGATYSTRENNGNSVCYPDHPGNAYVCNNNSPFVVNSTLAYGFAGVSFQGGADVEHCCHCYLLSFKGKLQGKQMLVQTINTGADAVAHHFDLQIPGGGVGYHTQGCRIQWNAPENGWGDRYGGVHSEQECNQLPWQLQAGCKFRFQFMQGVSNPDVSFQEVKCPSQLVSITSCGDLLNNNCVFDFFVGIY

SEQ ID NO: 20776 - protein, 244 aa, Diabrotica virgifera
  misc_feature: Coding regions on vcDNA: vcDNA=SeqID_473; Strand=+; Position=199-932
  misc_feature: Homolog annotation: Hit_ID=BAB85478.1; Match level="QueryCoverage =97%, HitCoverage=76%, E-value=1e-41, Identity=39%"; Hit description =luciferin-regenerating enzyme [Luciola lateralis]
  misc_feature: Gene Ontology Annotation: Cellular component=nucleus
  misc_feature: Pfam annotation: Pfam_ID=SMP-30; Match level="Score=114.4, E-value =2.9e-31, Copies=1"; Pfam description=Senescence marker protein-30 (SMP-30)
  misc_feature (222)..(222): Xaa can be any naturally occurring amino acid
MAPIIEKVLDGFKLAEGPHWDTKKQCLYFVDIVEGTIFKYVPSTKKLTKAKIGNHNVSIIIPLKYRNNEFIVTLNNSIALIEWDGESTNINSVKQIYEVDAGTSNVFNDGKCDKTGRIWAGTMGASPTSIGELVKGKGTLYNFFNNKATPHRDGIGISNGIAFDYKRGKMYYTDSFSFRVDQYDIDFSQGKISNMKTIFSIKNQSELAEETFCDGMTLDSDXNIWLALFISSKVYQIDPSKQRV

SEQ ID NO: 20777 - protein, 283 aa, Diabrotica virgifera
  misc_feature: Coding regions on vcDNA: vcDNA=SeqID_474; Strand=-; Position=564-1415
  misc_feature: Homolog annotation: Hit_ID=XP_319430.1; Match level="QueryCoverage =97%, HitCoverage=48%, E-value=5e-63, Identity=49%"; Hit description =ENSANGP00000014465 [Anopheles gambiae]
  misc_feature: Gene Ontology Annotation: Molecular function=gamma-glutamyl transferase activity; Cellular component=integral to plasma membrane; Biological process=spermatogenesis
  misc_feature: Pfam annotation: Pfam_ID=G_glu_transpept; Match level="Score=-2.4, E -value=1.3e-12, Copies=1"; Pfam description=Gamma -glutamyltranspeptidase
LHASGFIDVTKPDSVLTNQRIVESFKFAYAKRTKFADPDFFDFTPILKNLTSAKFTEATRKLIKDNETSQDPFYYGASTNFQQDHGTSHISVLSPQGDAVAVTSTINFIWGAGFQSNSTGIILNDSMDDFSQPNAVNGFGLPPAATNFIKPGKRPMSSMVPVIVLDEKKNVIMVIGGAGGSKITTANALTIIKHLWFGKDLSTAVNEMRLHHQLFPMKVIYEEGYKTKGIDIVNGLKKIGHEHDFKDDYGFAAVTAISKNSTTGQTEAVTDRRRSGSVAYVTA

SEQ ID NO: 20778 - protein, 287 aa, Diabrotica virgifera
  misc_feature: Coding regions on vcDNA: vcDNA=SeqID_475; Strand=+; Position=10-876
  misc_feature: Homolog annotation: Hit_ID=NP_503102.1; Match level="QueryCoverage =90%, HitCoverage=39%, E-value=3e-33, Identity=33%"; Hit description =reverse transcriptase family member (4S335) [Caenorhabditis elegans] pir||T24354 hypothetical
  misc_feature (112)..(112): Xaa can be any naturally occurring amino acid
  misc_feature (121)..(121): Xaa can be any naturally occurring amino acid
  misc_feature (214)..(214): Xaa can be any naturally occurring amino acid
  misc_feature (223)..(223): Xaa can be any naturally occurring amino acid
NLQGPANKINIRIGIRQGDIMSPKLLTVLEHALKSLELENKGIHIDSEMLSRHPRFADDIVLISDDLKTANDMLNELRDAARKVGLNINYQKTNMMTNLVPSHPLKVEDVEXKLLTANSGXAAYGRLRDIFKGDIPIRLKRRAFNQCVLPVLTYGAETLTLIRTSARKLQVTQRRMERSLLGITLRDRVRNEEIRGRSGVEDIIKHIAKIKWNXAGHVARRWXRDDRWTKKILEWRPRADRRNPGRPPTRCTDDIKRICTNWIAAAQDRPEWKFFEEAYVQQWTTMG

SEQ ID NO: 20779 - protein, 341 aa, Diabrotica virgifera
  misc_feature: Coding regions on vcDNA: vcDNA=SeqID_476; Strand=+; Position=1-1022
  misc_feature: Homolog annotation: Hit_ID=AAF12816.1; Match level="QueryCoverage =99%, HitCoverage=76%, E-value=3e-79, Identity=34%"; Hit description =zinc finger protein ZNF228 [Homo sapiens] sp|Q9UJU3|Z228_HUMAN Zinc finger protein 228
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=343.6, E-value =2.8e-100, Copies=12"; Pfam description=Zinc finger, C2H2 type
  misc_feature (306)..(306): Xaa can be any naturally occurring amino acid
  misc_feature (316)..(316): Xaa can be any naturally occurring amino acid
KEKRRNDEEKRLECEICLKRFRSNSEVKSHKRIHTGETFKCELCPKEYFSNSTLKSHMKWHTGETFSCKICSKQFVRNSKFKAHMLKHSGGGKERRFACVICSETFSTNYNLRQHSRWHTGETYTCEICSKQFVDNHYYNVHLRLHTGAKPFQCEICLKDFSLKSSLKVHMRVHTGEKPFSCEICSKSFITSSHLKEHMGKHTKEEPYECKNCPRKFATSSRLKSHMMVHMGNRPFKCEICPRQYKTNKDLQLHIKSHTGGETFSCEVCSQLLSTNSSLAFHMRTHTEGRPFTCEVCSKGFFSRAXVKVHMRVHTXELFPCEVCPKQFLTNYNLKIHMRRH

SEQ ID NO: 20780 - protein, 406 aa, Diabrotica virgifera
  misc_feature: Coding regions on vcDNA: vcDNA=SeqID_477; Strand=+; Position=45-1265
NINPARRLELQTYKQQAIKLEKRLRNCKELKKNLQELMSTKNLTSSPYFDGNSHIEALGISSARSSVQPKKKPNLSRDIIDVTEYSNDGIKLINREEDMVCESRQGQTDFNQGQLLSVGDAYESDSSLNKSSEIPVSSVMSSAREPHSQWATPDFIGSCDNQGHFSPRAWASPKPTRSTPPRNKSKSATAKPSSSPKPRLIRSNSYTLESPSPILLAHLQKCCKTNLEVPEASGNLSRGWTSLENNFSLNSEDSEFSSLNTVYNANLSSQTVSDKVPLDGVGDKELRLQKDTGQKSPTIEVVQTDISVQHITVNANSENIEPVKGTLDLTNPDCQLMQVLKKIPEDYSKQIIELLEKRRQEHQDKVENFGKQFKEASSKDEEVDDTDSITFGAGPVGRTIAQSRTN

SEQ ID NO: 20781 - protein, 99 aa, Diabrotica virgifera
  misc_feature: Coding regions on vcDNA: vcDNA=SeqID_478; Strand=+; Position=558-857
SCTLLVPVPHATGPDTARCWFLEYLIGGPRCFQSDNPDCFTTVTFREHPTNVVRDVPMTVVSTIIIGFDGYSRFVRWSFQEILDIGSMRFSASIPPARC

SEQ ID NO: 20782 - protein, 234 aa, Diabrotica virgifera
  misc_feature: Coding regions on vcDNA: vcDNA=SeqID_479; Strand=+; Position=182-886
  misc_feature: Homolog annotation: Hit_ID=XP_312215.1; Match level="QueryCoverage =100%, HitCoverage=92%, E-value=5e-61, Identity=51%"; Hit description= ENSANGP00000010284 [Anopheles gambiae]
  misc_feature (217)..(217): Xaa can be any naturally occurring amino acid
MPPIKLSTSNSGVNDLSDNEVSGNESQHSNSSRENDVAHDSTEDEPDSDDSSEMDEGECETRRNALLQHVQDLEKQFCHLREQLFRERMTQVECQLAEVKTGKSPEYLISLHELQDNMKIRTEVAGILKQLKLQNITNQYEAEIQAALQNFESEKSLTCDYIYSELMETIRRLEEDRHNSEISWGEGGEWGSRSRSRSRRKAVTVSGPYIVYMLKPXDILEDWTVIRKALKRTS

SEQ ID NO: 20783 - protein, 281 aa, Diabrotica virgifera
  misc_feature: Coding regions on vcDNA: vcDNA=SeqID_480; Strand=+; Position=112-954
  misc_feature: Homolog annotation: Hit_ID=XP_393151.1; Match level="QueryCoverage =99%, HitCoverage=55%, E-value=1e-141, Identity=87%"; Hit description= similar to CG9987-PA [Apis mellifera]
  misc_feature: Gene Ontology Annotation: Molecular function=molecular_function unknown
  misc_feature: Pfam annotation: Pfam_ID=UPF0027; Match level="Score=105.8, E-value =1.1e-28, Copies=1"; Pfam description=Uncharacterized protein family UPF0027
  misc_feature (202)..(202): Xaa can be any naturally occurring amino acid
  misc_feature (224)..(224): Xaa can be any naturally occurring amino acid
  misc_feature (240)..(240): Xaa can be any naturally occurring amino acid
  misc_feature (242)..(242): Xaa can be any naturally occurring amino acid
  misc_feature (247)..(247): Xaa can be any naturally occurring amino acid
  misc_feature (261)..(261): Xaa can be any naturally occurring amino acid
MVVRQYNQELEYLEKINSHCWRIKKGFQPNMNVEGVFYVNQTLEKLMFDELRNACRPGMVGGFLPGVKQIANVAALPGIVGRSVGLPDVHSGYGFAIGNMAAFDVNDPKSIVSPGGVGFDINCGVRLLRTNLFEQDVMPIKEQLAQSLFDHIPVGVGSKGIIPMNAKDLEEALEMGMDWSLREGYIWAEDKEHCEEYGRMLXADPSKVSMRAKKRGLPQLGTLXAGNHYAEIQVVEEIYXQXAASRXGIEEKRQICVMITXESRGFGHQVATDALVQMEKP

SEQ ID NO: 20784 - protein, 351 aa, Diabrotica virgifera
  misc_feature: Coding regions on vcDNA: vcDNA=SeqID_481; Strand=+; Position=136-1191
  misc_feature: Homolog annotation: Hit_ID=XP_317211.1; Match level="QueryCoverage =79%, HitCoverage=73%, E-value=4e-51, Identity=38%"; Hit description =ENSANGP00000011408 [Anopheles gambiae]
  misc_feature: Gene Ontology Annotation: Molecular function=galactosyltransferase activity; Cellular component=integral to Golgi membrane; Biological process=glycosphingolipid biosynthesis
  misc_feature: Pfam annotation: Pfam_ID=Gly_transf_sug; Match level="Score=56.0, E -value=1e-13, Copies=1"; Pfam description=Glycosyltransferase sugar -binding reg
MMKFYFKYRRRWMTFLIYFTLAVITIVLIHSLITEKNTIQCYRIKTEKSLPSIANFNPQPGKSIFFHETSCRSFYRGKIWISSRQACAVESVAKLNPNKEVYLLYTSPMDFKFEGDESDRFLKVILSYPNVKILHLDYENYTRGSPVEDLYRSGKIESSRHVVAHASDVLRYLTLWKYGGLYMDLDVIALKPVDDLEDNYAGIESSSVVASGVLNFDAAGEGHKLVERCLMDLKEIFDGHVWSKNGPGSITSLLESLCKANKTEDMLNNDCEGFTPYPSHTFFPPGLWTKRGRMAFPRKIPFEIVNGTLPPKKISSLFPRGETKLRGKKKKKKSPPPGTSGPPLFFFFFFF

SEQ ID NO: 20785 - protein, 80 aa, Diabrotica virgifera
  misc_feature: Coding regions on vcDNA: vcDNA=SeqID_482; Strand=-; Position=490-732
TKFAQPSEHKTIQNKKFLPYTLFCSNQLNLSLKKEELLKIVGVYTKLIKFCGIYFIHYIKIFLICTINNFLVCYQYIIMV

SEQ ID NO: 20786 - protein, 278 aa, Diabrotica virgifera
  misc_feature: Coding regions on vcDNA: vcDNA=SeqID_483; Strand=+; Position=26-862
  misc_feature: Homolog annotation: Hit_ID=AAL31972.1; Match level="QueryCoverage =88%, HitCoverage=88%, E-value=2e-78, Identity=55%"; Hit description =mitochondrial ribosomal protein S15 [Drosophila melanogaster]
  misc_feature: Gene Ontology Annotation: Molecular function=structural constituent of ribosome; Cellular component=mitochondrial small ribosomal subunit; Biological process=regulation of growth
  misc_feature: Pfam annotation: Pfam_ID=Ribosomal_S15; Match level="Score=-7.3, E -value=0.0045, Copies=1"; Pfam description=Ribosomal protein S15
MNSLKYLNTNSFLSICINNVPNIFSRNYAFKSDLKIKWVRPEKIPCFKPQKSGDLQGYPDVDKKQFQLQFRDSKELQTADDNVKKLFTLEFAPRSCSSKLFQYDMMEKVRRHDHDYSTVETRIARWTGIIRAMQEVMERFPRNKKTKVTLKELIDRRKKHLKYLRRWDYKKFEWLLETLDIVYKPPPNHFHWITRKESLRKLTDKYCDGIKEDRLKQYRLKLETEQPAFLEEKIRTLQFIRDEQKECGAEITITEEEIDEVKRQLEELKKNIGEDKTA

SEQ ID NO: 20787 - protein, 209 aa, Diabrotica virgifera
  misc_feature: Coding regions on vcDNA: vcDNA=SeqID_484; Strand=+; Position=126-755
  misc_feature: Homolog annotation: Hit_ID=XP_392760.1; Match level="QueryCoverage =95%, HitCoverage=43%, E-value=5e-64, Identity=62%"; Hit description =similar to ENSANGP00000011882 [Apis mellifera]
  misc_feature: Gene Ontology Annotation: Molecular function=structural molecule activity; Cellular component=mitochondrion; Biological process=growth
  misc_feature: Pfam annotation: Pfam_ID=OSCP; Match level="Score=204.7, E-value=1.8e- 58, Copies=1"; Pfam description=ATP synthase delta (OSCP) subunit
MASQNLCMAVRNFSTSNAASQLVKAPLQIFGIEGRYASALYSAASKQKSLEGVEKDLLKLQAALKTDAKLRGFVDNPTIKRSLKSEALKAVAQKISLKPESANLLALLADNGRLNKLETVINAFKQIMAAHRGEVSCEVTTARDLDADQKQKLMGVLKSFVKSNQSIQLATKVDPSIIGGMIVSIGDRYVDMSVASKIKKYTEVISATV

SEQ ID NO: 20788 - protein, 253 aa, Diabrotica virgifera
  misc_feature: Coding regions on vcDNA: vcDNA=SeqID_485; Strand=+; Position=27-788
  misc_feature: Homolog annotation: Hit_ID=XP_396219.1; Match level="QueryCoverage =83%, HitCoverage=28%, E-value=2e-23, Identity=33%"; Hit description =similar to ENSANGP00000018364 [Apis mellifera]
  misc_feature: Gene Ontology Annotation: Molecular function=molecular_function unknown
  misc_feature: Pfam annotation: Pfam_ID=DUF233; Match level="Score=44.7, E-value =2.7e-10, Copies=1"; Pfam description=Odorant binding protein
MKSLLLVICCCAFYNVVQGRSLQQLPEYLQKYSCKESEPDYGKCVWEGFHNVWPFFMKGIPELGVLGLDPFRMKMFAVNSTVGNLIKIDAVCENAEVTGLANTVIQDLKADPIKHYGEIRLFIPWMYANFDYDVKGQLLVIPLESKGHFEGNFTETQVLVKGDLKTYLKDGVEYFKTGKLYLKARIGNGWVKLTSLEKEFQYAADIITDFYNENPRRVMDAINPIFIQYSKAFARQEMDKILSKLPAAAWLPK

SEQ ID NO: 20789 - protein, 495 aa, Diabrotica virgifera
  misc_feature: Coding regions on vcDNA: vcDNA=SeqID_486; Strand=+; Position=64-1551
  misc_feature: Homolog annotation: Hit_ID=AAF97938.1; Match level="QueryCoverage =98%, HitCoverage=100%, E-value=1e-115, Identity=41%"; Hit description=cytochrome P450 CYP6N3v3 [Aedes albopictus]
  misc_feature: Pfam annotation: Pfam_ID=p450; Match level="Score=319.5, E-value=5.1e- 93, Copies=1"; Pfam description=Cytochrome P450
MDILCILLYIILGLPLFVYLYQKWKYSYWRTRNVFHLEPKFPYGSAQSELKLNGAMTTIVEDLYHKVKSRGLKYGGYFEFLTPMFVPVDLELIRCIMMKDFPHFTNHGTYVNEEVDPLTGHLFNLEDEKWKIIRAKLTPTFTSGKMKMMFQTMVECTEGLQELLKKSAASKEPVDIKSNLSCFTTDVIGSVAFGVDINSMKNPDSDFRKFGNRIFVHTTLVRLKFIFLSIWPQWMIKKSGIKLFSKDMEDFYLNLIGDTVEYREKNSIIRKDFLQLLIELKDSLTIKEMAAQSFAFYAAGFETSSTTMSFALLELSQRQDIQDQLREEILEAFKKDGDTMTYDSIMGMELLEKVISETLRKHPPAGILPRICNKTYKDPNSDLVIEAGTRINVPVYAIHRDPDYYPDPETFDPERFSEENKANRTPFSYMPFGEGPRTCIGMRFGKLQAKVGLCCVLRNYKVTLNEKTKLPITYRSGFVSAVEGGLWVNLEPLKM

SEQ ID NO: 20790 - protein, 125 aa, Diabrotica virgifera
  misc_feature: Coding regions on vcDNA: vcDNA=SeqID_487; Strand=+; Position=613-990
  misc_feature: Homolog annotation: Hit_ID=EAL40633.1; Match level="QueryCoverage =56%, HitCoverage=13%, E-value=3e-09, Identity=40%"; Hit description =ENSANGP00000020605 [Anopheles gambiae str. PEST] ref|XP_558713.1| ENSANGP00000020605 [Anopheles gambiae st
SNSFGFLGNEDADSSARSAVTGADSETVLQCAPNDLKVLLKHVFSDWLDEWQNSNSKLRQIKDTVKRVKTVYKSCYEQAVFNRLRLGHTRLTYSYLFSRSEPPICESCNTQVTVIEMPKIYTRTY

SEQ ID NO: 20791 - protein, 449 aa, Diabrotica virgifera
  misc_feature: Coding regions on vcDNA: vcDNA=SeqID_488; Strand=+; Position=94-1440
  misc_feature: Homolog annotation: Hit_ID=XP_320987.1; Match level="QueryCoverage =98%, HitCoverage=67%, E-value=6e-93, Identity=40%"; Hit description =ENSANGP00000007803 [Anopheles gambiae]
  misc_feature: Pfam annotation: Pfam_ID=ABC_tran; Match level="Score=179.7, E-value =6.4e-51, Copies=1"; Pfam description=ABC transporter
MEESEDNYAVQITDVDKFFGSNIVLSKLCMKVKRGRIYGLLGASGCGKTTLLKAVVGICKIDSGEINVLGKLISEGNDEFPVSKLGYMPQDIALCGEFTVQDAIFYFGRLFGMKHKDILERYDKLYNLLELPPHDRYLRNCSGGEQRRVSLAATLVHKPDLLILDEPTVGLDPLIRERIWQHLLELTRTDNVTVIITTHYVDECRDVDTIGLLRKGKLLTEESPKYLMAKYEAETLEEVFLFLAREDKQRRRSSLPGLEKFNKIKPKTKTSRHCIKSFSVDRKRFGALLDKNWKQFYRNITGIFFLMSFPLLEIGAFLTSVGRDVSNIPIGIVNNELMDCSNFTPNGTTDPFAFFQCHFYNMSCRFLTHLEDPMINKIFYPNIDDAMLGVKQGDISGIIYMPKNFSENFELRFDTRDPDDIGVDFSQIKVWLDMSNYQIALSMKQKLIE

SEQ ID NO: 20792 - protein, 150 aa, Diabrotica virgifera
  misc_feature: Coding regions on vcDNA: vcDNA=SeqID_489; Strand=+; Position=77-529
  misc_feature: Homolog annotation: Hit_ID=XP_312325.1; Match level="QueryCoverage =82%, HitCoverage=70%, E-value=9e-25, Identity=47%"; Hit description =ENSANGP00000010600 [Anopheles gambiae]
MVLIRPEENQISSEAEGQVAAVRVKAPKRILHFSDGILEEYSTDEEDNTDSIKNQPLVDPSTLTWGPWFWYKAWRAGNTTLGAMDTAGEFLASLFGITTPRYYFELEEYKRREDQKRRQHDKEAGWSQPSGSSVSVPLKDMGGANKPIDV

SEQ ID NO: 20793 - protein, 168 aa, Diabrotica virgifera
  misc_feature: Coding regions on vcDNA: vcDNA=SeqID_490; Strand=+; Position=1-507
  misc_feature: Homolog annotation: Hit_ID=XP_314392.1; Match level="QueryCoverage =80%, HitCoverage=16%, E-value=4e-16, Identity=33%"; Hit description =ENSANGP00000000488 [Anopheles gambiae]
LYCSLVRPHLDYASCVWSPQYNCHINKIEQVQRKFLRYYAYKMHLTGQSYESLLQIIRLDSLQSRRQHKDLCFLYNLIHGHKFCIPLLNKIGLHVPSRTTRSVTTFHEFINRTNYGSNSCLSKTIKLANTLSPQIDFFVNDFTAFSTQPALNVLISRLICQLLLLSLF

SEQ ID NO: 20794 - protein, 449 aa, Diabrotica virgifera
  misc_feature: Coding regions on vcDNA: vcDNA=SeqID_491; Strand=+; Position=79-1428
  misc_feature: Homolog annotation: Hit_ID=XP_312351.1; Match level="QueryCoverage =97%, HitCoverage=92%, E-value=6e-55, Identity=27%"; Hit description =ENSANGP00000012766 [Anopheles gambiae]
  misc_feature: Gene Ontology Annotation: Molecular function=mevalonate transporter activity; Cellular component=integral to membrane; Biological process=mevalonate transport
  misc_feature: Pfam annotation: Pfam_ID=MFS_1; Match level="Score=65.7, E-value=1.3e- 16, Copies=1"; Pfam description=Major Facilitator Superfamily
MEKSPEKVPPEGGWGYLITLAVFIAHLSTVVPLASFGIVHGKFLASLGDETAGTSISTSLFIAVTCSAGLFGGILFNTYSYRTVGLLGAVLHLIGSILLVFAETLFQFIVCLSIIQSFGGGLLLPSAFSSLNEYFHKKLSLQTAIAQILITVATVVNPLVMTYCVHSYGYKTTKIILIGYSLVNFFGMWSLHPVEWHTKTEKDKASSDQKNIRDHAEKGALLGGEKEIDQEKHDKERQIEESTSTYMSYFDLLKSAKYLNIAIGTSLSFHGDNLFIGMLASVLRSINYSSIDIAKLTMVHFGCDLITRIIYASLSAFYSFNNRYLVYGSTLLTAIFRILFVINDGYSWRMAILVILGILRCFIQTPYSLVIAEAYRDNFARAFTLFCVLSGGTSLVLGPLMSLLKGLTNNDNIAVQVLTGGMLLSVFMWTLEFVYIKLSNKNRASQRNS

SEQ ID NO: 20795 - protein, 286 aa, Diabrotica virgifera
  misc_feature: Coding regions on vcDNA: vcDNA=SeqID_492; Strand=+; Position=34-891
  misc_feature: Homolog annotation: Hit_ID=NP_609252.1; Match level="QueryCoverage =93%, HitCoverage=26%, E-value=7e-71, Identity=48%"; Hit description =CG9466-PA [Drosophila melanogaster] gb|AAF52710.1| CG9466-PA [Drosophila melanogaster]
  misc_feature: Gene Ontology Annotation: Cellular component=Golgi membrane
  misc_feature: Pfam annotation: Pfam_ID=Glyco_hydro_38; Match level="Score=201.1, E -value=2.3e-57, Copies=1"; Pfam description=Glycosyl hydrolases family 38 N-termi
MGSTVVTICLFAVFSLTVYCKVTTEQAENKVGCAVCHPLDQERINIHLVPHSHDDVGWLKSFDEYYYGLKAHATTTPIAVKNIITSVVEELQRNKDRRYIQVETAFFYKWWKEQDETMRRAFKNLVDNGQLEIVNGGWSMNDEACTNYQSTIDQFTLGFRIIDEALGKCGRSRVGWQIDPFGHSREQSSILAQMGYNGMFFSRLDHSDRSIREKEHRMNFAWQGSANLDGSIIFGSIFPNAGYNSPDGFCWDISCQNDQIVDDNSSIHFNLDDQVRRFTDILDGYA

SEQ ID NO: 20796 - protein, 300 aa, Diabrotica virgifera
  misc_feature: Coding regions on vcDNA: vcDNA=SeqID_493; Strand=+; Position=90-989
  misc_feature: Homolog annotation: Hit_ID=NP_609408.1; Match level="QueryCoverage =97%, HitCoverage=27%, E-value=8e-71, Identity=45%"; Hit description =CG6206-PA, isoform A [Drosophila melanogaster] gb|AAF52958.2| CG6206- PA, isoform A [Drosophila
  misc_feature: Gene Ontology Annotation: Cellular component=extracellular space
  misc_feature: Pfam annotation: Pfam_ID=Glyco_hydro_38; Match level="Score=241.0, E -value=2.2e-69, Copies=1"; Pfam description=Glycosyl hydrolases family 38 N-termin
  misc_feature (232)..(232): Xaa can be any naturally occurring amino acid
  misc_feature (251)..(251): Xaa can be any naturally occurring amino acid
  misc_feature (274)..(274): Xaa can be any naturally occurring amino acid
MKVYATTTPIAVKNIITSVVEELQRNKDRRYIQVETAFFYKWWKEQDETMRRAFKNLVDNGHLEIVNGGWSMNDEACTNYQSTIDQFTLGFRIIDEALGKCGRSRVGWQIDPFGHSREQASILAQMGYNGMFFSRLDHSDRSIRKEEHRMDFAWQGSANLDDSIIFGSIFPNAGYDAPQGFCWDISCQNDQIVDDNSSIHFNLEDQVSRFTDILDGYAKFYSKDNKKYVGCXWGEDFQYQQSAMYFDNMDXLIKGFKNHEKYNLIYSTPSLYMXSVHDDNVNLTLKTDDFLPRKSKKKNH

SEQ ID NO: 20797 - protein, 466 aa, Diabrotica virgifera
  misc_feature: Coding regions on vcDNA: vcDNA=SeqID_494; Strand=+; Position=55-1451
  misc_feature: Homolog annotation: Hit_ID=XP_314895.1; Match level="QueryCoverage =95%, HitCoverage=69%, E-value=1e-163, Identity=63%"; Hit description= ENSANGP00000012480 [Anopheles gambiae]
  misc_feature: Gene Ontology Annotation: Molecular function=long-chain acyl-CoA dehydrogenase activity; Cellular component=mitochondrion; Biological process=energy derivation by oxidation of organic compounds
  misc_feature: Pfam annotation: Pfam_ID=Acyl-CoA_dh; Match level="Score=166.7, E -value=5.2e-47, Copies=1"; Pfam description=Acyl-CoA dehydrogenase, C- terminal do
  misc_feature (457)..(457): Xaa can be any naturally occurring amino acid
NNCLYCTHYFLEIYFCYSHNSKMLRTVIKTGIKEQKIVQSILLPRCISTSTTHNKTVQTSEKAQPTHSNESASFVMNIFRGQLEPKQMFPYPNVLNEEQRETLQMMIEPTLQFFEKVNNPTKNDELEKVEENTLKGLWELGAFALQVPQELGGSELSNTQYARLVEIVGANDLGVGITLGAHQSIGFKGILLFGNPEQKAKYLTMCSSGKVAAFCLTEPSSGSDAASIQTRAELSPDGKHYILNGSKIWISNGGTADVMTVFARTKVTNPKTGKVDDKVSAFIVERGFGGVTSGPPEKKLGIKCSNTTALFFDNTKIPAENLLGGLGNGFKVAMNILNNGRFGMAAALSGTMRTCIKKAVEFATQRKQFGHKLESYGGIQEKLARMAMYHYVTESMAYMISGNMDSGCTDYQLEAAISKCFASEAAGYVCDEAIQILGGMGFMKETGLERDLRDLRXFRIFEGTMT

SEQ ID NO: 20798 - protein, 90 aa, Diabrotica virgifera
  misc_feature: Coding regions on vcDNA: vcDNA=SeqID_495; Strand=+; Position=2-274
VLFALVLYCCSEVLCNNDKPQCEGIQCDMPNCPFGDILKYPGEEDTACCPYCEHNPNCEVCGDLPRCAPGSSLRLKQNSCCPSCEPFADS

SEQ ID NO: 20799 - protein, 101 aa, Diabrotica virgifera
  misc_feature: Coding regions on vcDNA: vcDNA=SeqID_496; Strand=-; Position=309-614
GVSLGNGNTSMVNRGHRAGYIYSKFSALPTPITELQGAPSTLPIRFLSHNSRTTLYISLTSGTHTSHSKPKRPTYQPREKSRSGPTKNYKIFVTLKQHPLY

SEQ ID NO: 20800 - protein, 288 aa, Diabrotica virgifera
  misc_feature: Coding regions on vcDNA: vcDNA=SeqID_497; Strand=+; Position=107-970
  misc_feature: Homolog annotation: Hit_ID=XP_316201.1; Match level="QueryCoverage =97%, HitCoverage=63%, E-value=1e-132, Identity=80%"; Hit description= ENSANGP00000017705 [Anopheles gambiae]
  misc_feature: Gene Ontology Annotation: Molecular function=protein transporter activity; Cellular component=cytosol; Biological process=retrograde (endosome to Golgi) transport
  misc_feature: Pfam annotation: Pfam_ID=Vps26; Match level="Score=662.0, E-value=4e -196, Copies=1"; Pfam description=Vacuolar protein sorting-associated p
RYYIFYGNIMSFFGFGQSAEIEVTLDGQDNRKTAEVKTEDGKKERLYLYYDGETISGKVNVSLKKPGTKLEHQGIKIEFIGQIEMFYDRGNHHEFISLVKELARPGDMIAHSSYPFEFSNVEKPFEVYTGTNVRLRYFLRVTIIRRLADIMKEIDIAVHTLSSYPEMNNSIKMEVGIEDCLHIEFEYNKSKYHLKDVIVGKIYFLLVRIKIKHMEIAIIKKETTGSGPHTYTENVTIAKYEIMDGAPVRGESIPIRVFLAGYDLTPTMRDINKKFSVRYFLNLVLMDT

SEQ ID NO: 20801 - protein, 314 aa, Diabrotica virgifera
  misc_feature: Coding regions on vcDNA: vcDNA=SeqID_498; Strand=+; Position=107-1051
  misc_feature: Homolog annotation: Hit_ID=EAA03649.2; Match level="QueryCoverage =90%, HitCoverage=95%, E-value=8e-64, Identity=42%"; Hit description =ENSANGP00000004017 [Anopheles gambiae str. PEST] ref|XP_560412.1| ENSANGP00000004017 [Anopheles gambiae st
  misc_feature: Gene Ontology Annotation: Molecular function=serine hydrolase activity; Cellular component=cellular_component unknown; Biological process=digestion
  misc_feature: Pfam annotation: Pfam_ID=Abhydrolase_1; Match level="Score=21.6, E -value=0.0013, Copies=1"; Pfam description=alpha/beta hydrolase fold
  misc_feature (275)..(275): Xaa can be any naturally occurring amino acid
  misc_feature (302)..(302): Xaa can be any naturally occurring amino acid
  misc_feature (306)..(306): Xaa can be any naturally occurring amino acid
QRSAARLFKVNKFGNIHRYSSSTKREFKEIKIKVPWGYVAGKWWEPYDIRPVLTIHGWQDNCQSFDRLIPLLNKNVGFLAIDLPGHGYSSKFPNGMLYHLANYLLIIKSLSKTFEWPNTSLMGHSLGAVTSYIYSMLYPSEVDYLICLDAVKPMVSKKQHQHYAAALEKFFKYNNFLTSGEPPSYTIEEISKLVSTAHRHSILPENAKYIYERNIAPSEVHPGKYYFTRDPRLKTGSFTTYCQRDLVELAQHITMPIFIAKAKDSIYYEDKENFXRVIDVIKRSSSDCDFHYVPGSHHVHLXHPEXVSDLIIFY

SEQ ID NO: 20802 - protein, 258 aa, Diabrotica virgifera
  misc_feature: Coding regions on vcDNA: vcDNA=SeqID_499; Strand=+; Position=152-925
  misc_feature: Homolog annotation: Hit_ID=NP_723804.1; Match level="QueryCoverage =97%, HitCoverage=45%, E-value=4e-33, Identity=35%"; Hit description =CG6043-PC, isoform C [Drosophila melanogaster] gb|AAN10833.1| CG6043- PC, isoform C [Drosophila
  misc_feature: Gene Ontology Annotation: Molecular function=profilin binding; Cellular component=lamellipodium; Biological process=actin filament organization
  misc_feature (249)..(249): Xaa can be any naturally occurring amino acid
MDPPACVQNAMMTKDKKPFTYTPGGIDLSEARSPRLQRRIERNANLGGVGDIPQHPAPHPPISGPLPPSALAAMRPQPQVQVFPSGPPPPAPMRGGAPPPPPPPKQGIPPPPPPPSCPLPTQKVQTSDNQVLERPDMTKIIPDNPMALLRKTGGPQPRRSLVDQIFEESGKSAPEPRTPPVQSQQQYQPPQQRIQSGGTPISPVPQQTYKPSLPQQQQQYQPQAQPQYQPQQYQPQIQQQQQYQPPIQXTTPPRETYS

SEQ ID NO: 20803 - protein, 338 aa, Diabrotica virgifera
  misc_feature: Coding regions on vcDNA: vcDNA=SeqID_500; Strand=+; Position=3-1019
  misc_feature: Homolog annotation: Hit_ID=XP_394529.1; Match level="QueryCoverage =93%, HitCoverage=27%, E-value=1e-90, Identity=61%"; Hit description =similar to nubbin [Apis mellifera]
  misc_feature: Gene Ontology Annotation: Molecular function=transcription factor activity; Cellular component=nucleus; Biological process =transcription from Pol II promoter
  misc_feature: Pfam annotation: Pfam_ID=Pou; Match level="Score=193.1, E-value=5.6e -55, Copies=1"; Pfam description=Pou domain - N-terminal to homeobox d
KLVGVINIKFLVRPSNEQPRISTPNSQVTSSSPGVGAALAALGSLGGIFGNHLQMLGSLPAFQSPQSLQQLQQLAMLQQASGNQMNPQAQFLFQNQGFLQGFPRTSIPSRPPHTMQVQQIAQAAQQLQQLQKVQQNTNQHNTSIPQNTTLPHQTQTTPPNNHNIPASMLTPSTPSSGGLTPQHLKTPSRILEPSPEETTDLEELEQFAKTFKQRRIKLGFTQGDVGLAMGKLYGNDFSQTTISRFEALNLSFKNMCKLKPLLQKWLEDADSTLTNPGSLSNPLTTPETIGRRRKKRTSIETSARVALQKAFDQNPKPTSEEITMMSDGLCMEKEVVRV

SEQ ID NO: 20804 - protein, 51 aa, Diabrotica virgifera
  misc_feature: Coding regions on vcDNA: vcDNA=SeqID_501; Strand=+; Position=399-554
GRFNNIHHLFFYNYFLYKILYNFVLDFYKNSYFNIKNIVIMIKLVFYINKI

SEQ ID NO: 20805 - protein, 148 aa, Diabrotica virgifera
  misc_feature: Coding regions on vcDNA: vcDNA=SeqID_502; Strand=+; Position=2-445
ANASAIFFILLSLMFLEFVVGDDVQYYTDSTTSAPDPAPFWTTAPIPRSTSIGEDVVYVQDRQVPDPTYEIDAVEAFKEAKALHPVVDGTQLLETFSKLFNNKHPIDGGWKVVENLGPLYNPNADYIYIELRVIDANGDRTIRISNAK

SEQ ID NO: 20806 - protein, 215 aa, Diabrotica virgifera
  misc_feature: Coding regions on vcDNA: vcDNA=SeqID_503; Strand=+; Position=225-869
  misc_feature: Homolog annotation: Hit_ID=XP_319210.1; Match level="QueryCoverage =91%, HitCoverage=34%, E-value=4e-38, Identity=37%"; Hit description =ENSANGP00000019251 [Anopheles gambiae]
  misc_feature: Gene Ontology Annotation: Molecular function=beta-N -acetylhexosaminidase activity; Cellular component=extracellular space
  misc_feature: Pfam annotation: Pfam_ID=Glyco_hydro_20b; Match level="Score=51.0, E -value=3.4e-12, Copies=1"; Pfam description=Glycosyl hydrolase family 20, domain
MKFKIQLLSTFLCTSLVYAYIEEPGPRYPPTKGELWPKPYHQIKNHSFFTVRKEHFNFKIINNTCSIVEEAIKNYESIIFSGYTLMQENLNLSNHHLEKKPWLSNPKYLGILDVLEISLDIHCNGKEMPSDHMEEAYTIIVSEDVKRLKAFSVWGILRGLESFSQMIYMTNEGLSLRINKTSVEDRPRFSHRGLLIDTSKHFIPIKNILLTLNPD

SEQ ID NO: 20807 - protein, 85 aa, Diabrotica virgifera
  misc_feature: Coding regions on vcDNA: vcDNA=SeqID_504; Strand=+; Position=542-797
  misc_feature: Homolog annotation: Hit_ID=XP_319210.1; Match level="QueryCoverage =100%, HitCoverage=13%, E-value=2e-20, Identity=51%"; Hit description= ENSANGP00000019251 [Anopheles gambiae]
  misc_feature: Gene Ontology Annotation: Molecular function=beta-N -acetylhexosaminidase activity; Cellular component=extracellular space
  misc_feature (12)..(12): Xaa can be any naturally occurring amino acid
MEEAYTIIVSEXEKRLKAFSVWGILRGLESFSQMIYMTNEGLSLRINKTSVEGRPRLSHRGLLIDASRHFIPIKNILLTLDAMVY

SEQ ID NO: 20808 - protein, 225 aa, Diabrotica virgifera
  misc_feature: Coding regions on vcDNA: vcDNA=SeqID_505; Strand=+; Position=56-733
  misc_feature: Homolog annotation: Hit_ID=AAM44044.1; Match level="QueryCoverage =100%, HitCoverage=100%, E-value=9e-56, Identity=50%"; Hit description=ferritin 2 [Apriona germari]
  misc_feature: Pfam annotation: Pfam_ID=Ferritin; Match level="Score=28.7, E-value =4.4e-06, Copies=1"; Pfam description=Ferritin-like domain
MKTFIVLSFLCVAALASEDFCYQDAVTACNPTAAKYVDKLNCTAKFGAIDAVESDLQKFINHHFIRSFEYLLLATNFATYERNRAGFEKLFRGLSDNKWHEGIEFIKYLTSRGGHMNFNAISKDIKGEEAEARSFDLRELTAIAKALDIEKKFVHEAHSIHREATRNNKQFHDPEISDYLEKEVVHKERDLIRKLAGYSTDLAGLLNGPDSSLALFMFDDYLQKQ

SEQ ID NO: 20809 - protein, 230 aa, Diabrotica virgifera
  misc_feature: Coding regions on vcDNA: vcDNA=SeqID_506; Strand=+; Position=98-790
  misc_feature: Homolog annotation: Hit_ID=AAM44044.1; Match level="QueryCoverage =98%, HitCoverage=100%, E-value=8e-58, Identity=52%"; Hit description= ferritin 2 [Apriona germari]
  misc_feature: Pfam annotation: Pfam_ID=Ferritin; Match level="Score=47.5, E-value =3.9e-11, Copies=1"; Pfam description=Ferritin-like domain
MPGIMKAFIVLSIFCVAALASQDSCYNDAVTACDPAAARSVDKLNNCNAKFGGIDSAQSDLQKFVNHNFIRSFEYLLLATNFDNYQRNRKGFEKLFRGLSDKKWNDGIEFIKYLTARGGEVDFNEISDGVKKEEAQPVSFDLNELTAVSKALDLEKKYVHDAFSIHLGAARSNKQFYDPELTDYLEKEVVHEQREIIRKLAGYSTDLSGLLDGPDSSLALFMFDDYLQKQ

SEQ ID NO: 20810 - protein, 229 aa, Diabrotica virgifera
  misc_feature: Coding regions on vcDNA: vcDNA=SeqID_507; Strand=+; Position=147-836
  misc_feature: Homolog annotation: Hit_ID=AAM44044.1; Match level="QueryCoverage =98%, HitCoverage=100%, E-value=1e-55, Identity=50%"; Hit description= ferritin 2 [Apriona germari]
  misc_feature: Pfam annotation: Pfam_ID=Ferritin; Match level="Score=28.7, E-value =4.4e-06, Copies=1"; Pfam description=Ferritin-like domain
MPGIMKTFIVLSFLCVAALASEDFCYQDAVTACNPTAAKYVDKLNCTAKFGAIDAVESDLQKFINHHFIRSFEYLLLATNFATYERNRAGFEKLFRGLSDNKWHEGIEFIKYLTSRGGHMNFNAISKDIKGEEAEARSFDLRELTAIAKALDIEKKFVHEAHSIHREATRNNKQFHDPEISDYLEKEVVHKERDLIRKLAGYSTDLAGLLNGPDSSLALFMFDDYLQKQ

SEQ ID NO: 20811 - protein, 488 aa, Diabrotica virgifera
  misc_feature: Coding regions on vcDNA: vcDNA=SeqID_508; Strand=+; Position=86-1549
  misc_feature: Homolog annotation: Hit_ID=XP_321667.1; Match level="QueryCoverage =99%, HitCoverage=84%, E-value=1e-94, Identity=42%"; Hit description =ENSANGP00000011474 [Anopheles gambiae]
  misc_feature: Gene Ontology Annotation: Molecular function=telomeric DNA binding; Cellular component=nucleus; Biological process=nucleobase, nucleoside, nucleotide and nucleic acid metabolism
  misc_feature: Pfam annotation: Pfam_ID=RRM_1; Match level="Score=139.1, E-value =1.1e-38, Copies=2"; Pfam description=RNA recognition motif. (a.k.a. RRM, R
  misc_feature (455)..(455): Xaa can be any naturally occurring amino acid
  misc_feature (474)..(475): Xaa can be any naturally occurring amino acid
MSESPKDRRGRDRDRPRNNRDNRNNKGDNSRERSNDRGPREPRSMRPSQNRVYVSNIPYEYRWQDIKDLFRSKIGDVTFVELFVDDNDKPRGSGIVEFNDSDLVGKCLELMQRYEVKGRKLVVKDDQGITRDKFGAIVSNQGGGKRREYNRFNDNMNSMNIDLGNTLNLGNDKWGNTYGLSPQFLESLKIDPPLNNKVFVANLDYNIDKKKIKDVFKLAGRVINVDMPLDKDGKVRGFAVVEYDHPVEAVQAISMLQGQVLNDRTLAVRMDRVNDNSKLPEGLRSVGMGLGPNGEALKNVAHNLPSLGSGSQGGTTGSGLLGAVPNSSLQLANALSGLGNVGNLAGLNQNFSGLASTLLGNGLGATEFSSLVQNPLSAQNSATQQLSGLNNQNSTSGNLGNFNRGSSGDNYGNQNSNNWSSNNNSSNGGGRNFQSGNNNYGGNDRMSFNGTRQDXGGKSFSRKSVISNLPYSAXXQLLHEKFTEFGDV

SEQ ID NO: 20812 - protein, 380 aa, Diabrotica virgifera
  misc_feature: Coding regions on vcDNA: vcDNA=SeqID_509; Strand=+; Position=1-1139
  misc_feature: Homolog annotation: Hit_ID=XP_392361.1; Match level="QueryCoverage =99%, HitCoverage=10%, E-value=1e-124, Identity=57%"; Hit description= similar to CG30171-PB [Apis mellifera]
  misc_feature: Gene Ontology Annotation: Molecular function=protein serine/threonine kinase activity; Cellular component=actin cytoskeleton; Biological process=protein amino acid phosphorylation
  misc_feature: Pfam annotation: Pfam_ID=I-set; Match level="Score=66.4, E-value=7.6e- 17, Copies=1"; Pfam description=Immunoglobulin I-set domain
  misc_feature (90)..(90): Xaa can be any naturally occurring amino acid
LHASAEAFLEAKQEGRLPFFREKPSLAAMTEGQDLELTCLAVGEPQPIVQWFKNDSIVAESHRIKIFTDADGRSHFKLTPALNFDQGLYXVVARNKIGQVVSRTRIVLGLVPDEPDSPEAQQMSDTEILLTWKQPRFDGNAAVICYSLEYKAADELDWIKKADNIDHEFYLISGLESNKSYIFRLAAKNSIGWSDPGVPSAPVTTKPSGSPKIQLSKAMLHLQQLTDSGKEVDEESKTRLDYKLESSPVEWEDSNVQQEYNFISEIARGKFSVVLKGVDKRNDTVVVAKILDYIDKTREDVEGEFAALRSLRHERIASLLAAYRTNGTAVFILEKLQGADILTYLASRHEYTEQTVTTIVSQNLDGLQYLHWRRLWHLDL

SEQ ID NO: 20813 - protein, 350 aa, Diabrotica virgifera
  misc_feature: Coding regions on vcDNA: vcDNA=SeqID_510; Strand=+; Position=94-1146
  misc_feature: Homolog annotation: Hit_ID=XP_394165.1; Match level="QueryCoverage =84%, HitCoverage=19%, E-value=5e-81, Identity=55%"; Hit description =similar to CG31019-PA [Apis mellifera]
  misc_feature: Gene Ontology Annotation: Molecular function=DNA binding; Cellular component=nucleus; Biological process=RNA processing
  misc_feature: Pfam annotation: Pfam_ID=RRM_1; Match level="Score=23.9, E-value =0.00017, Copies=1"; Pfam description=RNA recognition motif. (a.k.a. RRM, RB
MSSSPEPSNRISPNPFSPNYRHKSDSGSKSPVSNRRQNGYLKKSQYDSDSGDSDYAQDHVRENRKARSRSPDQQDRDRDRRERHRTRDRDRDHRRQRSRSSSSRWEKKQKRDRDRDRCRDDDRDSTSERSYGCMPIGASGSEIIGFKSQPPNNTIMIRGLAQHISEYDIRQDIIGCDLFPKDIRLIRKKDTGASRGFAFVEFSTLGEAVRWMEKKQGVLMLQDQYRAIMQYSIPKDSNSAEKTPSYKASADWFCIKCGAQNFKRRDNCFKCHASKTESEEGGSGSDEVCMYATKTIMLRNLDPLTTEESVMAVLKQIIPELVETISVVCIGRDPLTSTSRGLCYLETSSY

SEQ ID NO: 20814 - protein, 125 aa, Diabrotica virgifera
  misc_feature: Coding regions on vcDNA: vcDNA=SeqID_511; Strand=+; Position=2-379
SKAIFFIKTKMFSTPFKIPRVRAVLILVTLSPSSADNYNKCPETSHERYLIYQNTLKGRVIHVRIPGTGFFHAPITCLQVTDINESFSTPVIEEGGYGKEYVVLRIDPVQSGEQLQYDVQIYVDQ

SEQ ID NO: 20815 - protein, 135 aa, Diabrotica virgifera
  misc_feature: Coding regions on vcDNA: vcDNA=SeqID_512; Strand=+; Position=2-409
YYLFCEAALLGKIKMFSATFKLLFLITVILVSLSPSSADNYNKCPETSHIRSLIYQNTLKGRVIHVRIPGTGFFEAPITCLQVTDINESFSTPVVEEGGYGREYVVLRIDPVESGEQLQYDVQIYIDEAVTAYPQ

SEQ ID NO: 20816 - protein, 142 aa, Diabrotica virgifera
  misc_feature: Coding regions on vcDNA: vcDNA=SeqID_513; Strand=+; Position=1-429
ILCCEAALLLKIKMFSTIFKLLFLVTTLILVDISPSRADNYNKCPETSHLRSLIYQNTLKGRVIHVRIPGTGFFEAPITCLQVTDINESFSTPVVEEGGYGREYVVLRIDPVESGEQLEYDVQIYIDEDTRTTAWRKTRHQL

SEQ ID NO: 20817 - protein, 290 aa, Diabrotica virgifera
  misc_feature: Coding regions on vcDNA: vcDNA=SeqID_514; Strand=+; Position=101-972
  misc_feature: Homolog annotation: Hit_ID=XP_309491.1; Match level="QueryCoverage =92%, HitCoverage=60%, E-value=1e-103, Identity=65%"; Hit description= ENSANGP00000022034 [Anopheles gambiae]
  misc_feature: Gene Ontology Annotation: Molecular function=arylformamidase activity; Cellular component=cellular_component unknown; Biological process=nitrogen metabolism
  misc_feature (276)..(276): Xaa can be any naturally occurring amino acid
  misc_feature (280)..(280): Xaa can be any naturally occurring amino acid
MNKNFVKFQQIAKYATMADVQARFVLPKRYEGSGSSVWTEYIQMAIDYKPLNLGQGFSDYSPPKYITDNLAEVSHSSNPLMQQYTRGFGHPRLVKAIANLYSPLIGRNLDERNEVITTSGAYEALFSAISGHTDLGDEVIILEPFFDCYEPMVKYAGGVPVFIPLTPKESRGKLPTSADWTFDKLELEKAFNEKTKIIIVNSPNNPLGKVFSIDELTFIADLCKKWNVLCISDEVYEWIVYKPHEHIKMATLPDMWERTITIGSAGKSFSVTGWEXGWAXGPEFLMKNLH

SEQ ID NO: 20818 - protein, 372 aa, Diabrotica virgifera
  misc_feature: Coding regions on vcDNA: vcDNA=SeqID_515; Strand=+; Position=2-1120
  misc_feature: Homolog annotation: Hit_ID=AAH14712.1; Match level="QueryCoverage =88%, HitCoverage=85%, E-value=5e-39, Identity=31%"; Hit description =Zfp617 protein [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=182.1, E-value =1.2e-51, Copies=9"; Pfam description=Zinc finger, C2H2 type
NKRAIFETIDTTPIVNTVESSVPKKTKTAKQKIVSKKSKPIIKQNQTQPNSELVENSNEATTEEDANEGNVKHDISTEGAEKTNQPNTQKEKKKSLDQDVQKILGEVQKRIGNTGFTCKTCNLSFSDRKSFNLHKRTHGKSQCHICGRYITKDNMGKHVKMHTAGPEVCTLCGLTFKNFDCLRCHIYHYHKHSAQQFMCEECGKSFRMKYTFLLHKKKVHMGIKNCKCSTCGKAFFANSKLLSHIRMTHEKLRPHVCEYCGTGFFSRYALRTHERQHTDEKPFVCQHCSEGFRQRVSLRSHLKSKHGIEEAKDFLCKTCEKGFATDYALSVHQRSHETKKCEICSENFAGDEYLANHLREIHHLEVEMNQDS

SEQ ID NO: 20819 - protein, 290 aa, Diabrotica virgifera
  misc_feature: Coding regions on vcDNA: vcDNA=SeqID_516; Strand=+; Position=61-931
  misc_feature: Homolog annotation: Hit_ID=XP_397133.1; Match level="QueryCoverage =93%, HitCoverage=68%, E-value=2e-84, Identity=56%"; Hit description =similar to fem-1 homolog b; FEM-1-like death receptor binding protein; FEM-1 (C.elegans)
  misc_feature: Gene Ontology Annotation: Molecular function=death receptor interacting protein activity; Cellular component=cellular_component unknown; Biological process=induction of apoptosis
  misc_feature: Pfam annotation: Pfam_ID=Ank; Match level="Score=153.1, E-value=6.2e -43, Copies=6"; Pfam description=Ankyrin repeat
  misc_feature (267)..(267): Xaa can be any naturally occurring amino acid
  misc_feature (274)..(274): Xaa can be any naturally occurring amino acid
  misc_feature (282)..(282): Xaa can be any naturally occurring amino acid
MCTVKYEYIPDDHLINRIYFASKDGMSIALYTSIGGLDKNKVNELLNETVDDAGQRCTPLMIAAKKGHDKVVRSLLTNYEPNLEKEGIVRFDGYVIDGATALWCAAFAGHLSICKYLIKAGSDVNHGTKTDSTPLRAACFDGRLDIVQYLVHHKADINKANKYNNTCLMIASFKGHLEVVKFLLENGANVNERALCGGTALHFAAESDHVKVVKELLKYDAIFSTNEAGLTPIKSAAEKTKERVVEFLISREDITVEDRIEALELLXASFANDXRNYDITKXLQYMLFIM

SEQ ID NO: 20820 - protein, 347 aa, Diabrotica virgifera
  misc_feature: Coding regions on vcDNA: vcDNA=SeqID_517; Strand=+; Position=74-1113
  misc_feature: Homolog annotation: Hit_ID=XP_393982.1; Match level="QueryCoverage =93%, HitCoverage=64%, E-value=7e-40, Identity=34%"; Hit description =similar to ENSANGP00000011742 [Apis mellifera]
  misc_feature: Gene Ontology Annotation: Molecular function=translation activator activity; Cellular component=nucleus; Biological process=cytoplasm organization and biogenesis
  misc_feature: Pfam annotation: Pfam_ID=bZIP_1; Match level="Score=60.2, E-value=6e -15, Copies=1"; Pfam description=bZIP transcription factor
  misc_feature (303)..(303): Xaa can be any naturally occurring amino acid
MNIDDFLNSSGEEGNSDLETMDVALGCENPELMSSEFFDSVLSLENNMDDEFFPNFEEDVNLSSDASSNVDEVLSPQSYYSESDKNSSCLENYDDTSTILGNIDGFDELMSILDPIPDVPVKEEIKPVTVPPTPVQKLPTQILIQNPNNKKCIARPMITTTSQVKRPLIKTKPQILKVQQISNNGSPVLLPLNIKSIKILSSPAEVAALTNNMRKRKVEPKIEDDTNVVSSTNHYPPLVLTPEEKRLLAKEGIALPTHHPLTKNDERELKRIRRKIRNKISAQDSRKRKKEYVDSLEERVEEXSEENKNLLQRVKALQRQNKTLIAHVNKLQALICNSTTSKATPST

SEQ ID NO: 20821 - protein, 501 aa, Diabrotica virgifera
  misc_feature: Coding regions on vcDNA: vcDNA=SeqID_518; Strand=+; Position=1-1506
  misc_feature: Homolog annotation: Hit_ID=XP_308398.1; Match level="QueryCoverage =99%, HitCoverage=22%, E-value=1e-146, Identity=40%"; Hit description= ENSANGP00000019107 [Anopheles gambiae]
  misc_feature: Gene Ontology Annotation: Molecular function=structural molecule activity; Cellular component=focal adhesion; Biological process=cell adhesion
  misc_feature: Pfam annotation: Pfam_ID=I_LWEQ; Match level="Score=-83.7, E-value =0.011, Copies=1"; Pfam description=I/LWEQ domain
  misc_feature (486)..(486): Xaa can be any naturally occurring amino acid
  misc_feature (489)..(490): Xaa can be any naturally occurring amino acid
DLVTSLEAISTQSGIVSGVVDNLTRAMTRLSDSRASLILSDGDIGFVDYQTRMVDCAKSIAKIAGEIASKAATDPQKVAQLSADLAHKYAQLSGDSIGAAAAATNAEVAIRLREVVQQLGGACVELVQTGGQCLVRKDDVLLREVGDCSRNVTEKVSRVLATLQNESRGTQACINAASTVSGIIGDLETTIMFATAGNLNPESEHESFANHRENILKTAKALVEDTKTLVAGAASSQEQLAVAAQNSVATIVQLAEVVKFGAASLGVDNPDSQVMLINAVRDVASALGDLIQATKAASGKPINDPAMAHLKDSAKVMVTNVTSLLKTVKAVEDEHTRGTRALESTVEAIGQEMKALYSSEGYRQGVVAEELIRCTKALTNATAKCVAAGISNKQDDIIAAANLSRKAISDMLIICKSAAYSLAETPELRTETLNAGHDCAKQFRELLLLILRDSGTTEVKQILPLTSRKIAQSVTELLSVAKRLKXSDXXDPEDPTVIAEK

SEQ ID NO: 20822 - protein, 131 aa, Diabrotica virgifera
  misc_feature: Coding regions on vcDNA: vcDNA=SeqID_519; Strand=+; Position=14-409
PSLVLAVSTKRLVLRGLTILYNFFDFKYLFTNLEHLLQFVLILVVSVAQIRLDLSKPGLLVTRGVFRLVGVAFISEYSTLSKLFLITNFAICRREIVLKMNASKTSMYVSRQPHCNTIFGQCYYTTHRLGL

SEQ ID NO: 20823 - protein, 234 aa, Diabrotica virgifera
  misc_feature: Coding regions on vcDNA: vcDNA=SeqID_520; Strand=+; Position=199-903
  misc_feature: Homolog annotation: Hit_ID=XP_317865.1; Match level="QueryCoverage =95%, HitCoverage=96%, E-value=1e-121, Identity=91%"; Hit description= ENSANGP00000019984 [Anopheles gambiae]
  misc_feature: Gene Ontology Annotation: Molecular function=protein kinase CK2 activity; Cellular component=protein kinase CK2 complex; Biological process=cell organization and biogenesis
  misc_feature: Pfam annotation: Pfam_ID=CK_II_beta; Match level="Score=489.9, E -value=2.6e-144, Copies=1"; Pfam description=Casein kinase II regulatory subunit
VNVSVANQGTKRKMSSSEEVSWISWFCGLRGNEFFCEVDEDYIQDKFNLTGLNEQVPHYRQALDMILDLEPDDELDDNPNQSDLIEQAAEMLYGLIHARYILTNRGIAQMIEKYQSGDFGYCPRVYCESQQMLPLGLSDVPGEAMVKSYCPKCMDVYTPKSSRHHHTDGAYFGTGFPHMLFMVHPEYRPKRPTNQFVPRLFGFKIHPLAYQLQQQAASTFKTPLRTINFNNGKR

SEQ ID NO: 20824 - protein, 212 aa, Diabrotica virgifera
  misc_feature: Coding regions on vcDNA: vcDNA=SeqID_521; Strand=+; Position=196-834
  misc_feature: Homolog annotation: Hit_ID=XP_392055.1; Match level="QueryCoverage =93%, HitCoverage=62%, E-value=9e-63, Identity=55%"; Hit description =similar to CG8806-PA [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=MSF1; Match level="Score=158.2, E-value=1.8e- 44, Copies=1"; Pfam description=MSF1-like conserved region
MPKFFSDSTIFNYTWDQVAQGFWKRYPNPNSKHVLTEDTVEREVRSGKLFSKRLLTKTNSIPKWAERFMSSRHVNIIEESIVDPKNKVLTTYTRNLGYVKVMSVTEKVVYTESEEHPGKTIAMRFAWIDSQIKGFSRAICAFGYERFKKNCHKMVGGFNHVLSNLYPQQNALTSSYSTAKATAKLKDAAKNASELAKSKAAPIYASLHPNQS

SEQ ID NO: 20825 - protein, 307 aa, Diabrotica virgifera
  misc_feature: Coding regions on vcDNA: vcDNA=SeqID_522; Strand=+; Position=2-926
  misc_feature: Homolog annotation: Hit_ID=A32713; Match level="QueryCoverage=94%, HitCoverage=33%, E-value=5e-75, Identity=46%"; Hit description =reverse transcriptase homolog - fruit fly (Drosophila melanogaster)
  misc_feature: Pfam annotation: Pfam_ID=RVT_1; Match level="Score=-3.5, E-value =0.00022, Copies=1"; Pfam description=Reverse transcriptase (RNA -dependent
  misc_feature (25)..(25): Xaa can be any naturally occurring amino acid
  misc_feature (116)..(116): Xaa can be any naturally occurring amino acid
SFESKQYCSTAFVDVSQAFDKVWHXGLLYKLKRDIYQNMYDILYSYLKERYFQVKYEDEITGLHLIKAGVPQGSVLGPILYLLLTSDLPTDNKVYTATFADDTAILAVHSDPVFEXTSELQENLNKIQTWTKKWKIKLNESKSSHIVFTKCHSDCPQISLNNAPVSTVDTVKYLGLHMGKGLTWKTHIWKKRKHLDTIYRKYYWLLGRKSQLSLRNKLLAYNAILKPIWTYGIQLWGTASKSNLAIMYRFQNKVLLAITDAPWFVSNKDILQYLQVPTVSEVIVSHSDKYLQRLENHPKCVSAKFIG

SEQ ID NO: 20826 - protein, 479 aa, Diabrotica virgifera
  misc_feature: Coding regions on vcDNA: vcDNA=SeqID_523; Strand=+; Position=1-1441
  misc_feature: Homolog annotation: Hit_ID=XP_317282.1; Match level="QueryCoverage =98%, HitCoverage=60%, E-value=1e-113, Identity=35%"; Hit description= ENSANGP00000006827 [Anopheles gambiae]
  misc_feature: Gene Ontology Annotation: Molecular function=structural molecule activity; Cellular component=cellular_component unknown; Biological process=biological_process unknown
  misc_feature: Pfam annotation: Pfam_ID=Kelch_1; Match level="Score=72.4, E-value =1.2e-18, Copies=5"; Pfam description=Kelch motif
  misc_feature (392)..(392): Xaa can be any naturally occurring amino acid
DCRPPRECRNGQCVCQDGYVGFDCEQSICLDNCNHDKGQGSCDKSYGRCLCSAGWTGPSCGIKKTKTQLTFTELFNTVKLSESLEHFRKTLPRFGHSLVSDRRGALWMFGGLSLSHGPLNDVRLFDTKNLTWMQVTIESTPDAKMPMGRYFHGADIGHTQTIYVYGGLSKKHKNYRNRTLDDFWQFDIQNQRWGEIEKTDVWPPALSGHTLTYHKSQESLILIGGISPQNGFLNLVWAYKFGKEQWVPINTKGPGPLGIFGHTTVYHAQSSNLFVFGGVVYERQLSTISNNLYMFNYENRTWTQLNNLGSTLHWPRPRYFHSAITTEDYMIIMGGKIYPWNITDTLYAYSYNCNRWMNLMSNDIEKIGPFPTQSYAQGMTVEPDGDAIYAIXGWGIETQSTVLRIELPTDLCNLLPRRITCLYMSGCGYCASKVGEDIIAEQCHSNTKGVYSRNSGKCSLVTNESQVCSPFTHYQTSPE

SEQ ID NO: 20827 - protein, 353 aa, Diabrotica virgifera
  misc_feature: Coding regions on vcDNA: vcDNA=SeqID_524; Strand=+; Position=84-1145
  misc_feature: Homolog annotation: Hit_ID=NP_476727.1; Match level="QueryCoverage =69%, HitCoverage=30%, E-value=7e-21, Identity=27%"; Hit description =CG8355-PC, isoform C [Drosophila melanogaster] gb|AAF58097.1| CG8355- PC, isoform C [Drosophila
  misc_feature: Gene Ontology Annotation: Molecular function=chemorepellant activity; Cellular component=extracellular; Biological process=neuron differentiation
  misc_feature: Pfam annotation: Pfam_ID=LRR_1; Match level="Score=43.6, E-value=5.7e- 10, Copies=6"; Pfam description=Leucine Rich Repeat
MRYSKNPLVFIVAIFAYSYGLEDSCPSMCNCTEEQVDCMSRDIEEVPDFETLTNRPQVIDLSGNKIAMIGAYDLSFEKSYMVKELYLNNSEVIDVEDEAFDDFENLQMLYLGENLLRVVPEEFVGDLTELILLDLSGNPFEGKMPIIRSDSLEVLALAKCQITEVTVEALRYLPNLRLLLLPENNIQYIQPDVFQDVSEYFSIRLSYNTWECNCRTMELFRFLADKKYLDLTEPYQCSTIDGKIINISDFQSMDEFKNGCNATEEETLQRKQTIGVGSLSREEKTNSSESSETNSKNRNGCVFVQKKKRIVLKRMTDFLFLGVSLHYLVQIKLLCVFFFWGFFFFFFIGGKEN

SEQ ID NO: 20828 - protein, 288 aa, Diabrotica virgifera
  misc_feature: Coding regions on vcDNA: vcDNA=SeqID_525; Strand=+; Position=33-899
  misc_feature: Homolog annotation: Hit_ID=EAA12124.3; Match level="QueryCoverage =86%, HitCoverage=90%, E-value=4e-75, Identity=56%"; Hit description =ENSANGP00000021403 [Anopheles gambiae str. PEST] ref|XP_555904.1| ENSANGP00000021403 [Anopheles gambiae st
  misc_feature: Gene Ontology Annotation: Molecular function=structural constituent of muscle; Cellular component=actin filament; Biological process =muscle contraction
  misc_feature: Pfam annotation: Pfam_ID=CH; Match level="Score=106.0, E-value=9.6e -29, Copies=1"; Pfam description=Calponin homology (CH) domain
HSVDYFKKLLHLCGLLNLFQEGGKTKTKTLVFQSPITEEELENIWDEKILRLLLEQSTEYEERRIIRNRLRSVMAEQEACADLVQKASQEQASGKIEESVTVEKSSSETPTTTTTTKVTKISTQQQVTKKPLSPFAKFQQLDKQNSTTTPPGTPGTPKTPGNGPLFKFTDPALSLSAATIKDRLLYWCKVKTKVYENVQLDNFSTSWADGLAFCALIHHFLPDAFDYHALTPKERRHNFELAFKVASDKADIFPLLDVDDMMATRRPDLKCVFTYVPVIYRRFKDEEI

SEQ ID NO: 20829 - protein, 215 aa, Diabrotica virgifera
  misc_feature: Coding regions on vcDNA: vcDNA=SeqID_526; Strand=+; Position=90-737
  misc_feature: Homolog annotation: Hit_ID=BAC87874.1; Match level="QueryCoverage =93%, HitCoverage=81%, E-value=4e-30, Identity=36%"; Hit description =arylalkylamine N-acetyltransferase [Periplaneta americana]
  misc_feature: Gene Ontology Annotation: Molecular function=arylalkylamine N -acetyltransferase activity; Biological process=catecholamine metabolism
  misc_feature: Pfam annotation: Pfam_ID=Acetyltransf_1; Match level="Score=36.0, E -value=1.1e-07, Copies=1"; Pfam description=Acetyltransferase (GNAT) family
MVDKEDIKIRRARADEENAVRDHLRASFYKQEPTCASLGVVTEERPICPDLESYTLQYFNKGLNLIAEYNGRIVGVCLTALLEKDKYEFEEYPVTDKKFEKILRMLEYAERKGDLSNRFPEVNKILSIVVLSVDASLRGKGIAKKLTNESKQLAKEHGAQMMFLECSSFFSAAVAKSLGYELIWSMDYENYKVNGEVVLKPAHPHKAVQLFVYKL

SEQ ID NO: 20830 - protein, 282 aa, Diabrotica virgifera
  misc_feature: Coding regions on vcDNA: vcDNA=SeqID_527; Strand=+; Position=211-1059
  misc_feature: Homolog annotation: Hit_ID=XP_312850.1; Match level="QueryCoverage =84%, HitCoverage=46%, E-value=1e-84, Identity=62%"; Hit description =ENSANGP00000016547 [Anopheles gambiae]
  misc_feature: Gene Ontology Annotation: Molecular function=protein kinase activity; Cellular component=nuclear membrane; Biological process=microtubule -based process
  misc_feature: Pfam annotation: Pfam_ID=Pkinase; Match level="Score=57.5, E-value =3.7e-14, Copies=1"; Pfam description=Protein kinase domain
MVERIIEENENYDCNGIVINNGDSIEGCNGGGGNGSASDSGDQMDAEARERELVRRKEEAKRRRRKKKRTGSSLVSSCFQDLYKLTGEVLGEGAYASVQTCVSLFTDQEFAVKIIDKVPGHARARVFREVETFHHCQGHPNIIQLMEFFEDEEKFYLVFEKINGGQLLRRIQEHKFFSEAAAAEIVREVASALQFMHAKGIAHRDLKPENILCVHRDQLCPVKICDFDLGSGIRFQSSDYRPFTAPQENNTYSSNYKVCSAIPDRFLVDNTFLTLVSYEVML

SEQ ID NO: 20831 - protein, 309 aa, Diabrotica virgifera
  misc_feature: Coding regions on vcDNA: vcDNA=SeqID_528; Strand=+; Position=82-1011
  misc_feature: Homolog annotation: Hit_ID=XP_307685.1; Match level="QueryCoverage =96%, HitCoverage=85%, E-value=1e-106, Identity=53%"; Hit description= ENSANGP00000017097 [Anopheles gambiae]
  misc_feature: Gene Ontology Annotation: Molecular function=enoyl-CoA hydratase activity; Cellular component=mitochondrion
  misc_feature: Pfam annotation: Pfam_ID=3HCDH_N; Match level="Score=299.9, E-value =3.9e-87, Copies=1"; Pfam description=3-hydroxyacyl-CoA dehydrogenase, NAD
MATISNIAKRCFSTSSTLNVIKNVTVIGGGLMGSGIAQVAAQAGQSVTLVDLNADILKKSETSIQTSVGRVAKKLHKEDAAAAKKFVEETIARVKYCPDPLKALDNADLVVEAIVENIDIKHKLFKSLDEAAPANTIFASNTSSLSISEIASVTKRKDKFGGLHFFNPVAVMKLLEVIRIPETSEETYKAMMEWGKSVGKVCITCKDTPGFVVNRLLVPYLAESIKLFERGDASANDIDTAMKLGAGYPMGPLELADYTGLDTTLFIIDGWHKKFPENPLFEPPAKLRKFVAEGKLGRKTGQGFYNYSK

SEQ ID NO: 20832 - protein, 158 aa, Diabrotica virgifera
  misc_feature: Coding regions on vcDNA: vcDNA=SeqID_529; Strand=+; Position=116-592
  misc_feature: Homolog annotation: Hit_ID=XP_312570.1; Match level="QueryCoverage =100%, HitCoverage=90%, E-value=3e-63, Identity=71%"; Hit description= ENSANGP00000014945 [Anopheles gambiae]
  misc_feature: Gene Ontology Annotation: Molecular function=molecular_function unknown; Cellular component=cytoplasmic vesicle; Biological process =intracellular protein transport
  misc_feature: Pfam annotation: Pfam_ID=TRAPP_Bet3; Match level="Score=219.2, E -value=7.9e-63, Copies=1"; Pfam description=Transport protein particle (TRAPP) com
MADESLFDFLHNEIVTYVLESNNKQNAGKDEDLSVLEYIGFSTGYRIIERLTKEMPRFKDELDTMKFVCTDFWCALYKKQIDNLRTNHHGIYVLQDNSFRFLTRLSNGKQYLDAAPRYVAFTCGVIRGCLANLNIMCLVTAELQNMPSCKFHIQVQRT

SEQ ID NO: 20833 - protein, 323 aa, Diabrotica virgifera
  misc_feature: Coding regions on vcDNA: vcDNA=SeqID_530; Strand=+; Position=50-1018
  misc_feature: Homolog annotation: Hit_ID=EAL30159.1; Match level="QueryCoverage =83%, HitCoverage=61%, E-value=1e-47, Identity=30%"; Hit description =GA20402-PA [Drosophila pseudoobscura]
  misc_feature: Gene Ontology Annotation: Molecular function=enzyme regulator activity; Cellular component=extracellular; Biological process =biological_process unknown
  misc_feature: Pfam annotation: Pfam_ID=LRR_1; Match level="Score=98.4, E-value=1.9e- 26, Copies=8"; Pfam description=Leucine Rich Repeat
MKLFLIFVFAFSHVRGEEEFCEINACEALSKSEMNLKEFSDSLEKDGKDEYLVKLERRVRSLEQPVWEISNVNERWIECGKGPCKCTPELKGVSCWQSNLSAIPDEQVLPQDVITMDLGINLLTTLNKNVFRGMTYLRELDLFDNKIDHLPGNIFAVLDSLKYLRLHKNKLEELSPDLLAFQRNLQTFDVSDNFLKYLPTNIFRGCPNLMLLHLSRNRLRNIPETVFNNLEVLEDLDLSNNLLETVPKFAFTDLKVLRRLFLAENNITLLPTGIFDTLVNLQELNLRKNQISYLPPHIFDKVQNLRISTLTNNKISQIGENDF

SEQ ID NO: 20834 - protein, 326 aa, Diabrotica virgifera
  misc_feature: Coding regions on vcDNA: vcDNA=SeqID_531; Strand=+; Position=1-981
  misc_feature: Homolog annotation: Hit_ID=XP_321599.1; Match level="QueryCoverage =72%, HitCoverage=42%, E-value=6e-86, Identity=62%"; Hit description =ENSANGP00000011569 [Anopheles gambiae]
  misc_feature: Gene Ontology Annotation: Molecular function=molecular_function unknown; Cellular component=nucleus; Biological process=rRNA processing
  misc_feature: Pfam annotation: Pfam_ID=RIO1; Match level="Score=271.9, E-value=1.1e- 78, Copies=1"; Pfam description=RIO1 family
GKESNIYTVADTEGEQLCLKLHRLGRICFRKVTEKRDYHKHRKSASWLYLSRISATKEFAYLKALYERKFPVPKPIDFNRHCVVMELINGTLLNHVQEVENIDSLYDDLMNLIIRFADSGVIHGDFNEFNIILNAEEKPIIIDFPQMISTEHPNAEYFFNRDVNCVKDFFKKRFGYESELFPQFSDINREDNLDAEVACSGFTKEMAKHINKEFGYEDSNDSSEEEVEGETENENVPERDDFFDASDKLEHKDSVQDLGSKSNSSTINYIFDQLKLTSKFDDTAQKIEDISLDSDDSSDHFDSKSMLSLHLLYLQKELKIVLKKHC

SEQ ID NO: 20835 - protein, 384 aa, Diabrotica virgifera
  misc_feature: Coding regions on vcDNA: vcDNA=SeqID_532; Strand=+; Position=61-1214
  misc_feature: Homolog annotation: Hit_ID=EAL31473.1; Match level="QueryCoverage =96%, HitCoverage=90%, E-value=4e-98, Identity=48%"; Hit description =GA15547-PA [Drosophila pseudoobscura]
  misc_feature: Gene Ontology Annotation: Molecular function=chaperone activity; Cellular component=cytosol; Biological process=gametogenesis
  misc_feature (313)..(313): Xaa can be any naturally occurring amino acid
MTNNLVKPVSYLVVDTTAFIQNAPLQDVGEKMITCPEVVDEIKNKRQLRRLVVLPYDLIVQDVFPENISIITEFSKKTGDYPSLSATDIKVMALTYQLHKEKSGTEGLRMEPVMQKAEVTTENKALEMNPDVTGFYLPGKTQTSEDNVAGDDQEEYTEEIDQNIEGLDKLDTNDVDNILTPVKDVEESDSEDSNSIEDESDDDSGWITPSNVKTAKQQLNSEIMEENHVEVSCMTTDFAMQNVLRQMNLNVSALDGRLIKQLRTYILRCYACFKTTSVMTHKFCPKCGNNTLKKVAVSLDAQGKMQIHINSKXPLTGRGKKYSLPRIKGGKHPNNPILVADQPMPDNRPTMLARTKTNPLDDDYTAGFSPFVMRDVNSNQRSCA

SEQ ID NO: 20836 - protein, 492 aa, Diabrotica virgifera
  misc_feature: Coding regions on vcDNA: vcDNA=SeqID_533; Strand=+; Position=167-1645
  misc_feature: Homolog annotation: Hit_ID=XP_394960.1; Match level="QueryCoverage =100%, HitCoverage=87%, E-value=1e-118, Identity=48%"; Hit description=similar to ENSANGP00000019598 [Apis mellifera]
  misc_feature: Gene Ontology Annotation: Biological process=signal transduction
  misc_feature: Pfam annotation: Pfam_ID=Pkinase; Match level="Score=-99.5, E-value =0.0099, Copies=1"; Pfam description=Protein kinase domain
MGNEQSTNIPGIDIREKAVEVCDFWTQHSAVIFNQESSSHLTVFIGELFMDTAYLWKSQPPLQINSKHLMIYRHPCIVKYVSSWHKDLAKYYLAVEEITPLSQEIAKLSGLEISVGLHSILKALNFLHSHAEVSHNNLCISSIYVSKEGNWKLAGMEFLCKYKDLTVDYLNKCKSNRYSKSVDPNEEKLFQMSSTRKDFIDIYAFGVLASDLLKTFKDESDMDSLESFIGFCKNELLNTDFSKRPTFKSILEHEFFNNDFITINSFLLELPVKNDNEKLNFFQNLKHRLFKFEEELVASQLSGLLLSRLVLLNKTAQTSFLPFLLTPQTGDENEETSTLFSENTFKKYLCPKLLEIFKVRDVEIRLLLLSFFPKYMHTFNHEDLQNRILPELLVGIKDTNDHLVSVTLTTLALLVPVLGSETVVGGKRAKLFNDFRPTHSVRRSSKKVNPEIFPNSSTSAQIPQEADQISFSGLENELNIVSELPERPRPDG

SEQ ID NO: 20837 - protein, 304 aa, Diabrotica virgifera
  misc_feature: Coding regions on vcDNA: vcDNA=SeqID_534; Strand=+; Position=93-1004
  misc_feature: Homolog annotation: Hit_ID=AAS38896.1; Match level="QueryCoverage =34%, HitCoverage=12%, E-value=4e-12, Identity=42%"; Hit description =similar to G-protein-coupled receptor at plasma membrane; interactions in two-hybrid system with Gpa2p; Gp
MKLLISFILLCVFQAVWTKSIVKRDCCGNSCSTPCNNNNNCNNSPCYNNCNSGNCNNNCNSRPCNSNCNSSPCNNNNCGSCNDRPNIPEPRDEVRPILVPFPQPQLSPSGGENTINNTNINNSTMELTFTNTINTVNNISMPISLNPSNENSITVHFNQVERTKEEKEIVQEDNCCFISERKCYANDTCVMVRRKECSDICWGILPVEPKPSPAPTTERPIVIVYTPPTPPPNPEPTTKGPTVIIYPPEPTHRPIPPPPNPRPVIIIPPRPCSANPQRPIYIPNWASYRNIWEYYYIQQPCTRM

SEQ ID NO: 20838 - protein, 136 aa, Diabrotica virgifera
  misc_feature: Coding regions on vcDNA: vcDNA=SeqID_535; Strand=-; Position=667-1078
  misc_feature: Homolog annotation: Hit_ID=AAC46945.1; Match level="QueryCoverage =94%, HitCoverage=42%, E-value=3e-13, Identity=34%"; Hit description =mariner transposase pir||S35520 transposase - lacewing
  misc_feature (65)..(65): Xaa can be any naturally occurring amino acid
KKIQNMVLENRRVTERFSRSKDISLSSLSNILTEGLGFRKLCSQWVSYSLTMEQKHIQIRVSQRXKDKVNFASRSITMNETWFLIINQNKRRNSGCEPGANQEGSCTSVFWDARGILFVHYLKTDKTINFGCSITA

SEQ ID NO: 20839 - protein, 246 aa, Diabrotica virgifera
  misc_feature: Coding regions on vcDNA: vcDNA=SeqID_536; Strand=+; Position=501-1241
  misc_feature: Homolog annotation: Hit_ID=XP_315425.1; Match level="QueryCoverage =95%, HitCoverage=72%, E-value=2e-38, Identity=41%"; Hit description =ENSANGP00000014316 [Anopheles gambiae]
MADLEAKQEEVLKQLADLKKQILSIKLDLKINANSVGTNKTSPSISAEKLNALPDLVVNASPTNPPYSLLIIQKLLHDIVELKVTSHIHSSVPALNENAKQLGDSLASYVPKRGVPSVNIKLIWKNVGVDTELMVSHVPIFGEVNLLRYLTRVISSPLSYSSDSDSVEIDSILDTCYLLLRAKTKTEKAGHIATLNKSLGKSQWLAGRSRHSLGDLAAYSALKQVTSGSEINANMTKWYQRCETVV

SEQ ID NO: 20840 - protein, 316 aa, Diabrotica virgifera
  misc_feature: Coding regions on vcDNA: vcDNA=SeqID_537; Strand=+; Position=1-947
  misc_feature: Homolog annotation: Hit_ID=XP_394436.1; Match level="QueryCoverage =100%, HitCoverage=29%, E-value=1e-118, Identity=62%"; Hit description=similar to ENSANGP00000014167 [Apis mellifera]
  misc_feature: Gene Ontology Annotation: Molecular function=motor activity; Cellular component=myosin I; Biological process=transport
  misc_feature: Pfam annotation: Pfam_ID=Myosin_head; Match level="Score=-93.1, E -value=1.8e-12, Copies=1"; Pfam description=Myosin head (motor domain)
  misc_feature (289)..(289): Xaa can be any naturally occurring amino acid
TEKEQSDMFSVISAILQLGNIGFSEEEGRTLILKPEQVDIVSKLLDCDKEKMSLALQQRTIETIRDVVTSPLNRELSIYARDALAKAIYDRMFTWLVKRINDSLQPSDKRRNVVMGILDIYGFEIFERNGFEQLCINFCNEKLQQLFIDLTLKSEQDEYEKEGIVWQHIEYFDNKIICELIEEKHKGLIAYMDEECLRPGDPSDKTLLAKLDERLSYHPHYISHKKADIKLQKIMGRDEFRLIHYAGNVTYNVKSFIDKNNDLLFRDLREAMLSSKNSIIESVFFEHEXESKKRPETAITQFKTSVNNLLNILKDK

SEQ ID NO: 20841 - protein, 170 aa, Diabrotica virgifera
  misc_feature: Coding regions on vcDNA: vcDNA=SeqID_538; Strand=-; Position=78-590
  misc_feature: Pfam annotation: Pfam_ID=Prefoldin; Match level="Score=11.4, E-value =0.0024, Copies=1"; Pfam description=Prefoldin subunit
MKMAKSPSDILKERDTYLQHLGEDINKYDKTIQTLTKEQETIDSLITNLQTLKTYPEQEALIPLGKNIYMKGRIVHTGEYFVKRIAHPDSIVMLQTADDTIKRLEEEKKTKEEDIDKAEYAKFQIEERIKILNGEDSFQADKSDMPKQIKSEKGVAVRVGDFYEILEFEE

SEQ ID NO: 20842 - protein, 351 aa, Diabrotica virgifera
  misc_feature: Coding regions on vcDNA: vcDNA=SeqID_539; Strand=+; Position=1-1055
  misc_feature: Homolog annotation: Hit_ID=CAB98197.1; Match level="QueryCoverage =99%, HitCoverage=73%, E-value=1e-175, Identity=89%"; Hit description= eukaryotic translation initiation factor 2 gamma [Clytus arietis]
  misc_feature: Gene Ontology Annotation: Molecular function=translation factor activity, nucleic acid binding; Cellular component=cytosolic small ribosomal subunit (sensu Eukarya); Biological process=locomotory behavior
  misc_feature: Pfam annotation: Pfam_ID=GTP_EFTU_D2; Match level="Score=48.9, E -value=1.5e-11, Copies=1"; Pfam description=Elongation factor Tu domain 2
  misc_feature (303)..(303): Xaa can be any naturally occurring amino acid
  misc_feature (316)..(316): Xaa can be any naturally occurring amino acid
  misc_feature (337)..(337): Xaa can be any naturally occurring amino acid
KCPRPSCFISGSSSKDDSFPCLRPACSGRFQLVRHVSFVDCPGHDILMATMLNGAAVMDAALLLIAGNESCPQPQTSEHLAAIEIMKLKHILILQNKIDLVKEGQAKEQHEQIVKFVQGTVAEGAPIIPISAQLKYNIEVLCEYITKKIPIPMRDFTSEPRLIVIRSFDVNKPGCEVNDLKGGVAGGSILRGVLKVGQEIEVRPGLVSKDSEGKLACRPIFSRIVSLYTEQNELQFAVPGGLIGVGTKIEPTLCRADRLVGSVLGAVGALPSIFTELEVSYYLLKRLLGVRTEREQKGAKVQXITKNERLLVNIGXLPPGGQVVPPKADFGEKMLLXNPAGTRIGKKMAPP

SEQ ID NO: 20843 - protein, 280 aa, Diabrotica virgifera
  misc_feature: Coding regions on vcDNA: vcDNA=SeqID_540; Strand=+; Position=65-904
  misc_feature: Homolog annotation: Hit_ID=XP_311171.1; Match level="QueryCoverage =97%, HitCoverage=48%, E-value=3e-20, Identity=27%"; Hit description =ENSANGP00000019050 [Anopheles gambiae] gb|EAA06937.2| ENSANGP00000019050 [Anopheles gambiae
MQTTLIELNPNRQLLDSNFDGYKLSLTEIPKKKRDLPIAVDRVLLDTNHCSLLHANLYGFHNHLTADPYDETSSVYFVDTELSICKVYVDPFNEELIDPIKLLTLPRKRERTSGDYNVSLRFASPTVAVISDGIENLYIVNTGSRNDDDAFNICFSDEVTDSGQSFVLMDAISMTNKDSNEELHVLALSLIRETEQERYYSLLHWITFTKVQDVWEQTAIKQVKSKGCVQYAFIEKNCEAIYVACDDECKFTLNSDFPVSEETPRNINTDNKVYTWSQNI

SEQ ID NO: 20844 - protein, 493 aa, Diabrotica virgifera
  misc_feature: Coding regions on vcDNA: vcDNA=SeqID_541; Strand=+; Position=82-1563
  misc_feature: Homolog annotation: Hit_ID=XP_315944.1; Match level="QueryCoverage =96%, HitCoverage=95%, E-value=1e-135, Identity=47%"; Hit description= ENSANGP00000014133 [Anopheles gambiae]
  misc_feature: Gene Ontology Annotation: Molecular function=serine-type peptidase activity; Cellular component=cellular_component unknown; Biological process=biological_process unknown
  misc_feature: Pfam annotation: Pfam_ID=Peptidase_S28; Match level="Score=628.1, E -value=6.5e-186, Copies=1"; Pfam description=Serine carboxypeptidase S28
MARLLSFTTIVLLLSIFGSFAAGATFFRRGRILHPEKDPEPSKYERWFTQNLDHFNPNDERTWQQRYYVNEELASGKGDLAFLQIGGEGEATAAWMTNGSWITYARKYKPILFQLEHRYYGKSHPTKDLSTENLAYLTSQQALSDLAFFIEAMNQQHNLSSDVKWIVFGGSYPGNLAAWVRQKYPHLVHGAMSASGPLLAQLDFSEYFKVVADSLRASNEKCPNIVKQSTAQVEALLHTAVGQKNLNQLFNLCEDITENVHNSLDVSNFFMSLADNFAGVVQYNNDNSAGIKKKNLTVDRLCNVLLDESTGLEINRLAAVTKLILDADGNSCFDYNYNNMVDSMKEVSWDSDAAYGSRQWTYQTCTEFGYFQTSSYKPHIFGTRFPLSFSIQQCLDIFGSLYNETFLNHAIERTNVLYGGLDIEVSNVVFVQGSLDPWHVLGVTKTLNDKAPAIVIEGAAHAANMFNPSDDDTPQLKAARVQIEELIGTWIDS

SEQ ID NO: 20845 - protein, 64 aa, Diabrotica virgifera
  misc_feature: Coding regions on vcDNA: vcDNA=SeqID_542; Strand=-; Position=295-489
KQTSAISWAFSVAHTSLKNLTRALLWSLWIICKSFVEKLFNVHIYVCVLNNEKCKYWKNTWKSK

SEQ ID NO: 20846 - protein, 398 aa, Diabrotica virgifera
  misc_feature: Coding regions on vcDNA: vcDNA=SeqID_543; Strand=+; Position=52-1245
  misc_feature: Homolog annotation: Hit_ID=XP_314443.1; Match level="QueryCoverage =100%, HitCoverage=73%, E-value=1e-158, Identity=67%"; Hit description=ENSANGP00000016027 [Anopheles gambiae]
  misc_feature: Gene Ontology Annotation: Molecular function=neurotransmitter:sodium symporter activity; Cellular component=ubiquitin ligase complex; Biological process=protein folding
  misc_feature: Pfam annotation: Pfam_ID=Pro_isomerase; Match level="Score=86.5, E -value=7.2e-23, Copies=1"; Pfam description=Cyclophilin type peptidyl- prolyl cis-
  misc_feature (24)..(24): Xaa can be any naturally occurring amino acid
  misc_feature (213)..(213): Xaa can be any naturally occurring amino acid
  misc_feature (358)..(358): Xaa can be any naturally occurring amino acid
  misc_feature (364)..(364): Xaa can be any naturally occurring amino acid
  misc_feature (373)..(373): Xaa can be any naturally occurring amino acid
  misc_feature (377)..(377): Xaa can be any naturally occurring amino acid
  misc_feature (387)..(387): Xaa can be any naturally occurring amino acid
MGKRQHQKDKMYITYTEWTTLYGXKKGGYTSKEGENFRRLPFDHCCLSLQPYEIPYCDLDGNIFDLEALIPFLKKFKINPVTGKPLDFKSLIQLNFHRKSEGVFECPVLFKPFTNSSHIAAIATTGNVFLMEAIEQLNIKNRNWKDLITDQPFERKDIIVLQDPNNLSKFDISKFHHVKQNLRVETEEEIADKSDPQARLKKINPETKYTLDXLNKEYKPPTIEVNKKASTEKADKFNAAHYSTGAVAASFTSTTIVPKLQGEAAIIHEDEVRYERVKKKGYVRLVTNLGMLNLELHCDMVPKTCENFMKHCENGYYNGTKFHRSIRNFMIQGGDPTNTGNGGKSIWGNKFEDEIRPXLSHTGXGVLSMANSXENTXNGSQFFITYXSCKHLDNKHTI

SEQ ID NO: 20847 - protein, 121 aa, Diabrotica virgifera
  misc_feature: Coding regions on vcDNA: vcDNA=SeqID_544; Strand=+; Position=42-407
  misc_feature: Homolog annotation: Hit_ID=XP_314835.1; Match level="QueryCoverage =100%, HitCoverage=78%, E-value=5e-44, Identity=67%"; Hit description= ENSANGP00000011122 [Anopheles gambiae]
  misc_feature: Gene Ontology Annotation: Molecular function=cytochrome c oxidase activity; Cellular component=extracellular space; Biological process= negative regulation of FGF receptor signaling pathway
  misc_feature: Pfam annotation: Pfam_ID=COX5B; Match level="Score=68.8, E-value=1.5e- 17, Copies=1"; Pfam description=Cytochrome c oxidase subunit Vb
MASLCRRIVTSTARNHVLSTSYRMASKVTMGDPLEHATGLEKRELLAKVAGNDNPFDIKVIKRGPGSKAQPNEIPSAFDARLVGCVCEEESTSINWMWLHKGEPKRCECGHWFNLVHKAPV

SEQ ID NO: 20848 - protein, 425 aa, Diabrotica virgifera
  misc_feature: Coding regions on vcDNA: vcDNA=SeqID_545; Strand=+; Position=150-1427
  misc_feature: Homolog annotation: Hit_ID=NP_995906.1; Match level="QueryCoverage =97%, HitCoverage=99%, E-value=1e-103, Identity=46%"; Hit description= CG13425-PC, isoform C [Drosophila melanogaster] gb|AAM68389.2| CG13425-PC, isoform C [Drosophila
  misc_feature: Gene Ontology Annotation: Molecular function=DNA binding; Cellular component=nuclear speck; Biological process=mRNA metabolism
  misc_feature: Pfam annotation: Pfam_ID=KH_1; Match level="Score=208.2, E-value=1.6e- 59, Copies=3"; Pfam description=KH domain
ATVAFSILGRLAMKRGADGDMGSPQKRSRRGDEEVRLLIPSMVAGSIIGKGGSNITKLRSQYKASITVPDCPGPERILTLSSDMDSVCNIVQDVIPKLEAHGATTNGNELDLRMMIHQSQAGCVIGKGGSKIKEIREKTGARVQIYANVAPQSTDRVIQITGEPPKCIETIRDILTLIKQSPIRGAVNPYDPHNYDEVYAAQYGGWGGDNQGGGFNRGRGNDGPRGGGNRDGGARFGGGNRPAGGSLNRGGGGGNRDGFGGGGLGGNRDSLGGGRFGGRDSGFGGGNRDSGFGGGRDSGFGGSGFGSRGGSGGGAFDRNGWSGGGQFSPPSGLNTSPSPFGSTGGSSNKNSTQVTIPKDLAGAIIGKGGVRIRKIRVESGANITIDEPLPGSNDRIITISGMPNQIQMAQYLLQQSVHNNSERNY

SEQ ID NO: 20849 - protein, 103 aa, Diabrotica virgifera
  misc_feature: Coding regions on vcDNA: vcDNA=SeqID_546; Strand=-; Position=913-1224
  misc_feature (23)..(23): Xaa can be any naturally occurring amino acid
KKLFLTIQKLTNEILSIHKLLFXQNSKTATKGVTRNIKKRKKAEYFGHRFRGPNYYLLRLIRKRGGKEMDWSKKILMVGIRIISRSSRYRSVSEKCKMMTASI

SEQ ID NO: 20850 - protein, 173 aa, Diabrotica virgifera
  misc_feature: Coding regions on vcDNA: vcDNA=SeqID_547; Strand=+; Position=92-613
  misc_feature: Homolog annotation: Hit_ID=XP_308524.1; Match level="QueryCoverage =81%, HitCoverage=70%, E-value=3e-51, Identity=62%"; Hit description =ENSANGP00000016062 [Anopheles gambiae]
  misc_feature: Gene Ontology Annotation: Molecular function=NADH dehydrogenase (ubiquinone) activity; Biological process=mitochondrial electron transport, NADH to ubiquinone
MVILSTLRTLTRLPSSSLRNEASKRLMSDHRVFPMQPSRWQWIKFKDYFHYYVMLGLIPATLAITYANVFIGPSTLSEIPEGYTPKFYEYHRSPVTRFLAKYICKDPQQEYEKYLAYIFMEDEKRKLRKLEKEVKHKMAERNDYQAYYYRPVAAKYHRITREAADYLETIRGE

SEQ ID NO: 20851 - protein, 427 aa, Diabrotica virgifera
  misc_feature: Coding regions on vcDNA: vcDNA=SeqID_548; Strand=+; Position=13-1292
  misc_feature: Homolog annotation: Hit_ID=XP_311315.1; Match level="QueryCoverage =99%, HitCoverage=32%, E-value=1e-153, Identity=64%"; Hit description= ENSANGP00000001645 [Anopheles gambiae]
  misc_feature: Gene Ontology Annotation: Molecular function=motor activity; Cellular component=actin cytoskeleton; Biological process=vision
  misc_feature: Pfam annotation: Pfam_ID=Myosin_head; Match level="Score=96.1, E -value=9.3e-26, Copies=1"; Pfam description=Myosin head (motor domain)
  misc_feature (370)..(371): Xaa can be any naturally occurring amino acid
  misc_feature (400)..(400): Xaa can be any naturally occurring amino acid
  misc_feature (418)..(418): Xaa can be any naturally occurring amino acid
MEDYVWARDHTEGYVLGKISELLDDGAEVTPQSSKFPKRILPFSEIFRANIDDNNKNYDDNCEMMFLNEGSLLNNIRSRYYQDKIYSYVANILIAVNPYKDIPTLYASQTIKNYKGKSLGQMPPHIFAVADKAYRDMLVLKQSQSIIVSGESGAGKTESTKHLLKYLCDNWGAEVGTLEKKILDANPVLEAFGNAKTTRNNNSSRFGKFIEVHFDNKFKVAGGHISHYLLEKSRICSTEGDERNYHIFYMLLAGAPEGLRSKLYLSQPDDFNYLKHGCTRYFTTNASEKALDANRKSAAHKKAGSLKDILLDDVGDFKELDEALSRLEISESERLQIYSTVAAVLHLGNVDFEDNPEDTRGGCRVGASGXXSLLLASKLLGIDPSELKQALISRVMQSAXGGFEGTVIMVPLKIYEAXNARDALAKA

SEQ ID NO: 20852 - protein, 270 aa, Diabrotica virgifera
  misc_feature: Coding regions on vcDNA: vcDNA=SeqID_549; Strand=+; Position=3-815
LEKIPNEKQNNVITTKPLSKSSDWTEVDLEVPDNEDHPIHLHNPKLNLIFNNDKGTPTPPPRKHKKNLREKIEAVAKTGLQAFQSKKSQVEATPPKPPTEVEEPLFVKKTIDYRCPICDADEASFNRDHHHHHHHEHNHVNDKNDNKTDKFINLRDGKESLKRKKTLSVYSLPNYDELKLTVSEFKDDNKGPSSLKTDKKGHPSEISLPVDHKKTATGSTGKLDTYITRCRSFGSIFPQQLKKLRPRKAPTDIESDDSFWWFRRLGLRTN

SEQ ID NO: 20853 - protein, 256 aa, Diabrotica virgifera
  misc_feature: Coding regions on vcDNA: vcDNA=SeqID_550; Strand=+; Position=71-841
  misc_feature: Homolog annotation: Hit_ID=XP_317375.1; Match level="QueryCoverage =94%, HitCoverage=82%, E-value=4e-45, Identity=45%"; Hit description =ENSANGP00000011718 [Anopheles gambiae]
  misc_feature: Pfam annotation: Pfam_ID=Secretogranin_V; Match level="Score=138.9, E- value=1.2e-38, Copies=1"; Pfam description=Neuroendocrine protein 7B2 precursor
MKITILMCCLTGAMCYLPPAKESLLSGLFLRDLVNRINGKGISEGDGVSYLDFTDGLPLDGRSLSGTLEEEQMFPVDYETMGEMNMHPSIRDQEYLQHSTLWGKQYLNGDRDENSILHHNGFKNKNGLKGESTLPAYCSPPNPCPIGYTADHGCIEMFDNTASFSRRYQASQNCMCDTEHMFECPTSNDISDDNSMDMIDSYHFNKMLQQSAKLKQLFSQKNVYAKKDLQIKSKNNPFLTGEKLPVAAKKGNNVLL

SEQ ID NO: 20854 - protein, 153 aa, Diabrotica virgifera
  misc_feature: Coding regions on vcDNA: vcDNA=SeqID_551; Strand=+; Position=27-488
  misc_feature: Homolog annotation: Hit_ID=XP_317375.1; Match level="QueryCoverage =72%, HitCoverage=43%, E-value=1e-28, Identity=50%"; Hit description =ENSANGP00000011718 [Anopheles gambiae]
  misc_feature: Pfam annotation: Pfam_ID=Secretogranin_V; Match level="Score=71.3, E -value=2.6e-18, Copies=1"; Pfam description=Neuroendocrine protein 7B2 precursor
MKITILMCCLTGAMCYLPPAKYLNGDRDENSILHHNGFKNKNGLKGESTLPAYCSPPNPCPIGYTADHGCIEMFDNTASFSRRYQASQNCMCDTEHMFECPTSNDISDDNSMDMIDSYHFNKMLQQSAKSKNNPFLTGEKLPVAAKKGNNVLL

SEQ ID NO: 20855 - protein, 467 aa, Diabrotica virgifera
  misc_feature: Coding regions on vcDNA: vcDNA=SeqID_552; Strand=+; Position=110-1513
  misc_feature: Homolog annotation: Hit_ID=XP_308390.1; Match level="QueryCoverage =92%, HitCoverage=99%, E-value=1e-53, Identity=27%"; Hit description =ENSANGP00000009437 [Anopheles gambiae]
  misc_feature: Gene Ontology Annotation: Molecular function=myo-inositol transporter activity; Cellular component=membrane; Biological process=myo -inositol transport
  misc_feature: Pfam annotation: Pfam_ID=Sugar_tr; Match level="Score=141.9, E-value =1.4e-39, Copies=1"; Pfam description=Sugar (and other) transporter
MVTQTVTKIVGKSEETQTEKTWYQVVVVSTISLVSLNCGISFAWPSPFLIKLVNDKENYNISEEEGSYFSVISIVAVVILPVFLSLIVNQIGRKRLLLLTAFPYVTAYVLAAFSRNIWLFYLARLITGIGDCIAYTCLVVFIAEISSPQVRGTWGNAIVWSGFLGQFIINVLGLYCSVMVASLVCAVFPVIFLFIFVFMPESPYFYLNKGQDEEAKVSLRRLKRKNNVEEEFSRLKEVMEKELKESGSWSDLVTNKTNRRALFAAIFLRVSQIFSGIFTLGPYIQFIFLKSGTNISMELSTILFTFINFVLYSAASYGSNKLGRRVSLISSLLGTSIIFLLEAAYFFVDTFYLDINLKPIQWFPLVGLILFLVVSSYGIGTVPFLMPGELFAPNIKAQGISVVISAFGLSNLIMNTLFYSLNNVTGLGGPFLVFGLCNIISAVVVYKFIPETKNKTLEEIQIILSKM

SEQ ID NO: 20856 - protein, 224 aa, Diabrotica virgifera
  misc_feature: Coding regions on vcDNA: vcDNA=SeqID_553; Strand=+; Position=220-890
  misc_feature: Homolog annotation: Hit_ID=XP_396639.1; Match level="QueryCoverage =97%, HitCoverage=68%, E-value=2e-71, Identity=61%"; Hit description =similar to CG5946-PB [Apis mellifera]
  misc_feature: Gene Ontology Annotation: Molecular function=cytochrome b5 reductase activity; Cellular component=membrane; Biological process=iron ion transport
  misc_feature: Pfam annotation: Pfam_ID=FAD_binding_6; Match level="Score=216.1, E -value=7e-62, Copies=1"; Pfam description=Oxidoreductase FAD-binding domain
  misc_feature (209)..(209): Xaa can be any naturally occurring amino acid
MNTLSGVLPLVLGVGVIVTSFVIYKFFYSSPDAPSKVTKSKSKKVLLKDPQMKYQLPLIEKTIISHDTRNFRFGLPEKDMVLGLPIGQHIILSAKINDELVIRSYTPVSSDDDQGYVDLVIKVYFKNVHPKFPDGGKMTQHLESLKIGDTIDVRGPAGRIEYLGHGKFTVKKLRKDPPEEITVKKVNLIAGGVGITPILQLIRHILKDXTDTTECALLFAIKQK

SEQ ID NO: 20857 - protein, 314 aa, Diabrotica virgifera
  misc_feature: Coding regions on vcDNA: vcDNA=SeqID_554; Strand=+; Position=122-1066
  misc_feature: Homolog annotation: Hit_ID=XP_396639.1; Match level="QueryCoverage =94%, HitCoverage=93%, E-value=1e-105, Identity=62%"; Hit description= similar to CG5946-PB [Apis mellifera]
  misc_feature: Gene Ontology Annotation: Molecular function=cytochrome b5 reductase activity; Cellular component=membrane; Biological process=iron ion transport
  misc_feature: Pfam annotation: Pfam_ID=FAD_binding_6; Match level="Score=216.1, E -value=7e-62, Copies=1"; Pfam description=Oxidoreductase FAD-binding domain
MDSGESQVLPLVLGVGVIVTSFVIYKFFYSSPDAPSKVTKSKSKKVLLKDPQTKYQLPLIEKTIISHDTRNFRFGLPEKDMVLGLPIGQHIILSAKINDELVIRSYTPVSSDDDQGYVDLVIKVYFKNVHPKFPDGGKMTQHLESLKIGDTIDVRGPAGRIEYLGHGKFTVKKLRKDPPEEITVKKVNLIAGGVGITPILQLIRHILKDPTDTTECALLFANQTEDDILLRPELEEAVKSRPNSFKLWYTLDRPGPDWKYSSGFINEEMLKEHLFPASDDALVLMCGPPPMINFACTPNFGETWPRKTKGCLAY

SEQ ID NO: 20858 - protein, 163 aa, Diabrotica virgifera
  misc_feature: Coding regions on vcDNA: vcDNA=SeqID_555; Strand=+; Position=472-963
  misc_feature: Homolog annotation: Hit_ID=AAV91386.1; Match level="QueryCoverage =100%, HitCoverage=75%, E-value=2e-80, Identity=90%"; Hit description= ribosomal protein L1 [Lonomia obliqua]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L1; Match level="Score=111.6, E -value=1.9e-30, Copies=1"; Pfam description=Ribosomal protein L1p/L10e family
LKHIPRPKMQVCILGDQQHCDEANANNVPFMDVEALKKLNKNKKLVKKLAKKYDAFLASEALIKQIPRLLGPGLNKAGKFPGLLSHQESMTQKIDEVKATIKFQMKKVLCLSVAVGHVGMNQDELVQNVHLSINFLVSLLKKHWQNVRSLHVKSSMGPPQRLY

SEQ ID NO: 20859 - protein, 194 aa, Diabrotica virgifera
  misc_feature: Coding regions on vcDNA: vcDNA=SeqID_556; Strand=+; Position=102-686
  misc_feature: Homolog annotation: Hit_ID=AAV91386.1; Match level="QueryCoverage =98%, HitCoverage=88%, E-value=3e-87, Identity=84%"; Hit description =ribosomal protein L1 [Lonomia obliqua]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L1; Match level="Score=150.5, E -value=3.7e-42, Copies=1"; Pfam description=Ribosomal protein L1p/L10e family
  misc_feature (176)..(176): Xaa can be any naturally occurring amino acid
KKNLFLVTGEFQIGLKNYDPQKDKRFSGTVKLKHIPRPKMQVCILGDQQHCDETNGNNDPFMDVEALKKLNKNKKLFKKLAKKYDAFLASEALIKQIPRLLGPGLNKAGKFPGLLSHQESMTQKIDEVKATIKFQMKKVLCLSVAVGHVGMNQDELVQNVHLSISFLVSLLKKHWXNARSLHVKSSMWTPLRSD

SEQ ID NO: 20860 - protein, 121 aa, Diabrotica virgifera
  misc_feature: Coding regions on vcDNA: vcDNA=SeqID_557; Strand=+; Position=429-794
  misc_feature: Homolog annotation: Hit_ID=XP_393297.1; Match level="QueryCoverage =95%, HitCoverage=96%, E-value=2e-32, Identity=56%"; Hit description =similar to myofibril-associated Zeelin1 protein [Apis mellifera]
MSFKEHLEMISLNESPSKKAKFWQAFVRSLKGSDDLRATDSVSSRRGIFRPISDIPEISSSWPYTKSIYDEPSAAAERIHVPGYRYDPVHRDIYGYSPRPIYPHNYGSLDRYRPGRFEYKH

SEQ ID NO: 20861 - protein, 157 aa, Diabrotica virgifera
  misc_feature: Coding regions on vcDNA: vcDNA=SeqID_558; Strand=+; Position=520-993
  misc_feature: Homolog annotation: Hit_ID=CAH04325.1; Match level="QueryCoverage =98%, HitCoverage=98%, E-value=7e-72, Identity=85%"; Hit description =S10e ribosomal protein [Curculio glandium]
  misc_feature: Gene Ontology Annotation: Molecular function=structural constituent of ribosome; Cellular component=cytosolic ribosome (sensu Eukarya); Biological process=locomotory behavior
  misc_feature: Pfam annotation: Pfam_ID=S10_plectin; Match level="Score=257.4, E -value=2.5e-74, Copies=1"; Pfam description=Plectin/S10 domain
MLMPKKNRVCIYEYLFKEGVMVAKKDYHAPKHPELETIPNLQVIKALQSLKSKGYVKEQFAWRHYYWYLTNSGIEYLRTFLHLPGEIVPSTLKRPARTETTRPRPAALRSETSKPSEDRAGYRRTPGGPGADKKADVGPGTGDVEFRQGFGRGRAPQ

SEQ ID NO: 20862 - protein, 540 aa, Diabrotica virgifera
  misc_feature: Coding regions on vcDNA: vcDNA=SeqID_559; Strand=+; Position=1802-3424
  misc_feature: Homolog annotation: Hit_ID=XP_317219.1; Match level="QueryCoverage =99%, HitCoverage=98%, E-value=0.0, Identity=78%"; Hit description =ENSANGP00000012024 [Anopheles gambiae]
  misc_feature: Gene Ontology Annotation: Molecular function=chaperone activity; Cellular component=actin filament; Biological process=cell organization and biogenesis
  misc_feature: Pfam annotation: Pfam_ID=Cpn60_TCP1; Match level="Score=611.7, E -value=5.6e-181, Copies=1"; Pfam description=TCP-1/cpn60 chaperonin family
MSAIPGSIAFDEYGRPFIILRDQDKQKRLTGIDALKSHILAARQIAQTISTSLGPKGLDKMMVSPDGEVTVTNDGATILKMMDVEHEVAKLLVQLSQSQDDEIGDGTTGVVVLAGALLEQAGSLLDRGIHPIRIADGFELACQTAVAHLEKIAELFPVSAENTEPLIKVAMTTLGSKIINKCHKQMAEIAVNAVLAVADLEQKDVNFELIKVEGKVGGKLEDTTLVKGVVIDKTMSHPQMPKELKDVKLAILTCPFEPPKPKTKHKLDVSSVEDYKELRQYEQEKFKEIVGLVKKAGATLAICQWGFDDEANHLLLQQELPAVRWVGGPEIELIAIATGGRIVPRFEELTPEKLGHAGLVREIAFGTTKDRMLVIEECSNSRAVTILVRGGNQMLVAEAKRSLHDALCVVRSLVQEPRVVYGGGAAEIACCLAVAAQADQLASLEQYAYRAFAEALESIPLALADNSGLSAIHTLGEVKAKQAATGDPALGIDCMNTGNLNMREQHVIESLRSKRQQFLLATQLVKMILKIDDVRQPASG

SEQ ID NO: 20863 - protein, 217 aa, Diabrotica virgifera
  misc_feature: Coding regions on vcDNA: vcDNA=SeqID_560; Strand=+; Position=57-710
  misc_feature: Homolog annotation: Hit_ID=AAV34821.1; Match level="QueryCoverage =100%, HitCoverage=100%, E-value=1e-109, Identity=89%"; Hit description=ribosomal protein L10A [Bombyx mori]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L1; Match level="Score=246.7, E -value=4.3e-71, Copies=1"; Pfam description=Ribosomal protein L1p/L10e family
MTSKVSRDTLYECVNGVLENAKEKKRNFLETVELQIGLKNYDPQKDKRFSGTVKLKHIPRPKMQVCILGDQQHCDEANANNVPFMDVEALKKLNKNKKLVKKLAKKYDAFLASEALIKQIPRLLGPGLNKAGKFPGLLSHQESMTQKIDEVKATIKFQMKKVLCLSVAVGHVGMNQDELVQNVHLSINFLVSLLKKHWQNVRSLHVKSSMGPPQRLY

SEQ ID NO: 20864 - protein, 70 aa, Diabrotica virgifera
  misc_feature: Coding regions on vcDNA: vcDNA=SeqID_561; Strand=-; Position=545-757
SPKPVRGRGMFVIIYFFRLDIFFEIDSWFINIFFCGYFHINLLWDRRSHHKIMITPRTPVSRSTRHQRGS

SEQ ID NO: 20865 - protein, 261 aa, Diabrotica virgifera
  misc_feature: Coding regions on vcDNA: vcDNA=SeqID_562; Strand=+; Position=88-947
  misc_feature: Homolog annotation: Hit_ID=XP_396571.1; Match level="QueryCoverage =100%, HitCoverage=77%, E-value=6e-85, Identity=58%"; Hit description= similar to CG3061-PA [Apis mellifera]
  misc_feature: Gene Ontology Annotation: Molecular function=molecular_function unknown; Cellular component=cellular_component unknown; Biological process=protein folding
  misc_feature: Pfam annotation: Pfam_ID=DnaJ; Match level="Score=123.6, E-value=4.6e- 34, Copies=1"; Pfam description=DnaJ domain
  misc_feature (224)..(224): Xaa can be any naturally occurring amino acid
  misc_feature (254)..(254): Xaa can be any naturally occurring amino acid
MEGNKDEALRCVDLAEKFIQEKNRQKAEKYLNKAEKLFPTDKAKDLLLKINLMAPSNPETTQPRRRRIKKCKDYYEILGVSKDATDSEIKKSYKKLALQMHPDKNKCPGASEAFKAVGNAVAVLTDTEKRKQYDLYGSDEDRLSSHSHHHTYTRGFESDATAEELFNMFFGGGFSGPNVYVRRGGRWQRQTASSQSHQEHSHHREQQSSYTAFIQLLPILLAIXLSMASSLFISDPAYSLQVSTKYPYFKKDSXLNIPYYV

SEQ ID NO: 20866 - protein, 119 aa, Diabrotica virgifera
  misc_feature: Coding regions on vcDNA: vcDNA=SeqID_563; Strand=+; Position=93-452
MKVQIVVLAVLLVLTETIYGIPTANDDIADEFVKKSLELQLKIAKEIKDITGQQIYVFDTSNTFADASIVVMANIRVLETKNKQLGVLSQAAQMTFSTSNQYKKFTNEDLHVDEVGLYI

SEQ ID NO: 20867 - protein, 292 aa, Diabrotica virgifera
  misc_feature: Coding regions on vcDNA: vcDNA=SeqID_564; Strand=+; Position=16-891
  misc_feature: Homolog annotation: Hit_ID=XP_320865.1; Match level="QueryCoverage =98%, HitCoverage=57%, E-value=3e-86, Identity=53%"; Hit description =ENSANGP00000019166 [Anopheles gambiae]
  misc_feature: Gene Ontology Annotation: Molecular function=inositol-145 -trisphosphate 5-phosphatase activity; Cellular component=ruffles; Biological process=biological_process unknown
  misc_feature: Pfam annotation: Pfam_ID=Exo_endo_phos; Match level="Score=85.3, E -value=1.6e-22, Copies=1"; Pfam description =Endonuclease/Exonuclease/phosphatase f
  misc_feature (240)..(240): Xaa can be any naturally occurring amino acid
  misc_feature (274)..(274): Xaa can be any naturally occurring amino acid
MDNLRLYLATYNVGTSSPDQDLRELLSITDRKSETRPDFFALSFQEVKAQPQNMLMDTLFDDPWTFAIKELLQRDYIKLKSLRLQGLLLIVFSLRKHLLNIREIDSEYTRTGLGGMWGNKGAVSIRLSIYGCSLCFVNAHLSAHDNHLDDRVEDYNSIIHDQEFHVPETTKIFYHDYVFWMGDLNFRLKEEFDKTPEEIERLVVKKEMKALFEHDQLRYVMRKGEAFSELTEQDPTFPPXTFKFTVGTPCYDYKRRPAWCDRILYKVNSNNYEXVTLKVDQLSYKSHPTMVP

SEQ ID NO: 20868 - protein, 358 aa, Diabrotica virgifera
  misc_feature: Coding regions on vcDNA: vcDNA=SeqID_565; Strand=+; Position=238-1314
  misc_feature: Homolog annotation: Hit_ID=CAH92367.1; Match level="QueryCoverage =94%, HitCoverage=75%, E-value=8e-73, Identity=42%"; Hit description =hypothetical protein [Pongo pygmaeus]
  misc_feature: Gene Ontology Annotation: Molecular function=serine C -palmitoyltransferase activity; Cellular component=mitochondrion; Biological process=sphingolipid metabolism
  misc_feature: Pfam annotation: Pfam_ID=Aminotran_1_2; Match level="Score=-19.6, E -value=0.00013, Copies=1"; Pfam description=Aminotransferase class I and II
MLDENLLQERLAQFNPEPLVDITHNKPKESIESYTIQEDENNIDLAKTNFLNFLDNEEIKKSAENIIRKYGVGTCGPRAFYGTTDVHLDLEQRLADFLNMSDSIVYSYGFVAISSSIAAYCKRSDTVFLDKETNFPILQGVIASKSKIVYFDHNDPNSLRREVEKVIKNEKKPSRKFLIVEGVSWKTGKLLPLEEFLKVAEDYKIRIFLEESYSIGIYGDHGKGLTEHFNIDPSRIDMIIATLEAAFGSIGGFCAGSHLTIEHQRLSGAGYIFSASLPTFLVQACIESIRLMEDRPKQIRAFAREFQVFLEETCQYKVDSDPECAFKVFTVKEETGRKEKEEVILSYLQSKWCTFPDI

SEQ ID NO: 20869 - protein, 428 aa, Diabrotica virgifera
  misc_feature: Coding regions on vcDNA: vcDNA=SeqID_566; Strand=+; Position=155-1441
  misc_feature: Homolog annotation: Hit_ID=XP_318129.1; Match level="QueryCoverage =98%, HitCoverage=77%, E-value=1e-143, Identity=58%"; Hit description= ENSANGP00000003620 [Anopheles gambiae]
  misc_feature: Gene Ontology Annotation: Cellular component=nuclear matrix; Biological process=establishment and/or maintenance of chromatin architecture
  misc_feature: Pfam annotation: Pfam_ID=PHD; Match level="Score=62.8, E-value=9.4e -16, Copies=1"; Pfam description=PHD-finger
MSRKRDISREEIAKQFLLPERQSKIDTLLKQDGQAYCICRSSDSSRFMIACDACEEWYHGDCVKISEKEAKLIKQYICVRCKEEDPSLTTRWKTKKEHDETFSLSLGQEERKSRKRKERGENKNDKKIKKCGECMGCYRTEDCGRCDVCTRKNRHSSSKNRERCKQRICVNALGGARRKRRDSSSDREQSHNDHLKTDYPRHCYGPKCTNSARYGSKYCSDQCGMNLARTRILQILPQRLHEWSLTPPAAEESNKKALDQIRKQQVEVQQILQELDKRHRELDVVIERAKNATIDPRLEHNEDEDTETSMYCVTCGLEIHSKTATKHMEKCFNKYESQSSFGSVVKTKIEGSSIFCDFYNAEHRTYCKRLKVLCPEHCKDPKIGDHEVCGCPLVKDVFSSTGEFCRAPKKSCSKHQFWEKIRRAEIDL

SEQ ID NO: 20870 - protein, 314 aa, Diabrotica virgifera
  misc_feature: Coding regions on vcDNA: vcDNA=SeqID_567; Strand=+; Position=35-976
  misc_feature: Homolog annotation: Hit_ID=AAH78208.1; Match level="QueryCoverage =95%, HitCoverage=97%, E-value=4e-65, Identity=45%"; Hit description =Zgc:100754 [Danio rerio] ref|NP_001009912.1| zgc:100754 [Danio rerio]
  misc_feature: Gene Ontology Annotation: Molecular function=electron transporter activity; Cellular component=mitochondrion; Biological process =induction of apoptosis
  misc_feature: Pfam annotation: Pfam_ID=adh_short; Match level="Score=105.7, E-value= 1.1e-28, Copies=1"; Pfam description=short chain dehydrogenase
MGSMLAVPCTSQSRLDGKTAVITGANTGIGKITAKDFYKRGAYVIIACRNLDKANEAIQEIKQDCQGQENLGQLKSVKLDVSSLKSVRECAEELNKTEHKINLLVNNAGVMAVPFSKTVDGFELTFGTNHLGPYLLTLLLLPKIIQSGPGARIVNVSSSVHSMTCSGPDFEDLNFEKRKFNTNQAYVYSKLANIFFTRELHRRLRDHGIDGVNVYSLHPGAIKTDLSRSMNESLFPGARFILKDLGGIFMKTPEQGAQTQIHCSVDEKCADQSGLYYSECKPVEPSKGALNDDMAAKMWNVSWKLVGLDENYDP

SEQ ID NO: 20871 - protein, 191 aa, Diabrotica virgifera
  misc_feature: Coding regions on vcDNA: vcDNA=SeqID_568; Strand=+; Position=8-583
  misc_feature: Homolog annotation: Hit_ID=A32713; Match level="QueryCoverage=81%, HitCoverage=18%, E-value=6e-39, Identity=50%"; Hit description =reverse transcriptase homolog - fruit fly (Drosophila melanogaster)
KWKVNETKSTQVTFTSRRDECPTITLNDTQLPVSTQVKYLGLTLDKRLTWKPHIQAKKTQINIKIRQMSWLIGRKSKLNIENKLLLYKTMIKPIWTYGVQLRGCSKPSNIKIIQRVQSKILRMIFNAPWYVSNKTLHEDSATPLVEEEIPRITKSYLDGLRSHPNDEARLLNTPPEFARRLKKLWPTDLVN

SEQ ID NO: 20872 - protein, 273 aa, Diabrotica virgifera
  misc_feature: Coding regions on vcDNA: vcDNA=SeqID_569; Strand=+; Position=2-823
  misc_feature: Homolog annotation: Hit_ID=AAC24982.2; Match level="QueryCoverage =92%, HitCoverage=25%, E-value=6e-37, Identity=34%"; Hit description =reverse transcriptase [synthetic construct]
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=95.3, E-value=1.6e- 25, Copies=1"; Pfam description=Reverse transcriptase (RNA-dependent
EDITIQVTEIRKAIKELKNGRSPGPGDIPAELIKCGSQKLFETVTWYNGSPVPDEWKIAYISSIHKKGDKLKCENYRGISVTSTFSRLYGRIIRDRIEKEYKDQEEEEQSGFRTGRSCTDNIFCLKQLIEKKLSTNQETHLIFIDLQKAYDTVPVNKLWNVLRQTNISVTLIKALRNLYEGSTSQIKTGNRLSQSFLVNKGLRQGCCVSPTLFKIYVAKALKEWKRKCRGMGVDLGEICLYTLQFADDQVVIANDKDNLEYMARNYKKNIESD

SEQ ID NO: 20873 - protein, 238 aa, Diabrotica virgifera
  misc_feature: Coding regions on vcDNA: vcDNA=SeqID_570; Strand=+; Position=46-762
  misc_feature: Homolog annotation: Hit_ID=XP_425408.1; Match level="QueryCoverage =68%, HitCoverage=21%, E-value=2e-32, Identity=44%"; Hit description =PREDICTED: similar to haploid germ cell-specific nuclear protein kinase [Gallus gallus]
  misc_feature: Gene Ontology Annotation: Molecular function=protein serine/threonine kinase activity; Cellular component=nucleus; Biological process=cell cycle
  misc_feature (164)..(164): Xaa can be any naturally occurring amino acid
  misc_feature (204)..(204): Xaa can be any naturally occurring amino acid
MHLCKENSDLSCMCITTYASLPGYVPDQIFEASLEDSFRCLSLTQNQQRNNSISKNQQLGVPVTAREIVLRKCGQTEPIQFSQCFTDSILQNCQKIGEGVYGEVFLLRNPDGGTSVLKIIPVEGDQIVNGERQKKFEEVLSEIIITIELSNLRHNKRNGISSFXEVQKIQCVQGTYPEKLIDLWDLFDETRGSENDCPDMFKEXQLYIVFQMAYKKWNLSFSTTQCKLTPCSQALADS

SEQ ID NO: 20874 - protein, 306 aa, Diabrotica virgifera
  misc_feature: Coding regions on vcDNA: vcDNA=SeqID_571; Strand=+; Position=4-924
  misc_feature: Homolog annotation: Hit_ID=AAS15645.1; Match level="QueryCoverage =89%, HitCoverage=53%, E-value=2e-53, Identity=42%"; Hit description =carboxylesterase [Aphis gossypii] dbj|BAA32385.1| carboxylesterase precursor [Aphis gossypii]
  misc_feature: Gene Ontology Annotation: Cellular component=synaptic junction; Biological process=cholesterol catabolism
  misc_feature: Pfam annotation: Pfam_ID=COesterase; Match level="Score=78.7, E-value= 1.6e-20, Copies=1"; Pfam description=Carboxylesterase
MTATSLLFVVNLLAIIFVEVSSENVQVTTNEGTILGTTSLSEKNKTMYMFHGVPFAEPPKRFELAVPKSNWTGVLNCTYERDQCVQGIGIVEGSEDCLYLNIASPKLNGRAPVLVWIHGGTFNAGNGSLITYSPELFLEEGLVVVGIQYRLGVFGFLSTGDLTCPGNWGLKDQTLALQWVQRNIAHFGGDPKRVTIWGASAGSASVSLHLNSPRSKGLFSGAIMNSGVSLCLWALSRTGNELAHNTGTALGVGSANSSQLIENLKKVDYASLQNASAILSVTTFNIFPLIGIALGPSIEVHIRQLS

SEQ ID NO: 20875 - protein, 114 aa, Diabrotica virgifera
  misc_feature: Coding regions on vcDNA: vcDNA=SeqID_572; Strand=+; Position=3-344
  misc_feature: Pfam annotation: Pfam_ID=SapB_1; Match level="Score=8.1, E-value =0.097, Copies=1"; Pfam description=Saposin-like type B, region 1
DAWANAWADAWANMKTALVLALLSCVALTVYAQHEPTLGPGPRPEPTRGPIPDELRCDTCVTLADIIKGYADERIPLDEVRHEAEKLCRDLPEQLREACERELLPNLDKVYEEL

SEQ ID NO: 20876 - protein, 282 aa, Diabrotica virgifera
  misc_feature: Coding regions on vcDNA: vcDNA=SeqID_573; Strand=+; Position=2-850
  misc_feature: Homolog annotation: Hit_ID=NP_610556.1; Match level="QueryCoverage =85%, HitCoverage=29%, E-value=1e-86, Identity=58%"; Hit description =CG30011-PC, isoform C [Drosophila melanogaster] gb|AAF58837.2| CG30011-PC, isoform C [Drosophila
  misc_feature: Gene Ontology Annotation: Molecular function=specific transcriptional repressor activity; Cellular component=nucleus; Biological process =negative regulation of transcription
  misc_feature: Pfam annotation: Pfam_ID=CP2; Match level="Score=71.9, E-value=1.7e -18, Copies=1"; Pfam description=CP2 transcription factor
TVTSTNFNLIEDKRFQYVLAAATSIATKQNEDTLTYLNQGQSYEIKLKKLGDLSYYRGKILKTFIRVCFHERRLQYMEKEQILSWQSSRPGDRILEVDVPLSYGAYDLTQPTNALNMIHFNWDPTKEVGVYIKVNCISTEFTAKKHGGEKGVPFRIQVETFQNSDQNTHNAQKILHAAACQVKVFKLKGADRKHKQDREKIMKRPLSEREKYQPSYECTVLNDLPNEVIMPSPPLSPISTDANSIDSNPPVQNNNLLVSKADTSADSGKIIPKIISSPGLDL

SEQ ID NO: 20877 - protein, 177 aa, Diabrotica virgifera
  misc_feature: Coding regions on vcDNA: vcDNA=SeqID_574; Strand=+; Position=105-638
  misc_feature: Homolog annotation: Hit_ID=XP_311387.1; Match level="QueryCoverage =93%, HitCoverage=83%, E-value=6e-36, Identity=49%"; Hit description =ENSANGP00000017418 [Anopheles gambiae]
  misc_feature: Gene Ontology Annotation: Molecular function=cytochrome b; Cellular component=mitochondrial membrane; Biological process=tricarboxylic acid cycle
  misc_feature: Pfam annotation: Pfam_ID=Sdh_cyt; Match level="Score=144.1, E-value =3.3e-40, Copies=1"; Pfam description=Succinate dehydrogenase cytochrome b s
TILKMSLIFRLAGQRCGSQFLKNNSGIITCVRPVTLKASNVSSPKEEGHDERNMKLGRPQSPHLTIYAPQLTSMLSITHRATGMALSFYAIAFGLTAAVAPESISSYIETIECAGVGAATIAAAKFVLAFPMTYHFWNGIRHLLWDTGKFLTIGEVYTTGYIMLALSIASAVALCMM

SEQ ID NO: 20878 - protein, 268 aa, Diabrotica virgifera
  misc_feature: Coding regions on vcDNA: vcDNA=SeqID_575; Strand=+; Position=35-840
  misc_feature: Homolog annotation: Hit_ID=XP_221641.2; Match level="QueryCoverage =94%, HitCoverage=71%, E-value=7e-54, Identity=44%"; Hit description =similar to carbonyl reductase 3 [Rattus norvegicus]
  misc_feature: Gene Ontology Annotation: Molecular function=carbonyl reductase (NADPH) activity; Cellular component=cytosol; Biological process =biological_process unknown
  misc_feature: Pfam annotation: Pfam_ID=adh_short; Match level="Score=68.3, E-value =2.1e-17, Copies=1"; Pfam description=short chain dehydrogenase
  misc_feature (242)..(242): Xaa can be any naturally occurring amino acid
MSPQKVAVLTGGNKGIGYATIKGLCERFDGIVYLTARDVTRGKSAVAKLEKENLKAVFHQLDIDSQTSVDEFRNFIEKEHGGLDLLINNAAICFWSAAPNPTFAQSSQTIETNYFGTVRVCEALFPLLRNNAKVVNVSSCEGHLLKIPSENLRREFSRNDLTIPELNQLIGKFLKAVEIEKHREDGWGGSTYGVSKVAVSALTFIQQRMFDEEQPNRNISINAVYPGFVKTDMTEHHGFLTXREGAKSSLFAALDADLKGNISGQIAV

SEQ ID NO: 20879 - protein, 95 aa, Diabrotica virgifera
  misc_feature: Coding regions on vcDNA: vcDNA=SeqID_576; Strand=-; Position=651-938
  misc_feature (48)..(48): Xaa can be any naturally occurring amino acid
  misc_feature (62)..(62): Xaa can be any naturally occurring amino acid
FPMISHFKSATTIKRKDLVDAGHVRNVSEYNKCIQYCYIQYFYMNQYXSCNIVFSFLKNPYXPFQFMKFIKCTKQNCQLPLTQRCHILFRKSTVI

SEQ ID NO: 20880 - protein, 252 aa, Diabrotica virgifera
  misc_feature: Coding regions on vcDNA: vcDNA=SeqID_577; Strand=-; Position=3-758
  misc_feature: Homolog annotation: Hit_ID=P48810; Match level="QueryCoverage=98%, HitCoverage=66%, E-value=1e-88, Identity=62%"; Hit description =Heterogeneous nuclear ribonucleoprotein 87F (HRP36.1 protein) (P11 protein) pir||S22315
  misc_feature: Gene Ontology Annotation: Molecular function=heterogeneous nuclear ribonucleoprotein; Cellular component=nuclear speck; Biological process=RNA-nucleus export
  misc_feature: Pfam annotation: Pfam_ID=RRM_1; Match level="Score=157.7, E-value =2.7e-44, Copies=2"; Pfam description=RNA recognition motif. (a.k.a. RRM, R
MKGDDSKNQEPEQFRKLFIGGLDFRTTDESLKEHFEKWGTIVDVVVMKDPTTKRSRGFGFITYSKAQMVDDAQNARPHRVDGRVVEPKRAIPRQDIGRPDAGATVKKLFVGGMKDDIEEEDLKEYFTKFGNIMSVSVVCDKDSGKKRGFGFVEFEDYDSVDKVILQRSHTIKGRNVDVKKALSKSEMDRSGNRGGGSMGGGRGGNFNQDNLRHIIGGGGGNWNRGGGDWNQGGAGGYGGGGGGGPWPQDPGI

SEQ ID NO: 20881 - protein, 108 aa, Diabrotica virgifera
  misc_feature: Coding regions on vcDNA: vcDNA=SeqID_578; Strand=+; Position=644-970
  misc_feature (12)..(12): Xaa can be any naturally occurring amino acid
PPLSHFFTTYEXDDDINFYILHYTKLTELRNFEVCRLFNDADIVKTIKTNHHANDRSDVEEDIERYNYKILNFMSKNPQTKHLRTYVYKANCHYFFMQNYPLKFVALI

SEQ ID NO: 20882 - protein, 81 aa, Diabrotica virgifera
  misc_feature: Coding regions on vcDNA: vcDNA=SeqID_579; Strand=+; Position=401-646
NYENTQRDYKIFQNVFSFLATRKHRHMYRYVQHYLPVMSVDLTRSYNLSRSVHNHYTYLGFTLDTKLTWDYHGMIFYKQSS

SEQ ID NO: 20883 - protein, 116 aa, Diabrotica virgifera
  misc_feature: Coding regions on vcDNA: vcDNA=SeqID_580; Strand=+; Position=574-922
  misc_feature: Homolog annotation: Hit_ID=AAL67867.1; Match level="QueryCoverage =91%, HitCoverage=89%, E-value=3e-38, Identity=72%"; Hit description =NADH dehydrogenase subunit 3 [Crioceris duodecimpunctata] ref|NP _569066.1| NADH dehydrogenase subunit 3
  misc_feature: Pfam annotation: Pfam_ID=Oxidored_q4; Match level="Score=115.8, E -value=1.1e-31, Copies=1"; Pfam description=NADH -ubiquinone/plastoquinone oxidored
  misc_feature (60)..(60): Xaa can be any naturally occurring amino acid
  misc_feature (110)..(110): Xaa can be any naturally occurring amino acid
FTNKKKSGTKIIYLINIILVIILNLISKKTFYDREKNRPFECGFDPKTFARLPFSLHFFXLIAIIFLIFDVEITLLLPFIIILKIRNIINYRIIIIFFIIILLLGVYHEXNQGALN

SEQ ID NO: 20884 - protein, 387 aa, Diabrotica virgifera
  misc_feature: Coding regions on vcDNA: vcDNA=SeqID_581; Strand=+; Position=724-1887
  misc_feature: Homolog annotation: Hit_ID=AAH42316.1; Match level="QueryCoverage =98%, HitCoverage=97%, E-value=1e-125, Identity=56%"; Hit description= Ctsd protein [Danio rerio] gb|AAH62824.1| Ctsd protein [Danio rerio]
  misc_feature: Gene Ontology Annotation: Molecular function=aspartic-type endopeptidase activity; Cellular component=lysosome; Biological process=induction of non-apoptotic programmed cell death
  misc_feature: Pfam annotation: Pfam_ID=Asp; Match level="Score=540.3, E-value=1.7e -159, Copies=1"; Pfam description=Eukaryotic aspartyl protease
MLSKLLIFVFAAVFVSAEINRIPLKKFEKPRDALNRNGLKEGLLAKYNRNVNDDSAVVLTNYLDAQYYGEIGIGTPAQTFNVIFDTGSSNLWIPSSKCGFLEVACLLHNKYDADKSSTYVKNDTRFAIAYGSGEVAGLISQDVVDFGGLQAKDQLFAEATQEPGLAFLVGKFDGILGMGYPEISVNGITPVFNSLVEQGAVQEPVFSFYLNRDPDGEVGGELLLGGSDPNYYKGDFTYVDVSAKGYWQVVMDSLNVGSSLKLCSNGCQIIVDTGTSLIAGPSAEVEKLHKEIGAFSFLNGEYIIDCSKIDQLPEISFVFGGKEFTLSGNDYVLKQSNGGIDICISGFMGLDLNTRTHVEWILGDVFIGKFYTEFDFGNNRVGLAEAV

SEQ ID NO: 20885 - protein, 381 aa, Diabrotica virgifera
  misc_feature: Coding regions on vcDNA: vcDNA=SeqID_582; Strand=+; Position=91-1233
  misc_feature: Homolog annotation: Hit_ID=XP_309360.1; Match level="QueryCoverage =85%, HitCoverage=38%, E-value=1e-114, Identity=63%"; Hit description= ENSANGP00000008246 [Anopheles gambiae]
  misc_feature: Gene Ontology Annotation: Molecular function=ATP binding; Cellular component=mitochondrion
  misc_feature: Pfam annotation: Pfam_ID=Dynamin_N; Match level="Score=-23.3, E-value= 0.00088, Copies=1"; Pfam description=Dynamin family
  misc_feature (368)..(368): Xaa can be any naturally occurring amino acid
MEHLLRGQFGRIIISTYSHTPLKYGPQKSCQRGMCILWSGRTLDRSRPFLKQQYIYQRREYGMLIARALRGVLKIRYLLLGGAVAGGGALQKKYNDWKDGLPDMKWLDEVLPDNEKFQQWRANLVDFKDNIKNNIELDPRIKALTENKYNEFKSWFDQRLDDAIAAAEAQESAQPNKEEGKKEIIQKTMVYAANPFSADEKARKETQERLNNIQDEMMQTQIKYQRELERLEKENKELRKQNLLLKQGKKPLTRKIKRSLIDMYSEVLDELADFDSGYNTQDQLPRVVVVGDQSSGKTSVLEMIAQARIFPRGAGEMMTRAPVKVTLSEGPYHIAQFRDSTREFDLTKESDLSDLRREVELRMRNSGXGGKTGSSESISMT

SEQ ID NO: 20886 - protein, 80 aa, Diabrotica virgifera
  misc_feature: Coding regions on vcDNA: vcDNA=SeqID_583; Strand=-; Position=614-857
  misc_feature: Homolog annotation: Hit_ID=AAW48899.1; Match level="QueryCoverage =70%, HitCoverage=82%, E-value=1e-13, Identity=68%"; Hit description =lark-PB [Bombyx mori]
  misc_feature (31)..(31): Xaa can be any naturally occurring amino acid
MGGSLRDSGFSRSASDYGMFSRRSPPPSGKXRSSRMYEDFSRDSFDDRRPGLRGPSPPRRYAPLKACMYATAKLPRLHNS

SEQ ID NO: 20887 - protein, 231 aa, Diabrotica virgifera
  misc_feature: Coding regions on vcDNA: vcDNA=SeqID_584; Strand=+; Position=2-694
  misc_feature: Homolog annotation: Hit_ID=NP_572387.1; Match level="QueryCoverage =91%, HitCoverage=23%, E-value=4e-40, Identity=43%"; Hit description =CG1677-PA [Drosophila melanogaster] gb|AAF46248.2| CG1677-PA [Drosophila melanogaster]
ERAYGKVEPPVVESAWERGLRTAKEMLRKSVKRKEQDIDFEEKKMNLSLVQEEFDKENGYYGRASPEPRYVRHVEYPARPPPEEYYGRRQVVYEQQDYMPPPRERARPYRELPPHRMPDYYSNKYNEEEAPPHSSGSTGKRSNKPKREVIVQRVESERPSSGRGDEWQDPWMRSKDQGRRKEAPGRKRSYSTGSSYSSSSSSSSSDSSRSSYASRRRARGRRSRSRKGKPV

SEQ ID NO: 20888 - protein, 94 aa, Diabrotica virgifera
  misc_feature: Coding regions on vcDNA: vcDNA=SeqID_585; Strand=-; Position=217-501
LGTIIWETFFNINFTKKSHSPQSALHSPKPKMQPSDIKPCQQYTRYVKKYEFHSRANYIPLYFKISKNFIMKSYLYLKTIFKYEITAFYLKKKF

SEQ ID NO: 20889 - protein, 530 aa, Diabrotica virgifera
  misc_feature: Coding regions on vcDNA: vcDNA=SeqID_586; Strand=+; Position=2-1591
  misc_feature: Homolog annotation: Hit_ID=NP_995977.1; Match level="QueryCoverage =100%, HitCoverage=34%, E-value=0.0, Identity=69%"; Hit description =CG12002-PC, isoform C [Drosophila melanogaster] ref|NP_995976.1| CG12002-PD, isoform D [Drosophila
  misc_feature: Gene Ontology Annotation: Molecular function=chromatin binding; Cellular component=integral to membrane; Biological process=anti -apoptosis
  misc_feature: Pfam annotation: Pfam_ID=An_peroxidase; Match level="Score=620.9, E -value=9.2e-184, Copies=1"; Pfam description=Animal haem peroxidase
CNNLQHPTWGASLTEFRRVLRPIYEDGLQKPVGWIKDKKYHGYTKPSSRLVSTTLITTTKITPDPEITHMVMQWGQFLDHDLDHALPSVTSESWDGIDCKKSCDYRAPCYPMDVPQNDPRVTNRRCIDFIRTSSICGSGMTSVFFDSIQPREQINQLTSYIDASQVYGFSEELASNLRDHNTNWGRLREGPIFPGKKALLPYAENQGIDCRRNLTESTLNCFVAGDIRANEQVGLLAMHTIWLREHNRIAKELKIMNPHWDTDQLYHEARKIVGASMQHVTYKQWLPIIIGKKGMEKLGEYQGYNPNINPSISNVFATAALRFGHTLINPVLHRLNSDFKPIREGNLPLSKAFFSPWRLVEEGGIDPLLRGFFTVAAKIKKSDENLNSELTETLFQAAHAVALDLAAMNVHRGRDHALPEYLEYRKFCNMTPVNSFDDLRYDISDANVRRKLQQLYGHPGNIDVFVGGILEDQIDGGKVGPLFQCILIEQFKRLRDGDRFYYENPSVFKPDQLAQIKQFNLARAICDNGD

SEQ ID NO: 20890 - protein, 564 aa, Diabrotica virgifera
  misc_feature: Coding regions on vcDNA: vcDNA=SeqID_587; Strand=+; Position=14-1705
  misc_feature: Homolog annotation: Hit_ID=AAH68965.1; Match level="QueryCoverage =84%, HitCoverage=58%, E-value=4e-41, Identity=25%"; Hit description =LOC414586 protein [Xenopus laevis]
  misc_feature: Gene Ontology Annotation: Molecular function=aldehyde dehydrogenase (NAD+) activity; Cellular component=mitochondrion; Biological process=ethanol metabolism
  misc_feature: Pfam annotation: Pfam_ID=Aldedh; Match level="Score=-107.6, E-value =3.8e-12, Copies=1"; Pfam description=Aldehyde dehydrogenase family
MEPAKVKNKIGDIFNNMAYGPNFEDTKLAIEWLKTKKSSFFAYIKKPTEELNGTPLPLLSTINQEQLCTINVPDIDTVKKILEQEEKSWKGVNPLEKIKIINKIGLGIEKKAELFAQLEILTRGILSKHTKSKAVTLLAQYFQYYSAFALRCEAECKERGIAVGVISNENYLAHLGLFVAPALAAGHNVVLQIGSLLAPAAFLLQEIALSVGLPEGTLKIIPSDDGELVPYFTMDNVKVISLFVDLNNDKYRGCHNHNKHLIVLSTYKTPAVIFDSADLDAASEGIIDSSWSYQSMLPWSTNTILVQENIFPTFLAKLKSKLKTLEVSTADNKSARISINLNNTSQLNDLNNSIKQARLQGIEVFQSTDKSDVWNPTVFVGGKINHNALGSKDGQSNVITVVAFRSIDEAVSLANNSNQGLWASVWSDNANLINEVTRKLKVSNISVNGSYELSPEVVISPTKDSGMGFFGGREGFMEYLSGPIVPTCCTKLERSDSVANVDIVNTAKKAQESQKIPTIQKQKILDFANVSTKSSEWGNDLKCVYKIIHNSQHNVTSTICGYNL

SEQ ID NO: 20891 - protein, 293 aa, Diabrotica virgifera
  misc_feature: Coding regions on vcDNA: vcDNA=SeqID_588; Strand=+; Position=56-935
  misc_feature: Homolog annotation: Hit_ID=XP_395882.1; Match level="QueryCoverage =88%, HitCoverage=81%, E-value=1e-42, Identity=35%"; Hit description =similar to CG1102-PA [Apis mellifera]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=-0.2, E-value =0.00047, Copies=1"; Pfam description=Trypsin
  misc_feature (258)..(258): Xaa can be any naturally occurring amino acid
MVSSSMAFFGNSLLFMCFMVAVKSQGFWGNANQGCRTPTGETGDCIPARQCRALITVLQTVKRPLTPSVTKQLNAYYCSFAYNMANVCCPQGPIILQDDSSQEVQQDPPDVSNHRNLRLLPPDCGYLDIPNKIRNGQNAEINEFPWMTLLRYRTSTGAEFRCGGTIINNKYILTAAHCITRLKDPLLDVRVGEYNTSSVIDCVMDQNGIAKCINDPIQNLAIEEIIPHPEFNPNVIANDIGLLRVSRMNINAENARPXCLPLGEHRLDEFRKSTVTGWGYTDSYAEVKTDVPS

SEQ ID NO: 20892 - protein, 236 aa, Diabrotica virgifera
  misc_feature: Coding regions on vcDNA: vcDNA=SeqID_589; Strand=+; Position=172-882
  misc_feature: Homolog annotation: Hit_ID=XP_393125.1; Match level="QueryCoverage =94%, HitCoverage=99%, E-value=2e-78, Identity=64%"; Hit description =similar to syntaxin-like protein [Apis mellifera]
  misc_feature: Gene Ontology Annotation: Molecular function=t-SNARE activity; Cellular component=integral to plasma membrane; Biological process =nonselective vesicle transport
  misc_feature: Pfam annotation: Pfam_ID=SNARE; Match level="Score=52.7, E-value=1e -12, Copies=1"; Pfam description=SNARE domain
MTLEDPFFVVKDEVFKALNKTRGLFLRWSELQEDGICCTKDEVEWTNTELKNSLRSIEWDLEDLEDTIDIVEKNPSKFKIDNKELTTRKHFIDSTKNEVKYMKESINMSRSRSKDRSARQPLLESSPVRIASARVTTKYSKLENDFDSPQRQFLNDTLSQQQYLTRQQDEHLEAISDSLGSLKTVSRHIGIELDEQAGMLDELGTDLENTDSKLDSTIQKVAKVLRLSNDGRQWTV

SEQ ID NO: 20893 - protein, 123 aa, Diabrotica virgifera
  misc_feature: Coding regions on vcDNA: vcDNA=SeqID_590; Strand=-; Position=1984-2355
GRHDHTACFFSKKGGREVMTQIKIYKSSKNINIKYIDNTMICDKYAYMEIRSRHFSFVFFFFFFRFPLVQKLDKNVQIARQSQITLEIWQHRCWIRFHNVANLSKYNIILRLIPGNYSSTTSK

SEQ ID NO: 20894 - protein, 479 aa, Diabrotica virgifera
  misc_feature: Coding regions on vcDNA: vcDNA=SeqID_591; Strand=+; Position=143-1582
  misc_feature: Homolog annotation: Hit_ID=XP_308390.1; Match level="QueryCoverage =88%, HitCoverage=97%, E-value=7e-60, Identity=31%"; Hit description =ENSANGP00000009437 [Anopheles gambiae]
  misc_feature: Gene Ontology Annotation: Molecular function=glucose transporter activity; Cellular component=integral to plasma membrane; Biological process=glucose transport
  misc_feature: Pfam annotation: Pfam_ID=Sugar_tr; Match level="Score=137.5, E-value =3.1e-38, Copies=1"; Pfam description=Sugar (and other) transporter
MARSVEISSEKEYSEKDSFTTERARVWPQVLACLIASLGAFTQGILFSWTSPFIVKIAQDKVNYNISEEEAARLPTIQPLTVLLTSLIFFKLPDIIGRKKTLLLISIPHILSFITAAVARSIYVFYLSRVFSGLANGFLWTALPMYIGEVTCPKIRGLCGTLITTAIFVGQLAVNVVGSYCDVATTSYIFMPVSILFVILFAFMPETPYYYLIKKDYGAARRSLIFLTRKKNVVDDLNNLKSDVDRQMSETGTWKDLVVIESNRNALFCAVFLRVSQSYSGISVFIQYTQYIFLKAGGNVSPQMASIIYSILCVVITLLVTLFVVSKFGRKPLYSNSSVLCSIILAVMAVYFYLEQFVPTFDISSLSWLPITSLVTYQVCSCFGVAIIPSIMLGELFSASVKSKAVATMTFVNSGGIFLANATFNFLSSVGGSYAPFLFFAICTAATAVVTRFVVPETKDKTLEEIQMNLKKSVENESV

SEQ ID NO: 20895 - protein, 138 aa, Diabrotica virgifera
  misc_feature: Coding regions on vcDNA: vcDNA=SeqID_592; Strand=+; Position=94-510
  misc_feature: Homolog annotation: Hit_ID=EAL41720.1; Match level="QueryCoverage =64%, HitCoverage=65%, E-value=5e-24, Identity=57%"; Hit description =ENSANGP00000027955 [Anopheles gambiae str. PEST] ref|XP_564527.1| ENSANGP00000027955 [Anopheles gambiae st
  misc_feature: Gene Ontology Annotation: Molecular function=transcription co -repressor activity; Cellular component=nucleus; Biological process =restriction of R8 fate
  misc_feature: Pfam annotation: Pfam_ID=HLH; Match level="Score=21.6, E-value =0.0009, Copies=1"; Pfam description=Helix-loop-helix DNA-binding domain
MKAVVSALCTENGISAISGKITKRKDIENEEIQMYLSKLKDLVPFMPKNKKLSKLEVIQYVIDYICDLQSALETHPAVNAFDAAAALGQKKSQAAVSPRQPLGVRPSPNTILAPCEAPVLQNVTSSEALTPSDRLSSC

SEQ ID NO: 20896 - protein, 88 aa, Diabrotica virgifera
  misc_feature: Coding regions on vcDNA: vcDNA=SeqID_593; Strand=+; Position=44-310
HIKQDDMIRGINSSNMMKTPYFYPQWQQYNTCLAAPTITGKGTARLNPKLSTSPMARKINLVCQTKPIIQRDLQRYQIMHIRIQRRTK

SEQ ID NO: 20897 - protein, 455 aa, Diabrotica virgifera
  misc_feature: Coding regions on vcDNA: vcDNA=SeqID_594; Strand=+; Position=85-1452
  misc_feature: Homolog annotation: Hit_ID=NP_497924.1; Match level="QueryCoverage =75%, HitCoverage=57%, E-value=7e-30, Identity=29%"; Hit description =insulin-like growth factor binding protein acid labile, P-granule Associated Novel protein
  misc_feature: Gene Ontology Annotation: Molecular function=insulin-like growth factor binding; Cellular component=soluble fraction; Biological process=embryogenesis and morphogenesis
  misc_feature: Pfam annotation: Pfam_ID=LRR_1; Match level="Score=95.4, E-value=1.5e- 25, Copies=13"; Pfam description=Leucine Rich Repeat
MVYVFMLLLCVLSVVSEKITFVDVKITLSSKKQQDLSEQIVITTKNLPSSIKNYNIDTYDAIKIEHQVLPIVYENAFQYLNTSHLAIVETDLKEFEPGAFNDLKKLETLTVGANLLKSIRKGIFNNLPITKLYLDDNKIKVIEGGSFDGMQRLTHIVLSMNKIIVLEKGLFKDLAELVSIRLDFNKIERIEELAFQNLPNLHRLDLDNNKIKILQASSLVNLPTLTVLLLQVNELESISLKNLDSLVVLWLYENKLKTLDMHMLNDLKSVKKINATNNEIGVLNCKSSTGFNVQFFDFSYNKIKNISEDCFNGSKIEHLKLSNNKIQNIPAESFRSANIKELHLQNNLITEIKKGTFANLHMSQLLLENNQIVDIEAGAFENSTFQSINLDGNKLRSIRHGVFDNTKVAFISILRNDGINERAFNNVSNLWDSKSGTNKLEFRRTTDKVFADEPF

SEQ ID NO: 20898 - protein, 211 aa, Diabrotica virgifera
  misc_feature: Coding regions on vcDNA: vcDNA=SeqID_595; Strand=+; Position=40-675
MSEGDVVNTSEEVQENQEVVEESIAPVKSVKNVEAAPPNLFDIFKPKDAANADKDGAKPEDKPADGTKPADETKPADGTTEAKPNIFDVFKPKTDAVTKPEEPKPLFPANDPFNFKKNAEEAQKAFKEKGLGGWIATVQKNVQETLNALIKGGEGKKLVEAIIEWVKNLIKTVQEKGLPAVTKQVEAKLKEILARAIVENNKWPMKALTQK

SEQ ID NO: 20899 - protein, 323 aa, Diabrotica virgifera
  misc_feature: Coding regions on vcDNA: vcDNA=SeqID_596; Strand=+; Position=61-1029
  misc_feature: Homolog annotation: Hit_ID=XP_309809.1; Match level="QueryCoverage =99%, HitCoverage=83%, E-value=7e-99, Identity=54%"; Hit description =ENSANGP00000018221 [Anopheles gambiae]
  misc_feature: Gene Ontology Annotation: Molecular function=(S)-2-hydroxy-acid oxidase activity; Cellular component=peroxisome; Biological process =fatty acid alpha-oxidation
  misc_feature: Pfam annotation: Pfam_ID=FMN_dh; Match level="Score=407.2, E-value=2e- 119, Copies=1"; Pfam description=FMN-dependent dehydrogenase
  misc_feature (295)..(295): Xaa can be any naturally occurring amino acid
  misc_feature (298)..(298): Xaa can be any naturally occurring amino acid
  misc_feature (310)..(310): Xaa can be any naturally occurring amino acid
MSDLFSVSEFEKHALEVLPKNIRDYYRSGAGRQETLADNRKAFFRYKVRPRYLRNVENIDLSTVVLGEKISMPIGIAPSGMQKMAHPMGELAVVKAAQEMGVVYTLSTMSTYSIEEVAQAAPMAVKWFQVYIYKDRALTRNLILRAERAGFKAIVLTVDAPLLGLRFPDLKNKFTLPPHLKLANFEGKISEMNQNLTKGSGLQNYVNDLFDPSINWEDIKWLKSITHLPIVLKGILTAEDALLAVEAGVAAVQVSNHGSRQLDGTPAAIDALCDVVKAVGDKIEVYVDGGVTDGXDVXSSCALGARWLWXGRSALWGLGHSGQ

SEQ ID NO: 20900 - protein, 215 aa, Diabrotica virgifera
  misc_feature: Coding regions on vcDNA: vcDNA=SeqID_597; Strand=+; Position=2-649
  misc_feature: Homolog annotation: Hit_ID=XP_321327.1; Match level="QueryCoverage =94%, HitCoverage=42%, E-value=8e-43, Identity=43%"; Hit description =ENSANGP00000012864 [Anopheles gambiae]
  misc_feature: Pfam annotation: Pfam_ID=DUF580; Match level="Score=-0.6, E-value=1e -08, Copies=1"; Pfam description=Protein of unknown function, DUF580
QNGTGSKNKNNLDSPICTSTGVVFKYHLGSIAFGSFIITLIAIIRALLTSLTKNKAVKAIVDACIGALEDFLKFLSKNAYILIAMHGKPFYKSGKRAAKIIFQNAVNIVSINFVGDFVLGMAQLLIVLISLLISVGLMRGVKSEWEYVVYLIVFFVSLCVAITCFSIFETTIDTIFLCFCEDSLLNDGMARPYAMSRDLMEFVENSKKLYGEKKD

SEQ ID NO: 20901 - protein, 215 aa, Diabrotica virgifera
  misc_feature: Coding regions on vcDNA: vcDNA=SeqID_598; Strand=+; Position=251-898
  misc_feature: Homolog annotation: Hit_ID=AAT01087.1; Match level="QueryCoverage =100%, HitCoverage=100%, E-value=1e-109, Identity=92%"; Hit description=putative rab11 [Homalodisca coagulata]
  misc_feature: Gene Ontology Annotation: Molecular function=RAB small monomeric GTPase activity; Cellular component=Golgi apparatus; Biological process=signal transduction
  misc_feature: Pfam annotation: Pfam_ID=Ras; Match level="Score=341.4, E-value=1.3e -99, Copies=1"; Pfam description=Ras family
MSTKDDEYDYLFKVVLIGDSGVGKSNLLSRFTRNEFNLESKSTIGVEFATRSIQVDGKTIKAQIWDTAGQERYRAITAAYYRGAVGALLVYDIAKHLTYENVERWLRELRDHADQNIVIMLVGNKSDLRHLRAVLTEEAKAFAERNGLSFIETSALDSTNVDNAFQNILTEIYRIVSQKQIRDPPEGDVIRPQNVEPIDVKPTMNSDGVRKQCCQ

SEQ ID NO: 20902 - protein, 232 aa, Diabrotica virgifera
  misc_feature: Coding regions on vcDNA: vcDNA=SeqID_599; Strand=+; Position=107-805
  misc_feature: Homolog annotation: Hit_ID=XP_313661.1; Match level="QueryCoverage =93%, HitCoverage=54%, E-value=1e-65, Identity=55%"; Hit description =ENSANGP00000013017 [Anopheles gambiae] gb|EAA09159.1| ENSANGP00000013017 [Anopheles gambiae
  misc_feature: Gene Ontology Annotation: Molecular function=molecular_function unknown; Cellular component=cellular_component unknown; Biological process=galactose metabolism
  misc_feature: Pfam annotation: Pfam_ID=Aldose_epim; Match level="Score=97.0, E -value=4.7e-26, Copies=1"; Pfam description=Aldose 1-epimerase
MSPADRESDVQFEEDGFGMFTDRTTGKSASVRRFTWKNANNVTVQVITYGATITSIRLPGKNGVVEDIVMGFDNMEGYLNHLNPYFGATVGRVANRTGYAKITIGENTYNVSANLGKHQLHGGFIGFDKVNWNHHVHGKKVILSYLSVDKEEGFPGDVLTSISFELNNDNEFLVDFKATSSKPSVINLTNHSYFNLAGHDKGAEELYKHVVSINADHTTDVDKDSIPTGKQR

SEQ ID NO: 20903 - protein, 256 aa, Diabrotica virgifera
  misc_feature: Coding regions on vcDNA: vcDNA=SeqID_600; Strand=-; Position=87-855
  misc_feature: Homolog annotation: Hit_ID=NP_728437.1; Match level="QueryCoverage =99%, HitCoverage=27%, E-value=1e-50, Identity=40%"; Hit description =CG14476-PE, isoform E [Drosophila melanogaster] ref|NP_728436.1| CG14476-PD, isoform D [Drosophila
  misc_feature: Gene Ontology Annotation: Molecular function=protein binding; Cellular component=alpha-glucosidase complex; Biological process =protein modification
  misc_feature (8)..(8): Xaa can be any naturally occurring amino acid
  misc_feature (28)..(28): Xaa can be any naturally occurring amino acid
FPDESRQXIRTALGLRYAHIPLFYTLFXQHEISGEPVIRPLFYQYPNDENVVDIDNEILVGDSVLAAMIAEPGASSVGVYLPGGANEYWYDIEDFRLYQGTGNYNIPVSLDKSLAFYRGGSIIPRKDRPRRASPLMKNDPFTLYIALDSNKKASGYLYVDDNESFEYKNQKYLYLHFSFEDNTFNSVLVDKTDYPTKEWVERLVILGPPKGIKGAKLTSKSLGTVELDTSYSHEDRVLVVRKPGVSIREKFTIKLY

SEQ ID NO: 20904 - protein, 117 aa, Diabrotica virgifera
  misc_feature: Coding regions on vcDNA: vcDNA=SeqID_601; Strand=+; Position=2-352
  misc_feature: Homolog annotation: Hit_ID=NP_609407.1; Match level="QueryCoverage =99%, HitCoverage=12%, E-value=5e-19, Identity=46%"; Hit description =CG5322-PA [Drosophila melanogaster] gb|AAF52957.1| CG5322-PA [Drosophila melanogaster]
FPGQHSIVSHIIKRYYIEEIKNNKTFYTDSNGRQLIKRIRNDHEFHDDDVEAASSNYYPVTSKISIEDIKSDLKLSILTDRSQGRTSLKDGEVEFMLPPRTLKDDYQGLEEPLQEME

SEQ ID NO: 20905 - protein, 242 aa, Diabrotica virgifera
  misc_feature: Coding regions on vcDNA: vcDNA=SeqID_602; Strand=+; Position=100-828
  misc_feature: Homolog annotation: Hit_ID=XP_413786.1; Match level="QueryCoverage =80%, HitCoverage=16%, E-value=3e-21, Identity=32%"; Hit description =PREDICTED: similar to hypothetical protein FLJ13213 [Gallus gallus]
  misc_feature: Gene Ontology Annotation: Molecular function=double-stranded DNA binding; Cellular component=nucleus; Biological process =establishment and/or maintenance of chromatin architecture
  misc_feature: Pfam annotation: Pfam_ID=RRM_1; Match level="Score=49.0, E-value=1.3e- 11, Copies=1"; Pfam description=RNA recognition motif. (a.k.a. RRM, R
MSEVESRKLADLRVIDLRLELERRGLDKNGVKQALLERLTKHLTDQGFDPATYIFKKNEQNEAFEDTEEDGKSKKSNEGSKKVTDGHDSPILLSLEEDEGANNADKKKREDSNQSSSGQASSGTTNGENSENRARDSKNEKKLGSKSNPTVVWISNLAENTRASDLKQALSACGRVTGAKIVVNARFPGSCCFGYVTMGSVEDVENVIEKLNNTELKGQMIKIEKYDLVRAVQLKKNEKSQT

SEQ ID NO: 20906 - protein, 329 aa, Diabrotica virgifera
  misc_feature: Coding regions on vcDNA: vcDNA=SeqID_603; Strand=+; Position=80-1070
  misc_feature: Homolog annotation: Hit_ID=XP_314713.1; Match level="QueryCoverage =94%, HitCoverage=96%, E-value=1e-152, Identity=85%"; Hit description= ENSANGP00000013055 [Anopheles gambiae]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=Mov34; Match level="Score=167.3, E-value =3.3e-47, Copies=1"; Pfam description=Mov34/MPN/PAD-1 family
  misc_feature (304)..(304): Xaa can be any naturally occurring amino acid
FSNKNNLFISFINLINNKMDRLLRLGGGMPGLTQAPPPSDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLTLADYSENCSVNEKTVADMLELAKNYNQAFKEEGKMTFPQLAIKNVGEHSTLKHFXKKGDFFFTNNIRPGVGTMLDTVVFK

SEQ ID NO: 20907 - protein, 290 aa, Diabrotica virgifera
  misc_feature: Coding regions on vcDNA: vcDNA=SeqID_604; Strand=+; Position=24-896
  misc_feature: Homolog annotation: Hit_ID=XP_395277.1; Match level="QueryCoverage =67%, HitCoverage=65%, E-value=4e-27, Identity=38%"; Hit description =similar to Larval cuticle protein A3A (TM-A3A) (TM-LCP A3A) [Apis mellifera]
  misc_feature: Gene Ontology Annotation: Molecular function=structural constituent of eye lens
  misc_feature: Pfam annotation: Pfam_ID=Chitin_bind_4; Match level="Score=95.2, E -value=1.7e-25, Copies=1"; Pfam description=Insect cuticle protein
MSHKVIAFVAFLAVAQAGVISPALPVQVDKDYDSNPQYMFAYSVNDPFTGDNKNQVEGRVGDRVEGQYSLDEPDGTRRIVDYTADDANGFQATVRKTPQVKTALITPAIQVKTAAVPVVSSEVSLSGDSVITNSALPVVDAKVTNVVAPAVSSVSTAEHLSSLAKVSSVSTVQHIAPVAKVAHVETPVAHVSYVTPLSVAHVAEVAKIRTVAPVTLTKIIPQTRITEHSQSIVHGAAQHSQSIVHGAALSPYRLATYSVPVRPHYTYSVPYSYDFAPTYYNAYPYSYYEY

SEQ ID NO: 20908 - protein, 273 aa, Diabrotica virgifera
  misc_feature: Coding regions on vcDNA: vcDNA=SeqID_605; Strand=+; Position=189-1007
  misc_feature: Homolog annotation: Hit_ID=XP_306103.1; Match level="QueryCoverage =72%, HitCoverage=45%, E-value=1e-44, Identity=45%"; Hit description =ENSANGP00000000137 [Anopheles gambiae]
  misc_feature: Gene Ontology Annotation: Molecular function=molecular_function unknown; Cellular component=nuclear membrane; Biological process =nucleobase, nucleoside, nucleotide and nucleic acid metabolism
  misc_feature: Pfam annotation: Pfam_ID=DEAD; Match level="Score=73.5, E-value=5.9e -19, Copies=1"; Pfam description=DEAD/DEAH box helicase
  misc_feature (218)..(218): Xaa can be any naturally occurring amino acid
  misc_feature (238)..(238): Xaa can be any naturally occurring amino acid
  misc_feature (241)..(241): Xaa can be any naturally occurring amino acid
  misc_feature (251)..(251): Xaa can be any naturally occurring amino acid
MFSVTRRVLKNCFNKRFIQNLQSLEGTIEGTSKNHSPSLLISCKRKKLNYHAGVQYKKFDEVPLASKGWNHSKSKGDFFLINRLKNEKSQRYSFDELNIHPKIRDALKIDEIRELTEFQARSINEVRKGSHLLLAAETGCGKTLSYLIPIIQDLISNKSETANTPKAVVIVPNRELAYQVGEIARHLGEAVGLTVKTVVGGKTKSLMMNPVFEDIDIXLVATPGALGKLSTVGIYKLXEAXYAVFDEADTXIDDSFIEEKGKLNQKGYPSSSY

SEQ ID NO: 20909 - protein, 404 aa, Diabrotica virgifera
  misc_feature: Coding regions on vcDNA: vcDNA=SeqID_606; Strand=+; Position=17-1227
  misc_feature: Homolog annotation: Hit_ID=XP_319040.1; Match level="QueryCoverage =98%, HitCoverage=43%, E-value=1e-152, Identity=67%"; Hit description= ENSANGP00000013260 [Anopheles gambiae]
  misc_feature: Gene Ontology Annotation: Molecular function=protein carrier activity; Cellular component=nuclear membrane; Biological process =protein-nucleus import, docking
  misc_feature: Pfam annotation: Pfam_ID=IBN_N; Match level="Score=68.9, E-value=1.4e- 17, Copies=1"; Pfam description=Importin-beta N-terminal domain
  misc_feature (379)..(379): Xaa can be any naturally occurring amino acid
MHQEAIQLIQVLEKTVSPDKNELEQASSFLEQAAVTNLLEFIKTLSDILRHGGNSPVARMAAGLQLKNQLTSKDSNIKTTYQQRWLAFPEDVRGYIKNNVVCALGTETSRPSSAAQCVAYVAVTELPQGQWPDLIATLVNNVCHANSTEMQKEATLEASGYICQEIDSDVLVSQPNDILTAIVHGMRASEPSNHVRLAATQALLNSLEFTKANFDQPTERNYIMEVVCEATQSPDSQIRVAALQCLVKIMSLYYQHMEPYMAPALFPITLEAMKSENDAVSLQGIEFWSNVSDEEVDLAIEDTEATEAGRPPTRCSRHYAKGALLYIVPILLQKLTKQEDVDDEDDWNPCNAAGACLMFLAPGWEDEIVPHVLPLFKEXNLSLINWRFRDAFLVASGIIFRGLE

SEQ ID NO: 20910 - protein, 273 aa, Diabrotica virgifera
  misc_feature: Coding regions on vcDNA: vcDNA=SeqID_607; Strand=+; Position=157-974
  misc_feature: Homolog annotation: Hit_ID=EAA11750.2; Match level="QueryCoverage =89%, HitCoverage=75%, E-value=9e-49, Identity=43%"; Hit description =ENSANGP00000013796 [Anopheles gambiae str. PEST] ref|XP_556977.1| ENSANGP00000013796 [Anopheles gambiae st
  misc_feature: Gene Ontology Annotation: Molecular function=ATP-binding cassette (ABC) transporter activity; Cellular component=mitochondrial membrane; Biological process=transport
  misc_feature (243)..(243): Xaa can be any naturally occurring amino acid
MWRLIQQNLHNKLLFHNSAIFKKYFCQGHIKNYISRTVSQKPVLKSFIPSKVATFGVTLTGGLIIKLYISHNGVLCEAKKTRMAGYENKSDKNVKFDWARLWKYLKPHIWYFLAAIVGALAVALLNIQIPQVIGGVVNVLAKFSESRDSELFLNEMKRPVIKLISMYLAQSVCTFFYIFMLSNLGERMAYKMRTDLFESILKQDIAFFDQQRTGEIINRLTADVQDFKSSFNQSFSGGLRASXAELSGCSVSLIMLSPQMTFISLLCIPSVIA

SEQ ID NO: 20911 - protein, 184 aa, Diabrotica virgifera
  misc_feature: Coding regions on vcDNA: vcDNA=SeqID_608; Strand=+; Position=300-992
  misc_feature: Homolog annotation: Hit_ID=XP_317270.1; Match level="QueryCoverage =90%, HitCoverage=37%, E-value=1e-40, Identity=51%"; Hit description =ENSANGP00000021800 [Anopheles gambiae]
  misc_feature (119)..(119): Xaa can be any naturally occurring amino acid
MSNKKAGVKTNAEPAVLPPRYQPPPMPTGQGILKNSPTEPAKKPPKTGENVKLPRLPEESGAQQIHLDLRVPQQRQPIRYDDEFLRPEMLKFVRKPDDPRFIDPNRQFQGILLELRSLXEANQHLADDNQELRDLCCFLDDDRQKGRKLARGWQRFGRYTASGMRQEVSAYQTKLRELDIKHRN

SEQ ID NO: 20912 - protein, 282 aa, Diabrotica virgifera
  misc_feature: Coding regions on vcDNA: vcDNA=SeqID_609; Strand=+; Position=53-900
  misc_feature: Homolog annotation: Hit_ID=NP_524118.1; Match level="QueryCoverage =91%, HitCoverage=64%, E-value=3e-70, Identity=50%"; Hit description =CG12232-PA [Drosophila melanogaster] gb|AAF49429.2| CG12232-PA [Drosophila melanogaster]
  misc_feature: Gene Ontology Annotation: Molecular function=ATP binding; Cellular component=plasma membrane; Biological process=visual behavior
  misc_feature: Pfam annotation: Pfam_ID=G-alpha; Match level="Score=221.9, E-value =1.2e-63, Copies=1"; Pfam description=G-protein alpha subunit
  misc_feature (268)..(268): Xaa can be any naturally occurring amino acid
MGCGSKVKEDRDHELYTKKFLQTVKLLLLGTGESGKTTIIKQMKILHINGYSNDERREKIPFIKQNIHESIFDIVSNMSRINPPVEAQSEESKASIEYILNLGPGCPSEFTEEYIHHVKTAWADAGVQKTFNRSNEYQLIDSAEHFLNQVDVVCKPDYIPTNQDILFCRIMTVSISKIEFDMPVPKQYGGGKAEFWMFDVGGQRGERKKWIKVFAGIQGILFLIAASDFDLMLREDTSVNRLEESFRLFQDIYSSEYVEKSAMIVFLXNQHLLQRKIEQGRK

SEQ ID NO: 20913 - protein, 80 aa, Diabrotica virgifera
  misc_feature: Coding regions on vcDNA: vcDNA=SeqID_610; Strand=+; Position=362-604
WIFILNLTFMIFVLFSLILCQKEMLIKFGKSFIAIDGTHGLNSYDFELMTVLVKDEFGNGFCTAFLFSNRKDTYFNLPIF

SEQ ID NO: 20914 - protein, 136 aa, Diabrotica virgifera
  misc_feature: Coding regions on vcDNA: vcDNA=SeqID_611; Strand=+; Position=16-426
NPKDNSVKPRRDRLRNTSIREQCKIQDFVRWGRQRKRMWYNYVRRMDDNRLPKIALENNPPCSRPPGRPPKRWRGSWQSTSQQSTSLPRKLTRGSFRIKQVERSPRSKRIIMHISRNILENAIRRTKNTMPSFQPS

SEQ ID NO: 20915 - protein, 108 aa, Diabrotica virgifera
  misc_feature: Coding regions on vcDNA: vcDNA=SeqID_612; Strand=+; Position=159-485
NLQDLHTTYHDMTYLTEVREDTNTTKQMLRVAEIKTLRTIVGKTRRDRVRTTNIREQCKIQDIVRWERQHKRMWYNHVRRMDENRIENNPPVSWQSTSQEINQRQLQN

SEQ ID NO: 20916 - protein, 80 aa, Diabrotica virgifera
  misc_feature: Coding regions on vcDNA: vcDNA=SeqID_613; Strand=+; Position=193-435
FKLSHSNRAFHRLSFVSSLRHKLYNPCIILIYTDYTTHDGGSKRITVDEKPYWCWIQPLSCFLTVGRCGRPKSERTHSKF

SEQ ID NO: 20917 - protein, 73 aa, Diabrotica virgifera
  misc_feature: Coding regions on vcDNA: vcDNA=SeqID_614; Strand=+; Position=623-844
AYYLCDISYWNSTVSQTVESEVLSISFSKKCFEHTALLTNLINTSCLPRRIFWKALKHYSCRFFYLHCFCYSN

SEQ ID NO: 20918 - protein, 87 aa, Diabrotica virgifera
  misc_feature: Coding regions on vcDNA: vcDNA=SeqID_615; Strand=+; Position=207-470
SDLCWVFIAITFTFNITFLHLTLLYELFEVYHNSNFLTMVLITLFHCGIFLRRYAMVLTFYWQPKVECVMFLLYTDMIVVIITSKKW

SEQ ID NO: 20919 - protein, 265 aa, Diabrotica virgifera
  misc_feature: Coding regions on vcDNA: vcDNA=SeqID_616; Strand=+; Position=37-831
  misc_feature: Homolog annotation: Hit_ID=CAA10770.1; Match level="QueryCoverage =86%, HitCoverage=69%, E-value=3e-29, Identity=31%"; Hit description =reverse transcriptase-like [Bos taurus]
  misc_feature (159)..(159): Xaa can be any naturally occurring amino acid
  misc_feature (171)..(171): Xaa can be any naturally occurring amino acid
  misc_feature (185)..(185): Xaa can be any naturally occurring amino acid
  misc_feature (190)..(190): Xaa can be any naturally occurring amino acid
  misc_feature (240)..(240): Xaa can be any naturally occurring amino acid
MRVLLTIIKHSTKYDMNKLMHVLESKMIDFRIISNLYYKQRAKVRVNDQLSEEIEISRGVRKGCVLSCCRKKALESETAGIKVNGVPINNIRYADDIVILAENIGDLQRLLTRIAKFGQEYDLTMNVKKTKFMRISKTQRKNEHLFINGSNIERVEQYXYLGTMINSTGDXYLQEIKIRIEKARXKILTXMRKVLCTRDLKLELRVRLIRCYVFLTLFYGMETWTLNTTSMKKLESFELXVYRRILKISWTKQKRKPTIIKSRAT

SEQ ID NO: 20920 - protein, 143 aa, Diabrotica virgifera
  misc_feature: Coding regions on vcDNA: vcDNA=SeqID_617; Strand=-; Position=114-545
  misc_feature: Homolog annotation: Hit_ID=XP_328828.1; Match level="QueryCoverage =50%, HitCoverage=87%, E-value=1e-27, Identity=84%"; Hit description =predicted protein [Neurospora crassa] gb|EAA34645.1| predicted protein [Neurospora crassa]
  misc_feature: Gene Ontology Annotation: Molecular function=molecular_function unknown; Cellular component=small nucleolar ribonucleoprotein complex; Biological process=snRNP protein-nucleus import
EKKKKNKKKKKKKKKKKKKKKKKKKKKKKKKKKKKKKKKKKKKKKKKKKKKKKKKKNKKEKKQGGGAPKKKKFLKGGGGKFFFFFYGPQKLFFRGRVLKKGGGGKKPGETPIYTFWKNPPFPRGGKKKKSPPRPPPPPPRGAP

SEQ ID NO: 20921 - protein, 132 aa, Diabrotica virgifera
  misc_feature: Coding regions on vcDNA: vcDNA=SeqID_618; Strand=+; Position=1144-1542
MRTDSKIRIYATCIRPIMTYGTEVCEDTNKTKYMLRFAEMKTLRTIVGKTRRDRVRNTSIREQCKIQDFVRWGRQRKRMWYNYVRRMDDNRLPKIALENNPPCSRPPGRPPKRWRGSWQSTSQEINQRQLQN

SEQ ID NO: 20922 - protein, 90 aa, Diabrotica virgifera
  misc_feature: Coding regions on vcDNA: vcDNA=SeqID_619; Strand=-; Position=881-1153
YIVYCHITDDITNLYNPTNKIGGLKDLRNSHIWEIMNSSSLVNLMCLVYTIRFYKHLPKKVYSEKKIIYHILCTKTITTIYNHNPSYCKV

SEQ ID NO: 20923 - protein, 297 aa, Diabrotica virgifera
  misc_feature: Coding regions on vcDNA: vcDNA=SeqID_620; Strand=+; Position=229-1122
  misc_feature: Homolog annotation: Hit_ID=NP_733324.1; Match level="QueryCoverage =93%, HitCoverage=90%, E-value=1e-67, Identity=45%"; Hit description =CG7816-PG, isoform G [Drosophila melanogaster] ref|NP_733323.1| CG7816-PF, isoform F [Drosophila
  misc_feature: Gene Ontology Annotation: Molecular function=molecular_function unknown; Cellular component=cellular_component unknown; Biological process=nurse cell/oocyte transport (sensu Insecta)
  misc_feature: Pfam annotation: Pfam_ID=Zip; Match level="Score=143.9, E-value=3.8e -40, Copies=1"; Pfam description=ZIP Zinc transporter
MSLLANAFICATDINSTNYDDSYQEIVKDLVPDWVCALEYVPWCWAIFGSLLVGLSGVLPLLVIPIDHSENLKQGDGANKLKTLLSFAVGGLLGDVFLHSLPEIWANDTVTKLGSGHISNSGLLILTGLIVFVAAEKVFSVIEQIEDNEKSTSQSVENNNTKGLSQPIEHKKSVSGYLNLVANTMDNFTHGLSLGGAFLVSLRLGLLTTFAILVHEIPHEVGDFAILLKSGFTRWHAGVFHLLTAGGGLIGAMAAILFSGAHTALEARSSWILPFTGNTFLHIALVTVLPEFLTVHS

SEQ ID NO: 20924 - protein, 269 aa, Diabrotica virgifera
  misc_feature: Coding regions on vcDNA: vcDNA=SeqID_621; Strand=+; Position=379-1188
  misc_feature: Homolog annotation: Hit_ID=EAL26786.1; Match level="QueryCoverage =90%, HitCoverage=78%, E-value=6e-69, Identity=52%"; Hit description =GA20606-PA [Drosophila pseudoobscura]
  misc_feature: Gene Ontology Annotation: Molecular function=molecular_function unknown; Cellular component=cellular_component unknown; Biological process=nurse cell/oocyte transport (sensu Insecta)
  misc_feature: Pfam annotation: Pfam_ID=Zip; Match level="Score=173.8, E-value=3.7e -49, Copies=1"; Pfam description=ZIP Zinc transporter
KFIIFWLSKIIQYRQSQRSKIDGANKLKTLLSFAVGGLLGDVFLHSLPEIWANDTVTKLGSGHISNSGLLILTGLIVFVAAEKVFSVIEQIEDNEKSTSQSVENNNTKGLSQPIEHKKSVSGYLNLVANTMDNFTHGLSLGGAFLVSLRLGLLTTFAILVHEIPHEVGDFAILLKSGFTRWHAGVFQLLTAGGGLIGAMAAILFSGAHTALEARSSWILPFTAGTFLHIALVTVLPDLLKEEDPKESFKQLLALILGITVMAFVTNAFE

SEQ ID NO: 20925 - protein, 697 aa, Diabrotica virgifera
  misc_feature: Coding regions on vcDNA: vcDNA=SeqID_622; Strand=+; Position=290-2383
  misc_feature: Homolog annotation: Hit_ID=XP_392932.1; Match level="QueryCoverage =78%, HitCoverage=95%, E-value=1e-141, Identity=48%"; Hit description= similar to Hypothetical protein MGC75603 [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=zf-C3HC4; Match level="Score=26.1, E-value =4.3e-05, Copies=1"; Pfam description=Zinc finger, C3HC4 type (RING finger)
MEKKGNRNLPLAKGSTTDSKKDGISSKPWPRGSRRRECAGSSLSSKPEVSRKPQPQRVKTFDKRPRPRGGGLCGTLARNETPSLEDTDDHQQVELGSVFLPGSKKQSLNHLLNFSYSPRDSFHRSERGQGNGNNVNRMMGTKKHKYNKEHFLQANCQFVVNDSGDYKQYLNNPDALVDWSLVEQVNIQVSEFPTCPICLYPPVAAKMTRCGHIYCWSCVLHYLSLSDKPSRKCPICFENIQKQDMKSVVAIPYTSFNTDETITFKLMKRPRGCLIAYPADAETKNENDIFNMSDQGSRDVYSKLLLAKTDDVLTIIEREFNELKEELKDDISPERCFIEQAMVLLKERESVVCGHVIKNDHSLEPSEENQLVDSLKEVEISADDQYKQITDEILEDCSSIQPAKFHYFYQASDNQHIYLHAINARMLEHSYGSLEFGPKTITGKILEKEGGSMTEELRKRLRYLQHLPVTCQFEVAEIQLKTPVVNKDTLEHFRDQIEIRRKRRQKRAKEEKRREKRIEVEENRKMGKYLHPNLHLDSNIQFPEFGFETRLRSESESTIPSERSASPDLAGTPTSVSLEGAYSGPSFAKMLATEKKSSPSWPGLKATSSTSKSPDLINVTGSKMKMLSTVRVPSDNEQDPDGYEPVPSFNRSFGDAIAKALEQAEKPEEESIQSSGKKKKKSKQKVLFATNMAYSGK

SEQ ID NO: 20926 - protein, 507 aa, Diabrotica virgifera
  misc_feature: Coding regions on vcDNA: vcDNA=SeqID_623; Strand=+; Position=73-1594
  misc_feature: Homolog annotation: Hit_ID=NP_651970.1; Match level="QueryCoverage =98%, HitCoverage=64%, E-value=0.0, Identity=68%"; Hit description =CG2173-PA [Drosophila melanogaster] gb|AAF59119.1| CG2173-PA [Drosophila melanogaster]
  misc_feature: Gene Ontology Annotation: Molecular function=nucleic acid binding; Cellular component=nucleolus; Biological process=ribosome biogenesis
  misc_feature: Pfam annotation: Pfam_ID=DEAD; Match level="Score=234.2, E-value=2.5e- 67, Copies=1"; Pfam description=DEAD/DEAH box helicase
  misc_feature (239)..(239): Xaa can be any naturally occurring amino acid
  misc_feature (258)..(258): Xaa can be any naturally occurring amino acid
MLQSVKKYDTIIRTIDDDEEVEDLSENSDEEIEFQPSKQKTRSKEDFDTEFNFVSSVEEYNKDVWNDLTKYVKRKAKQKTDDKIKKVRGTQADEDQTNTENGTNDLVDSDISLSEDELKHDRIKLKEKKKKKVKADNDTEAFFEEVELNSGETVSFYQMNLSRPLLKAIAEMKFVHPTPIQSATIPVALLGRDICGCAATGTGKTAAYMLPTLERLLYRPSDGTTVIRVLVLVPTRELXVQVYQVTKQICPFSDIQVXLAVGGLDLKTQENILRKNPDIVIATPGRLIDHLKSTPSFSLDSIEVLILDEADRMLDEYFAEQMNEIVKQCSRKRQTMLFSATMTEEVESLAAVSLTKPVRLFVDSNRDVAFNLRQEFVRIRSDKETDREPILAALVCRTFREHCMVFVQTKKQAHRLHIVLGLLGLKVAELHGNLTQPQRLENLERFKTKQVDVLIATDVAARGLDIVGVQTVINFVMPATTEHYIHRVGRTARAGRAGVSVSLAGEK

SEQ ID NO: 20927 - protein, 91 aa, Diabrotica virgifera
  misc_feature: Coding regions on vcDNA: vcDNA=SeqID_624; Strand=+; Position=473-748
VPYYTFVKLMLRRNPKFKFKIWNILTSIMIENVNILIQGSKVIFLILEPFAYWRKNSFYRTIYLNCSFCSFINLDLQTQVIIVASSPSARV

SEQ ID NO: 20928 - protein, 79 aa, Diabrotica virgifera
  misc_feature: Coding regions on vcDNA: vcDNA=SeqID_625; Strand=+; Position=986-1225
  misc_feature (38)..(38): Xaa can be any naturally occurring amino acid
VPYYTFVKLMLRRNPKFKFKIWNILTSIMIENVNILIXGSKVIFLILESFAYCRKNSFYRRTIYLNCSFINLDLQTQES

SEQ ID NO: 20929 - protein, 155 aa, Diabrotica virgifera
  misc_feature: Coding regions on vcDNA: vcDNA=SeqID_626; Strand=+; Position=43-510
ICLKMETKSNNPNKKKSKPVGRNAFIYTREQRLVMTVWYHERLFTGLTFDQLSQNFLVRFKTASPSYKSVILWEKQLFKHGSIPVTNSLKVKNKATLARLVHVPYVKESLIRFPDLTLSGRAHFLGLCTGTLSTILREDLKCDLDQQKKADTEKK

SEQ ID NO: 20930 - protein, 75 aa, Diabrotica virgifera
  misc_feature: Coding regions on vcDNA: vcDNA=SeqID_627; Strand=-; Position=216-443
SLTNDKLRRTTHPPITCLKRASQLIMEMNVVYLLVRKVCLIVMESNKTIFDDFILVFRLLDQSRYQINCSGSRAT

SEQ ID NO: 20931 - protein, 254 aa, Diabrotica virgifera
  misc_feature: Coding regions on vcDNA: vcDNA=SeqID_628; Strand=+; Position=77-841
  misc_feature: Homolog annotation: Hit_ID=XP_310479.1; Match level="QueryCoverage =84%, HitCoverage=73%, E-value=3e-88, Identity=72%"; Hit description =ENSANGP00000019230 [Anopheles gambiae]
  misc_feature: Gene Ontology Annotation: Molecular function=protein binding; Cellular component=cellular_component unknown; Biological process =biological_process unknown
  misc_feature: Pfam annotation: Pfam_ID=NifU; Match level="Score=112.7, E-value=9e -31, Copies=1"; Pfam description=NifU-like domain
MWRSSLLFSKIFNNPFPKGIIAQENISQSWLRNTIFTSSPLKMFIQTQETPNPNSLKFVPGVQVLDPGSTIDFPNGQAAYCSPLGKLLFRVEGVKSVFLGPDFITITKSEDDEVSWKLLKPEIFATIMDFFASGLPVLNEASPNQDTQINEDDDETVQMIKELLDTRIRPTVQEDGGDIIFVAYEDGIVKLKMQGACSSCPSSVVTLKNGVQNMMQFYIPEVIGVEQVLDEADKVAESEFKKIDEKISAKEDSK

SEQ ID NO: 20932 - protein, 157 aa, Diabrotica virgifera
  misc_feature: Coding regions on vcDNA: vcDNA=SeqID_629; Strand=-; Position=513-986
MLGCKGKLSQPFKYETGIRQRDSLIPLIFNLIMMDEIIKNGRKRRGYKMGEKEIKIICYADDAIITTENEDDLQRLIKEFEDTAFIYNMVISTEKTKSIVISTELRHCKLVVNNKIIEQVMETEYLGIKLSTWRTEMSQQHNLEKQISHNGNENQDI

SEQ ID NO: 20933 - protein, 286 aa, Diabrotica virgifera
  misc_feature: Coding regions on vcDNA: vcDNA=SeqID_630; Strand=+; Position=45-905
  misc_feature: Homolog annotation: Hit_ID=EAL32141.1; Match level="QueryCoverage =89%, HitCoverage=86%, E-value=6e-92, Identity=61%"; Hit description =GA15370-PA [Drosophila pseudoobscura]
  misc_feature: Gene Ontology Annotation: Molecular function=ubiquinone biosynthesis methyltransferase activity; Cellular component=mitochondrial inner membrane; Biological process=electron transport
  misc_feature: Pfam annotation: Pfam_ID=Ubie_methyltran; Match level="Score=336.0, E- value=5.5e-98, Copies=1"; Pfam description=ubiE/COQ5 methyltransferase family
MSGSLKQLKRIIGRNLSVKYNFLPSVRLLTSQTTNDGETHFGFEKVKEQEKEKKVFEVFENVAVDYDIMNDTMSLGIHRLWKDYFMCSLSPTNNTKLLDVAGGTGDITFRFLDFVKNQNLQNCHATVCDINPHMLEVGKLRSSRYNYNANMVSWKEGNAEKLDFEDNSFNVYTIAFGIRNVTHIDRVLSEAYRVLQPGGRFMCLEFSHLENSTLQWLYDHYSFQLIPVLGQLIAGKWQPYKYLVESIRQFPTQENFKLMIEEAGFRQVTYENLTMGMVAMHSGFQL

SEQ ID NO: 20934 - protein, 320 aa, Diabrotica virgifera
  misc_feature: Coding regions on vcDNA: vcDNA=SeqID_631; Strand=+; Position=152-1112
  misc_feature: Homolog annotation: Hit_ID=EAL28259.1; Match level="QueryCoverage =80%, HitCoverage=18%, E-value=2e-74, Identity=52%"; Hit description =GA19130-PA [Drosophila pseudoobscura]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_membrane; Match level="Score=89.3, E -value=1e-23, Copies=1"; Pfam description=ABC transporter transmembrane region
  misc_feature (289)..(289): Xaa can be any naturally occurring amino acid
MLKSVAFTNTNPQEIITTADPSVSASKLSSNMSSLELENFKSEGYYIWVYSALIIAVVILQIWRCFLYYQVCMSSSKALHNKMFHNILQAPMRFFDTNPSGRILNRFSKDMGAVDELLPSCQIDAIQILMVFVGILVMVVIVNPWMILTTIIIGPVLFILRKMYLKTAQSVKRLEGISKAPVFSHISASLFGITTIRASNAEKMVTTEFDILQDQHSSTWFLFLVSGRVFGFYLDVICCIFLAIVTIQFLLFRDENTLSGNVGLAISHSYILTGMVQMGIRQSRGSSQXMISVERILQYTKLEKGWLYLNHCLLKKLPET

SEQ ID NO: 20935 - protein, 418 aa, Diabrotica virgifera
  misc_feature: Coding regions on vcDNA: vcDNA=SeqID_632; Strand=+; Position=5-1258
  misc_feature: Homolog annotation: Hit_ID=XP_397113.1; Match level="QueryCoverage =71%, HitCoverage=51%, E-value=7e-96, Identity=53%"; Hit description =similar to CG7985-PA [Apis mellifera]
  misc_feature: Pfam annotation: Pfam_ID=Glyco_hydro_20; Match level="Score=-65.2, E -value=1.9e-07, Copies=1"; Pfam description=Glycosyl hydrolase family 20, catalyt
MRKTRPQLRSVKTKYANPYIVFFIFVLVICIFYFSLKSSKSLKNEVDEVQSNEEIKEPYFKREKPISFKGHKVVHLDLKGAPPKIDFYKDLFPLLAKFGATGVLIEYEDMFPYKDNLINISATNAYTLQNIREINRLAKEHNLTVIPLIQTFGHLEFVLKLKDYEMLREISEYPQVICPTHQKTEQLLETMVQQMLAAHPDSQFIHIGADEVYYLGICERCTDTMIKHNLSKNLLFIAHIKNVISIVKRFNPHITVLMWDDEFRSFSDADLANSNLHNNVEPVIWKYTKDVYDELGPTLWDSYQKVFKNVWIASAFKGATGSNEIVPYATHYLQNHRSWMPVVAEYSNQVNFKGIIITGWQRNDHFCWALRKNYLPPYPPWTWNTTNLTRLSDASPSNSPQNETPYRPCKRGQHLSPS

SEQ ID NO: 20936 - protein, 251 aa, Diabrotica virgifera
  misc_feature: Coding regions on vcDNA: vcDNA=SeqID_633; Strand=+; Position=114-869
  misc_feature: Homolog annotation: Hit_ID=AAN39695.1; Match level="QueryCoverage =99%, HitCoverage=98%, E-value=1e-74, Identity=56%"; Hit description =ATP synthase-like protein [Choristoneura parallela]
  misc_feature: Gene Ontology Annotation: Biological process=embryogenesis and morphogenesis
  misc_feature: Pfam annotation: Pfam_ID=Mt_ATP-synt_B; Match level="Score=292.2, E -value=8.1e-85, Copies=1"; Pfam description=Mitochondrial ATP synthase B chain pr
MLSRAAILSGQASKSLVANCLRATSTSTANTQVAKTDERPGEVAFARPARQEPGKVRMGFIPDEWFQFFYKKTGVTGPYTFAVTLSTYLVSKEIYVLEHEYYSGLSLLIMWVYGIKTLGPKLAAYLDKEIEEYENAWNESRVNQKQSLTDQISDEEKAQKSMEGQTLLVEAKRENVALQLEASYRERLISAYSEVKKRLDYQVEKQNIERRITQKNLVDYVVAKVRSSITADQEKQNINKCISDLAGLAKA

SEQ ID NO: 20937 - protein, 282 aa, Diabrotica virgifera
  misc_feature: Coding regions on vcDNA: vcDNA=SeqID_634; Strand=+; Position=79-927
  misc_feature: Homolog annotation: Hit_ID=XP_318582.1; Match level="QueryCoverage =98%, HitCoverage=81%, E-value=1e-58, Identity=47%"; Hit description =ENSANGP00000020915 [Anopheles gambiae]
  misc_feature: Gene Ontology Annotation: Molecular function=single-stranded DNA binding; Cellular component=nucleolus; Biological process=ribosomal small subunit assembly and maintenance
  misc_feature: Pfam annotation: Pfam_ID=RRM_1; Match level="Score=55.3, E-value=1.8e- 13, Copies=1"; Pfam description=RNA recognition motif. (a.k.a. RRM, R
KYKLFLRFKMAKPGTDSESDKEKKKERGREKKKRSASGSSSSSKSSSSDSSSSSSRSSSSSSSASSSRSSSSSSDSSSSSSDNNRTRSRKRSGSTAKPAAKGRDVKDKEKDKDKDKKETKDKDKEKERVDSKKDEKEKKGLTPTKERDKDKERDRNHIRNRSRSRSPRKQRRRRSPTPRPTKIHIGRLTRTVNKEHIMEIFGTYGSIKHVEFPKDHNHQHLGRLYCYVEYTTADEAENAMKHMDGGQIDGQEITAAPVLIPNPRLCLQGDHLLPPIKRGPNT

SEQ ID NO: 20938 - protein, 250 aa, Diabrotica virgifera
  misc_feature: Coding regions on vcDNA: vcDNA=SeqID_635; Strand=+; Position=119-870
  misc_feature: Homolog annotation: Hit_ID=EAL30915.1; Match level="QueryCoverage =96%, HitCoverage=95%, E-value=1e-75, Identity=55%"; Hit description =GA10496-PA [Drosophila pseudoobscura]
  misc_feature: Gene Ontology Annotation: Molecular function=phosphomannomutase activity; Cellular component=cytosol; Biological process=protein-ER targeting
  misc_feature: Pfam annotation: Pfam_ID=PMM; Match level="Score=433.0, E-value=3.4e -127, Copies=1"; Pfam description=Eukaryotic phosphomannomutase
  misc_feature (178)..(178): Xaa can be any naturally occurring amino acid
  misc_feature (214)..(214): Xaa can be any naturally occurring amino acid
  misc_feature (229)..(229): Xaa can be any naturally occurring amino acid
  misc_feature (234)..(234): Xaa can be any naturally occurring amino acid
MDQKNILCLFDVDGTLTKPVNVIEPEIYSFLLDKVKACCTVGLVGGSDFKKIAFQMNGDDVIHKVHYVFSENGLVQYKHGKEIGRQSIQNFLGEDKIQKFINFVLQYLSTITLPVKRGTFVEFRTGMLNISPIGRNCSQQERDAFEIYDNEHQVRKTMIEQLKKEFPDFGLTYSIGGXISFDVFPNGWDKTYCLQLLEREGFDEIHFFGDKTHXGRYDYEIYSDKRVIXHKVTXSLDTKRQLRYSINVII

SEQ ID NO: 20939 - protein, 271 aa, Diabrotica virgifera
  misc_feature: Coding regions on vcDNA: vcDNA=SeqID_636; Strand=+; Position=185-1000
  misc_feature: Homolog annotation: Hit_ID=NP_724589.1; Match level="QueryCoverage =92%, HitCoverage=84%, E-value=2e-44, Identity=41%"; Hit description =CG30495-PA [Drosophila melanogaster] gb|AAM71103.1| CG30495-PA [Drosophila melanogaster]
  misc_feature: Gene Ontology Annotation: Molecular function=electron transporter activity; Cellular component=nucleus; Biological process=induction of apoptosis
  misc_feature: Pfam annotation: Pfam_ID=adh_short; Match level="Score=48.5, E-value =1.9e-11, Copies=1"; Pfam description=short chain dehydrogenase
IIIGATLVLACRNINKGLEAKKYILKYSNSKNIKIFVKELDLCKISSIVKFAETLKTEFTEIYALVNNAGVFYHPQDLTEDGFEITLQTNYLGPFILTHHLLDLLKRSVHARIVNISSEAHRLVNVYDLNAVTKCQTEFRDNFIAYGVSKLAINLFTKELSQKLLSTNVIINAANPGNVETSIFRNFPPLSNPWLYALQWPIRILVIKNPKQGAQTPLHLLLTSNRTTGQYFSDCKLALPSPIAASDKAAHDYYALTLEILADKFNTESEW

SEQ ID NO: 20940 - protein, 127 aa, Diabrotica virgifera
  misc_feature: Coding regions on vcDNA: vcDNA=SeqID_637; Strand=-; Position=1057-1440
KKKGGGGAIIKKNKKKKKITKKKFFFFFFFFPPTPKKKKKKKKKNLFFLFKIFFFFWSRNPPPKGKITQKKLNFWPFVKARRDFSIGGKELGQMTLWRIILFVRHMLDPKKGGGGEELHWGPYLSMS

SEQ ID NO: 20941 - protein, 312 aa, Diabrotica virgifera
  misc_feature: Coding regions on vcDNA: vcDNA=SeqID_638; Strand=+; Position=1-936
  misc_feature: Homolog annotation: Hit_ID=XP_309874.1; Match level="QueryCoverage =99%, HitCoverage=44%, E-value=1e-123, Identity=66%"; Hit description= ENSANGP00000018264 [Anopheles gambiae]
  misc_feature: Gene Ontology Annotation: Molecular function=transcription factor activity; Biological process=digestion
  misc_feature: Pfam annotation: Pfam_ID=Peptidase_C2; Match level="Score=-183.4, E -value=0.0095, Copies=1"; Pfam description=Calpain family cysteine protease
LLEKAYMKVMGGYDFPGSNSNIDLHALTGWIPERAAIKNCPDFNKDAVFQKIESRMAKGDVLVTVATGELSDAQAERTGLVATHAYAVMDVQTVDGVRLFKLKNPWSHLRWRGNYSELDTRRWTPELQRRLNFDPNSAAQFDNGVFWIDYDSLCNFFDVFYMNWNPELFKHTTCIHQSWNAGTGPVKDLYTISANPQFSLDVQGDSPGAVWLLLSRHITDIEDFRDNKEYITLFVYQGGRKIYYPFDPPPYIDGVKINSPHYLCKILLSPWSSRKFYSCCFPYEKSTTIYYTLRAYATLPFTLTKIVDPYKY

SEQ ID NO: 20942 - protein, 302 aa, Diabrotica virgifera
  misc_feature: Coding regions on vcDNA: vcDNA=SeqID_639; Strand=+; Position=2-910
  misc_feature: Homolog annotation: Hit_ID=NP_728482.1; Match level="QueryCoverage =96%, HitCoverage=92%, E-value=2e-75, Identity=45%"; Hit description =CG6851-PC, isoform C [Drosophila melanogaster] ref|NP_728481.1| CG6851-PB, isoform B [Drosophila
  misc_feature: Pfam annotation: Pfam_ID=Mito_carr; Match level="Score=23.1, E-value =4.8e-05, Copies=1"; Pfam description=Mitochondrial carrier protein
  misc_feature (291)..(291): Xaa can be any naturally occurring amino acid
DDLRWSNYGLRILINTVSHPFEYAKVLIQIGYEPIPPRPGKTFFGKPALKLPNIFEYVKYIKSVDGFVGCYNGLAPKVCGNIMSAIATQKLLDYLEPPSEEEEFGEEPTEDEKRKIFVKGVKNEIIIHTAAIVVSQPFHVITVRMMAQFIGRESKYMGILSSLREVYRENGLVGFFSGLVPRLVGDIISLLLVSSLTYAINNYVIEEKELGIYTGSIMSFLATSVTYPFQVISNCMAVTNSGLVAGSPTYMPHYKSWIDCWVDLSNRNQLKRGSSILVRYYTGPSIVIGGXAVPLSSTTVIS

SEQ ID NO: 20943 - protein, 264 aa, Diabrotica virgifera
  misc_feature: Coding regions on vcDNA: vcDNA=SeqID_640; Strand=+; Position=53-847
  misc_feature: Homolog annotation: Hit_ID=XP_392467.1; Match level="QueryCoverage =96%, HitCoverage=36%, E-value=1e-65, Identity=50%"; Hit description =similar to ENSANGP00000012259 [Apis mellifera]
  misc_feature: Gene Ontology Annotation: Molecular function=protein binding; Cellular component=cellular_component unknown; Biological process =protein folding
  misc_feature: Pfam annotation: Pfam_ID=TPR_1; Match level="Score=65.3, E-value=1.7e- 16, Copies=3"; Pfam description=Tetratricopeptide repeat
MTEKESVSIPTNEDIVSEITNDLQTELNVTEPNSEEILNSHHNEGIPKDFDKEESDTDTTTKDPDDYIDEEQLKVLENDLSDEEKAERHQTALELKNKGNEQFKSGLHVESVCSYTEALRMCSLKFENDRSIFYANRAASKIALNRKESAIEDCTKAIELNDSYIRAYLRRAKLYEETEKLDESLADYKKVLELDKNNKDALQAQYRLPPLIAERNEKLKTEMLGKLKDLGNMILKPFGLSTENFQLNQDPNSGGYSVNFSQNK

SEQ ID NO: 20944 - protein, 227 aa, Diabrotica virgifera
  misc_feature: Coding regions on vcDNA: vcDNA=SeqID_641; Strand=+; Position=33-716
MKSIVAAILLVATIVSAEPPRQFLRQKAAEAPYEPSGWKPNGPLLQYPVRSNVQAYGAPEPQTIYGPPEPQSSYGPPTNDTELEPTTTETFEETTTLEPQAENIKTSPSSGKLQAKKSEKSTAPQPNQFFFIVNPAQSERLVLAPLRVTPVNAKPVAPIRAPARVAAPARLEEFPQVVEVDQTVPVQVEQAVPVQYAQVQAVPFLPGYVSQSSIVTPYSSSFVQIYQ

SEQ ID NO: 20945 - protein, 286 aa, Diabrotica virgifera
  misc_feature: Coding regions on vcDNA: vcDNA=SeqID_642; Strand=+; Position=101-961
  misc_feature: Homolog annotation: Hit_ID=XP_309823.1; Match level="QueryCoverage =93%, HitCoverage=91%, E-value=5e-66, Identity=48%"; Hit description =ENSANGP00000018239 [Anopheles gambiae]
MVRKPRKSFWRVTRKTLKHLGILGFSKNENILGINPIIVSTTYILLTLFLASVLRKIVKLIYGDSEKFSKRLLLEFIATLELCACCYELIIIADNWGISAYAFYLFLLTVWWGSNWGSASACPYSPIEEVIEGNQDIKTAFWLIGAQLAGALLTFRDVQVLWSLELVETHLDKAYEDCTTDLQVDTGLGTIIEAGATCLCRIVSRILSESDAKLCNYFDAFFGTMMVVAAFNFSGGYFNPALATSLKLGCDGNTFVGHVIVYWVVAIITGAILFNFPFKTTGSSKK

SEQ ID NO: 20946 - protein, 63 aa, Diabrotica virgifera
  misc_feature: Coding regions on vcDNA: vcDNA=SeqID_643; Strand=-; Position=664-855
KYKLVYMQDITKYNKFIGNRNKSTPWYNKNKHNGNGLLMPYFFICQNFHKLLIFLIFFILNTG

SEQ ID NO: 20947 - protein, 202 aa, Diabrotica virgifera
  misc_feature: Coding regions on vcDNA: vcDNA=SeqID_644; Strand=+; Position=154-762
  misc_feature: Homolog annotation: Hit_ID=NP_732610.1; Match level="QueryCoverage =100%, HitCoverage=98%, E-value=1e-104, Identity=91%"; Hit description=CG3320-PA, isoform A [Drosophila melanogaster] gb|AAF55873.1| CG3320-PA, isoform A [Drosophila
  misc_feature: Gene Ontology Annotation: Molecular function=RAB small monomeric GTPase activity; Cellular component=endoplasmic reticulum; Biological process=signal transduction
  misc_feature: Pfam annotation: Pfam_ID=Ras; Match level="Score=356.9, E-value=2.7e -104, Copies=1"; Pfam description=Ras family
MNPEYDYLFKLLLIGDSGVGKSCLLLRFADDTYTESYISTIGVDFKIRTIDLDGKTIKLQIWDTAGQERFRTITSSYYRGAHGIIVVYDCTDQDSFNNVKQWLEEIDRYACDNVNKLLVGNKSDLTTKKVVDFTTAKEYADQLGIPFLETSAKNATNVEQAFMTMAAEIKNRVGPPSSAVDQGNKVRFDQSRPVETTKSGCC

SEQ ID NO: 20948 - protein, 68 aa, Diabrotica virgifera
  misc_feature: Coding regions on vcDNA: vcDNA=SeqID_645; Strand=-; Position=1065-1271
LISRDNSHYSGQPKRRPDWSRRRIIIMFKFSVVNSLSFCLILFMIIVIILWSISVYKSLDSCCELYIS

SEQ ID NO: 20949 - protein, 251 aa, Diabrotica virgifera
  misc_feature: Coding regions on vcDNA: vcDNA=SeqID_646; Strand=+; Position=3-758
  misc_feature: Homolog annotation: Hit_ID=AAN15432.1; Match level="QueryCoverage =56%, HitCoverage=84%, E-value=3e-20, Identity=45%"; Hit description =unknown protein [Arabidopsis thaliana] gb|AAM96994.1| unknown protein [Arabidopsis thaliana]
  misc_feature: Gene Ontology Annotation: Molecular function=molecular_function unknown; Cellular component=nucleus; Biological process=negative regulation of cell growth
LLLRRMKTLVLFIFVGISAAYAEPKKTKRGVFGEHNSVGGIPPPQYGPPGGGAHAHGPGIGGPSGPGFGGPSGSGFGGPSGPGFGGNGGPGFGGHGGPGFGGHGGPGFGGHGDPGFGGTNDPNFGGHAGPGFGGHGGQGFGDPGNLGSRGPLRGPQVGPPQPLGTSVDLGKQVLKQIKVIHRVGHHYAIPIGVKYDRAVPVKIPKHVNVPTPLDIPVPVPVQVKVPVFKDIPIPVETRLTRAVESTPHYPF

SEQ ID NO: 20950 - protein, 297 aa, Diabrotica virgifera
  misc_feature: Coding regions on vcDNA: vcDNA=SeqID_647; Strand=+; Position=45-933
  misc_feature: Homolog annotation: Hit_ID=XP_393632.1; Match level="QueryCoverage =99%, HitCoverage=61%, E-value=1e-69, Identity=48%"; Hit description =similar to Pgcp protein [Apis mellifera]
  misc_feature: Pfam annotation: Pfam_ID=PA; Match level="Score=10.4, E-value=0.026, Copies=1"; Pfam description=PA domain
  misc_feature (227)..(227): Xaa can be any naturally occurring amino acid
  misc_feature (278)..(278): Xaa can be any naturally occurring amino acid
MLVRSILVFFVVIVASKCDNVNNKVEDECHLPEKLVKEIQSYKPTVHRIIDAVTKGRHKGKVYNHLSDFIDTFGARVSGTKNLENSIDYVQDLLVQAGLENIHGENVTVPHWVRGTEIAEVLEPRRSKIGVLGLGQTANTPPEGITAEVLVVRSFEELNKPDISAAAKGKIVVINFQFERYGRSVKYRSQGPVEAAKHGALAVLIKSVTPFSMYTLHTGYLQVQERXVKKIPALSITVEDANMLQRYQDKGKRIVIKLQVDSQHLPDETSRNLVAEIXGSEKEQKVVIVSGHLDSWD

SEQ ID NO: 20951 - protein, 281 aa, Diabrotica virgifera
  misc_feature: Coding regions on vcDNA: vcDNA=SeqID_648; Strand=+; Position=109-951
  misc_feature: Homolog annotation: Hit_ID=EAA03441.3; Match level="QueryCoverage =99%, HitCoverage=66%, E-value=1e-120, Identity=76%"; Hit description= ENSANGP00000016314 [Anopheles gambiae str. PEST] ref|XP_560566.1| ENSANGP00000016314 [Anopheles gambiae s
  misc_feature: Gene Ontology Annotation: Cellular component=mitochondrion
  misc_feature: Pfam annotation: Pfam_ID=adh_short; Match level="Score=105.3, E-value= 1.5e-28, Copies=1"; Pfam description=short chain dehydrogenase
MINSGKLAGLTIFVTGGSRGIGKAIALKAAKDGANVVVAAKTAEPHPKLPGTIYTACEEIEKAGGKSLACVVDVRDENTVRKAVQDTVSKFGGIDILINNASAISLTGTADTDMKRYDLMHNINTRGTFLVTKECLPYLKKSNHAHVLNISPPLNMSPHWFKGHVAYTMAKYGMSMCVLGQHEEFRPYNIAVNALWPRTAIDTAAMQMLSGKEASAQYSRKPEIMADSAYAILVKDPKSFTGNFCIDDEVLKQSGATDTDIRNYACIPENADNLMEDFFFL

SEQ ID NO: 20952 - protein, 537 aa, Diabrotica virgifera
  misc_feature: Coding regions on vcDNA: vcDNA=SeqID_649; Strand=+; Position=140-1750
  misc_feature: Homolog annotation: Hit_ID=CAA77038.1; Match level="QueryCoverage =99%, HitCoverage=42%, E-value=0.0, Identity=60%"; Hit description =maleless protein [Sciara ocellaris]
  misc_feature: Gene Ontology Annotation: Molecular function=chromatin binding; Cellular component=dosage compensation complex (sensu Drosophila); Biological process=dosage compensation, by hyperactivation of X chromosome
  misc_feature: Pfam annotation: Pfam_ID=dsrm; Match level="Score=115.0, E-value=1.9e- 31, Copies=2"; Pfam description=Double-stranded RNA binding motif
  misc_feature (510)..(510): Xaa can be any naturally occurring amino acid
MSDLKSFLNQWCQKNKKEPAYEVRPTGPKHRQRFLCELRIDGYNYVGAGNSTNKKDAQSNASKDFISFLVRQGMINKNEVPADIDAAPTPAIHHGQQEMTGGGPQHQVFEKGMGPANFGEAYRPRGREDGEWHYMDRAQEQKRMEEAEDLDVNAQIHGNWTVENAKSKLHQFMQANKINTDYKYTQVGPDHSRTFVAELSFYVKQLGRTIHGRDTGSNKQTASKSCALSVVRQLFHLKVIEAFSGTLKKEKKSATEMPPFQVRLSPKLKDQISDCLRSLNVTPTPVTSNQVDDKGEPVPVSLLSSHVLDDFHPAKPTAAGVVPWSPPQPNWNCWTGCNIDEGYLASATLDDLSEQMLTDWKHRTANDSSLITSMQDRMILPVYTKKSEIMEAINEHPVIIIRGNTGCGKTTQVCQFILEDYVMSGQGAWANICVTQPRRISAVSVSERVAAERCEELGQSIGYSVRFESALPKPYGSVMFCTVGVLLKKVENGLRGVSHVIVDEIHERDXHSDFIYGVLRDMIHTYPDLRVILCLLH

SEQ ID NO: 20953 - protein, 174 aa, Diabrotica virgifera
  misc_feature: Coding regions on vcDNA: vcDNA=SeqID_650; Strand=+; Position=80-604
  misc_feature: Homolog annotation: Hit_ID=XP_394187.1; Match level="QueryCoverage =74%, HitCoverage=92%, E-value=5e-36, Identity=59%"; Hit description =similar to CG7911-PA [Apis mellifera]
  misc_feature: Pfam annotation: Pfam_ID=Nucleoplasmin; Match level="Score=97.5, E -value=3.3e-26, Copies=1"; Pfam description=Nucleoplasmin
MVVSLHFAALTLKGKNSEIWDPEAKGAEDYQGGHKLIIKQALLGPEAQEGEVNVVQVEAMTWKDSVKIPIATLKAGGPNNQVLLDLSFPDPPVTFSLIQGNGPVHIVGHHLIGSPMEEFDEMDELEEEMLDDEEGEEGAEEDEDEDEPKAKKAKSATNAKGKTPVKNNSKAAKK

SEQ ID NO: 20954 - protein, 173 aa, Diabrotica virgifera
  misc_feature: Coding regions on vcDNA: vcDNA=SeqID_651; Strand=+; Position=102-623
  misc_feature: Homolog annotation: Hit_ID=XP_394187.1; Match level="QueryCoverage =75%, HitCoverage=92%, E-value=4e-36, Identity=59%"; Hit description =similar to CG7911-PA [Apis mellifera]
  misc_feature: Pfam annotation: Pfam_ID=Nucleoplasmin; Match level="Score=115.0, E -value=1.8e-31, Copies=1"; Pfam description=Nucleoplasmin
MADEYFFALTLKGKNSEIWDPEAKGAEDYQGGHKLIIKQALLGPEAQEGEVNVVQVEAMTWKDSVKIPIATLKAGGPNNQVLLDLSFPDPPVTFSLIQGNGPVHIVGHHLIGSPMEEFDEMDELEEEMLDDEEGEEGAEEDEDEDEPKAKKAKSATNAKGKTPVKNNSKAAKK

SEQ ID NO: 20955 - protein, 237 aa, Diabrotica virgifera
  misc_feature: Coding regions on vcDNA: vcDNA=SeqID_652; Strand=+; Position=174-887
  misc_feature: Homolog annotation: Hit_ID=CAF99699.1; Match level="QueryCoverage =95%, HitCoverage=23%, E-value=6e-21, Identity=28%"; Hit description =unnamed protein product [Tetraodon nigroviridis]
  misc_feature: Gene Ontology Annotation: Molecular function=G-protein coupled receptor activity; Cellular component=integral to membrane; Biological process=G-protein coupled receptor protein signaling pathway
  misc_feature: Pfam annotation: Pfam_ID=LRR_1; Match level="Score=60.5, E-value=4.9e- 15, Copies=8"; Pfam description=Leucine Rich Repeat
YKQDHYSIIDVKKGNITDLCDGIIKNFPVLETLYLINVNLSRIQPNAFQAVPRLRELSLAVNHIEDLVDGSFNNLEALETLYLSGNKIKYIDGETFQNMKSLKHLHLDRNLITKLSPNCLRGSSLLRVLDLRHNSMEIVDGNTFPVMEPIFTDPVTIYLENNYIKDVDPSVFTFKNPVNLHLERNNLNTASTLFYGMREYSVLYLNKNQFNCLPDDVLENVKKTTKTIYLLDNPISM

SEQ ID NO: 20956 - protein, 213 aa, Diabrotica virgifera
  misc_feature: Coding regions on vcDNA: vcDNA=SeqID_653; Strand=+; Position=218-859
  misc_feature: Pfam annotation: Pfam_ID=Tetraspannin; Match level="Score=-39.0, E -value=0.0031, Copies=1"; Pfam description=Tetraspanin family
  misc_feature (206)..(206): Xaa can be any naturally occurring amino acid
TPYEVPEKKKTKDMMQPSTSTESWDFPWQNKMRKKIPKIVSPRERGRHPGEVCFLMCFLRLLMLTSSLVLIGISVWSIVIKVKHYRYLFDIRVDIPYFSLPAGILLLPGVWLASYIHSNRKRRLYILLLLGVITLTSILVILGSTIGFLYSIEDANGEWHVTNSFDLPDLNKSVSHSFYQFNSSKNHQKAWNNMQQRLECCGISAXMIGRLWG

SEQ ID NO: 20957 - protein, 108 aa, Diabrotica virgifera
  misc_feature: Coding regions on vcDNA: vcDNA=SeqID_654; Strand=-; Position=849-1175
HFIMRYRRYRSRLRVESNCRIFKKVFLACSILHLEKIHFGNSLHHCKISGFKRSSKVCIPIGHCIRRTSVTVLADAGGSVRTLKQHGEWQSTSNAEGYIEHSICIFKK

SEQ ID NO: 20958 - protein, 194 aa, Diabrotica virgifera
  misc_feature: Coding regions on vcDNA: vcDNA=SeqID_655; Strand=+; Position=47-631
  misc_feature: Homolog annotation: Hit_ID=EAL28311.1; Match level="QueryCoverage =98%, HitCoverage=77%, E-value=2e-72, Identity=68%"; Hit description =GA19345-PA [Drosophila pseudoobscura]
  misc_feature: Gene Ontology Annotation: Molecular function=ATP binding; Cellular component=nucleus; Biological process=pyrimidine ribonucleotide biosynthesis
  misc_feature: Pfam annotation: Pfam_ID=ADK; Match level="Score=197.1, E-value=3.6e -56, Copies=1"; Pfam description=Adenylate kinase
MKPKVVFVLGGPGAGKGTQSQKIVETFGYTHLSAGDLLREERNNPGSQYGELIENYIKEGKIVPVEITCSLLEKAMEKSGKEKFLIDGFPRNKDNLDGWNRQVADKVNLEFVLFFDCPLEICLNRCLERGASGSGRSDDNEESLKKRVNVYLNESKPIIDHYDEFNLVKKIDATQNEDKVFDEVKKLFRDSGDH

SEQ ID NO: 20959 - protein, 652 aa, Diabrotica virgifera
  misc_feature: Coding regions on vcDNA: vcDNA=SeqID_656; Strand=-; Position=44-2002
  misc_feature: Homolog annotation: Hit_ID=EAA05399.2; Match level="QueryCoverage =96%, HitCoverage=89%, E-value=0.0, Identity=75%"; Hit description =ENSANGP00000003866 [Anopheles gambiae str. PEST] ref|XP_559992.1| ENSANGP00000003866 [Anopheles gambiae str.
  misc_feature: Gene Ontology Annotation: Molecular function=RNA binding; Cellular component=mitochondrion; Biological process=growth
  misc_feature: Pfam annotation: Pfam_ID=Helicase_C; Match level="Score=68.5, E-value= 1.9e-17, Copies=1"; Pfam description=Helicase conserved C-terminal domain
YLQHQAYVSFRIYCLEAQNLPADIHVVFSDILQGAGNITDIFPYFLRHAKMMFPHLDCMDDLRKISDLRSPANWYPEARAINRKIIFHSGPTNSGKTYHALERFMTSKSGVYCGPLKLLASEVFNKSNNRGTPCDLVTGEERNFADPAGNASNHVSCTVEMTSVTNAYEVAVIDEIQMIKDVQRGWAWTRALLGLKAEEIHLCGEAGAVDLVRQICLTTGEDLEVRNYKRLTPLKIENAAVGSLENVLPGDCIVCFSKNDIYSVSRGIEATGKEVAVIYGGLPPGTKLAQAAKFNDPENSCKILVATDAIGMGLNLSIKRVIFYSLIKATMNEKGEREMDTISVSSALQIAGRAGRYGTQWPEGSATTFKSEDLPTLQNLLASQPDPIIQAGLHPTAEQIELYAYHLPNSTLSNLMDIFINLSTVDDSLYFMCPTEDFKFLADMIQHVPLPLRARYLFCCAPINKKMPFVCTMFLKFARQYSKNEMITFDWLCRNIGWPLQPPRTILDLVHLEAVFDVLDLYLWLSYRFVDLFNEPNLVRDMQRELDQIIQQGIVQLTRLLRNSETGISSGTGAADDEEFAMSRQKQTYLRGQKSLTLGKGKLTERLLAQGILTPTMLQELKKEWNKGSVTNIVKEEVEEPKKTRRKRTTKK

SEQ ID NO: 20960 - protein, 405 aa, Diabrotica virgifera
  misc_feature: Coding regions on vcDNA: vcDNA=SeqID_657; Strand=+; Position=96-1315
  misc_feature: Homolog annotation: Hit_ID=XP_312543.1; Match level="QueryCoverage =85%, HitCoverage=83%, E-value=2e-99, Identity=52%"; Hit description =ENSANGP00000014976 [Anopheles gambiae]
  misc_feature: Gene Ontology Annotation: Molecular function=pseudouridylate synthase activity; Cellular component=nucleus; Biological process=pyrimidine base metabolism
  misc_feature: Pfam annotation: Pfam_ID=PseudoU_synth_1; Match level="Score=76.9, E -value=5.5e-20, Copies=2"; Pfam description=tRNA pseudouridine synthase
  misc_feature (303)..(303): Xaa can be any naturally occurring amino acid
  misc_feature (359)..(359): Xaa can be any naturally occurring amino acid
MLFRITKNISRFFSQADFLSKGPQLPITSIFPSMEPKPFKKNKYDGRTKKRQWEERRRDKGESLRETPEDPKRVKLDEDQEMEKDKIKRRKFCLLLGYSGNNYFGMQRNPNTKTIEEDLLNALFKTHLITEDCYQQVQNMQFQRAARTDKGVSAARQVVSLKLKENIDLNQINAELPEVIRVFNYKRVTKGFNSKSQCDGRSYIYLIPTVAFAPHDKEVSQKDFRLDDETFTKINTILENYLGTKNFHNYTSKKKHNDPSANRYMKSFVCEKPFIRKEVEFAILKVHGQSFMLHQIRKMGGLXLAIIRGLATEDIIKESFKSDKVIIPRAPGLGLVLEYVHYDRYNNRYGADGVHETIXWDEVEDKVQKFNEKNIFSNEFFFKKKNLGGGRGGCKKRGGKKKKKF

SEQ ID NO: 20961 - protein, 340 aa, Diabrotica virgifera
  misc_feature: Coding regions on vcDNA: vcDNA=SeqID_658; Strand=+; Position=1-1020
  misc_feature: Homolog annotation: Hit_ID=EAL29024.1; Match level="QueryCoverage =96%, HitCoverage=34%, E-value=1e-76, Identity=43%"; Hit description =GA18473-PA [Drosophila pseudoobscura]
  misc_feature: Gene Ontology Annotation: Cellular component=actin filament; Biological process=establishment and/or maintenance of cell polarity
  misc_feature (295)..(295): Xaa can be any naturally occurring amino acid
HKQCCVSDLRIYLNLLDSEKKTELASRLIKDVGISSTSVPQTERQMQRHISALQLSRLCGGHRNLQPDHLRALITALSLHYQHGFQTYGENLLPTDLGPSDPYALMSAHVLYDLAHIEKSSNCIQVALRLLECLLNYSPSNFHAKLLAIRLYHELGGSISAHDMYCSLDVKHLQLDSLGFIHCARLPTTGLFTLCTNLFDATLKFFSSNYKDSSDHLTFSYKFGSFMKIDEFMDFRERLNNSLHYSTVVVDRIILNLVECMSLETLYSLAITPQDCNINWKSLIDNHDLSAYTTXDPERINGQPEDWQQTKDLFEQDIWVSKLRSSVLLGIAHGIEIVKS

SEQ ID NO: 20962 - protein, 279 aa, Diabrotica virgifera
  misc_feature: Coding regions on vcDNA: vcDNA=SeqID_659; Strand=+; Position=2-841
FKGPPPFFFFFFSFFIFGFFSFFFSFSSYRSFFFFLPGKSSFNSIVCKYKHFYCNRNKLNDGTSQQKKEYERALIYDKLLMYRSEAFEDFVELTLMDRVHDVEIGDININRFLEKNELITIVKESKKTPDIMFILNGILYIGDIAVSQSIGSVTEIKKQKYGPLIEEIRSMNEKLTINELYLILDENNKNLDDVISTMEDITGIAHRRTYKEEMLRKLKNIKDARREILNKVTNREAFEKFIKEIKNSQPSAYDSYGGGASIIPVTSRKDDLTIFNEIA

SEQ ID NO: 20963 - protein, 113 aa, Diabrotica virgifera
  misc_feature: Coding regions on vcDNA: vcDNA=SeqID_660; Strand=-; Position=459-800
IHESMTDVENSFDILANNCNSFRGDVPRKNNICFILKYIKIILISRINRVFRLNSPHSHNLIPDNVALLPYANDLVFLYNSLNPILDSIHINQYYQIFMNSVTTIFFNNILFS

SEQ ID NO: 20964 - protein, 173 aa, Diabrotica virgifera
  misc_feature: Coding regions on vcDNA: vcDNA=SeqID_661; Strand=+; Position=315-836
  misc_feature: Homolog annotation: Hit_ID=XP_311500.1; Match level="QueryCoverage =99%, HitCoverage=95%, E-value=4e-38, Identity=46%"; Hit description =ENSANGP00000013693 [Anopheles gambiae]
MATNKSLYFGYGSNLLERRMHRSNPNAVRYGKGVLKDYTLDMGTYGHFWKGCGANIVQSPGDKVWGALWQLKDEDFVNLDRQESVHKNVYKRIIVQIETPEGQKLNAIAYQNVKQFERFDLTNLPTERRPSPAYMDVIIKGAQETGLPIDYINFLKTISTNGIDHVPNLDPEK

SEQ ID NO: 20965 - protein, 271 aa, Diabrotica virgifera
  misc_feature: Coding regions on vcDNA: vcDNA=SeqID_662; Strand=+; Position=146-961
  misc_feature: Homolog annotation: Hit_ID=AAH74384.1; Match level="QueryCoverage =97%, HitCoverage=50%, E-value=4e-53, Identity=42%"; Hit description =MGC84319 protein [Xenopus laevis]
  misc_feature: Gene Ontology Annotation: Molecular function=molecular_function unknown; Cellular component=nucleus; Biological process=cAMP -mediated signaling
  misc_feature: Pfam annotation: Pfam_ID=Tcp11; Match level="Score=-86.6, E-value=1e -05, Copies=1"; Pfam description=T-complex protein 11
MSENKDIPKGNNDEQGSSRIRTTSECSYTSDDGSSGFTGRRQRTTSHQFMVASGLTAASPPKFVSLEEIMQAANGMRDMALVHQIVVDKDFRLKRAEPEPNSVQGIIKNTMHKAFWDILKQQLNENPPVYTQALNLLEEIKEGLFAVLLPQHTRIKQQISEVLDSDLIKQQAEKGTLDFKNYAQYVVSVMSKLCAPVRDNKILELSMTVDVIETFQGILETLDLMQLDMANFTLQMARPDIIACSVELERKKFADYLAVQYDGLEQLVNGY

SEQ ID NO: 20966 - protein, 197 aa, Diabrotica virgifera
  misc_feature: Coding regions on vcDNA: vcDNA=SeqID_663; Strand=+; Position=206-799
  misc_feature: Homolog annotation: Hit_ID=EAA14722.2; Match level="QueryCoverage =92%, HitCoverage=93%, E-value=4e-54, Identity=52%"; Hit description =ENSANGP00000016703 [Anopheles gambiae str. PEST] ref|XP_553141.1| ENSANGP00000016703 [Anopheles gambiae st
MGRLVNMQYLFSLTTLLLFSSIISTQAEDVPLSKLSQHIGTPTLRFLYCYSCGYKNMFDQFSTIINQKYPEILVDGANYDPPGMNMFIAKMIGWIKMAIILCILANINVFEYFNQPRPGWWIWCVENKLYACMMLFFLCNILEGQLIQSGAFEITLNDVPVWSKLETGRIPQPAELFQIIDSHMQFDTKIEYNNFAK

SEQ ID NO: 20967 - protein, 281 aa, Diabrotica virgifera
  misc_feature: Coding regions on vcDNA: vcDNA=SeqID_664; Strand=+; Position=615-1460
  misc_feature: Homolog annotation: Hit_ID=XP_392465.1; Match level="QueryCoverage =84%, HitCoverage=33%, E-value=1e-106, Identity=77%"; Hit description= similar to Bmsqd-2 [Apis mellifera]
  misc_feature: Gene Ontology Annotation: Molecular function=RNA binding; Cellular component=nuclear speck; Biological process=RNA catabolism
  misc_feature: Pfam annotation: Pfam_ID=RRM_1; Match level="Score=171.8, E-value =1.4e-48, Copies=2"; Pfam description=RNA recognition motif. (a.k.a. RRM, R
NTFFIFRKLFVGGMSWETTDRELREHFGQYGEIESINVKTDPNTGRSRGFAFIVFTTTEAIDKVVAAGDHVINGKKVDPKKAKARHGKIFVGGLTSELSDDDIKNYFSQFGSIIDIEMPFDKQKNQRKGFCFITFESEQVVNELLKQPKQTIKDKEVDVKKATPKPDQMGGPMMGMRGMRGGGRGGPMRGGRGGRGGYGNQGNWNQAYGGYGYGQGYGYDGYSQGYDYYGSGYGGYGGYDYSNYGGGNYGGAGGYQSGGAGGGPKQRGAGQRNQRFQPYQK

SEQ ID NO: 20968 - protein, 250 aa, Diabrotica virgifera
  misc_feature: Coding regions on vcDNA: vcDNA=SeqID_665; Strand=+; Position=733-1485
  misc_feature: Homolog annotation: Hit_ID=XP_392465.1; Match level="QueryCoverage =94%, HitCoverage=33%, E-value=1e-106, Identity=77%"; Hit description= similar to Bmsqd-2 [Apis mellifera]
  misc_feature: Gene Ontology Annotation: Molecular function=RNA binding; Cellular component=nuclear speck; Biological process=RNA catabolism
  misc_feature: Pfam annotation: Pfam_ID=RRM_1; Match level="Score=171.8, E-value =1.4e-48, Copies=2"; Pfam description=RNA recognition motif. (a.k.a. RRM, R
KLFVGGMSWETTDRELREHFGQYGEIESINVKTDPNTGRSRGFAFIVFTTTEAIDKVVAAGDHVINGKKVDPKKAKARHGKIFVGGLTSELSDDDIKNYFSQFGSIIDIEMPFDKQKNQRKGFCFITFESEQVVNELLKQPKQTIKDKEVDVKKATPKPDQMGGPMMGMRGMRGGGRGGPMRGGRGGRGGYGNQGNWNQAYGGYGYGQGYGYDGYSQGYDYYGSGYGGYGGYDYSNYGGGNYGKYTHRTH

SEQ ID NO: 20969 - protein, 326 aa, Diabrotica virgifera
  misc_feature: Coding regions on vcDNA: vcDNA=SeqID_666; Strand=+; Position=667-1647
  misc_feature: Homolog annotation: Hit_ID=BAA07211.1; Match level="QueryCoverage =89%, HitCoverage=96%, E-value=1e-112, Identity=68%"; Hit description= Bmsqd-2 [Bombyx mori]
  misc_feature: Gene Ontology Annotation: Molecular function=RNA binding; Cellular component=nuclear speck; Biological process=RNA catabolism
  misc_feature: Pfam annotation: Pfam_ID=RRM_1; Match level="Score=171.8, E-value =1.4e-48, Copies=2"; Pfam description=RNA recognition motif. (a.k.a. RRM, R
MENGEDFSKDVSAEHQNGSGDAPADSGSAETPGRDDDRKLFVGGMSWETTDRELREHFGQYGEIESINVKTDPNTGRSRGFAFIVFTTTEAIDKVVAAGDHVINGKKVDPKKAKARHGKIFVGGLTSELSDDDIKNYFSQFGSIIDIEMPFDKQKNQRKGFCFITFESEQVVNELLKQPKQTIKDKEVDVKKATPKPDQMGGPMMGMRGMRGGGRGGPMRGGRGGRGGYGNQGNWNQAYGGYGYGQGYGYDGYSQGYDYYGSGYGGYGGYDYSNYGGGNYGGAGGYQSGGAGGGPNKEELVTPPRVKGFGGERGTKKVTPPKKFFK

SEQ ID NO: 20970 - protein, 62 aa, Diabrotica virgifera
  misc_feature: Coding regions on vcDNA: vcDNA=SeqID_667; Strand=+; Position=788-976
TWFLFSRWLSQLSGRWEDEEDIGALGPMVFILGHFLLPTLSKTEPITLILTNSVTNHFIKSK

SEQ ID NO: 20971 - protein, 847 aa, Diabrotica virgifera
  misc_feature: Coding regions on vcDNA: vcDNA=SeqID_668; Strand=+; Position=66-2609
  misc_feature: Homolog annotation: Hit_ID=CAH93116.1; Match level="QueryCoverage =69%, HitCoverage=62%, E-value=2e-96, Identity=35%"; Hit description =hypothetical protein [Pongo pygmaeus]
  misc_feature: Gene Ontology Annotation: Molecular function=endopeptidase inhibitor activity; Cellular component=extracellular space
  misc_feature: Pfam annotation: Pfam_ID=VWA; Match level="Score=62.6, E-value=1.1e -15, Copies=1"; Pfam description=von Willebrand factor type A domain
MVIQKEALLGLLLCISIVTCFPQVSQSDSLVTSIASDSVENNGDNSNKENVPVLPKIYEMRVDANVSNRFAKCQITSKVRNLDKNAHEATFSVVIPEQAYISEFIMEIEGKQYKAYVQEKEQAKNTYTKAVESGQAAAHVSVSARDSNRFTVSVNVEPQKKAVFYLKYEELLTRANNQYELVINIHPGQPVKKLDVEVHIDESRPLKFINAPPLRSGNEIAKKGESLNPKAEIVKVNATSAVVKFSPDIEKQKQYATDLGTNAENGLAGQFVVQYDVEKAGPGGEVLVDGGHFVHFFAPSDIPALPKQVVFILDTSGSMEGIRITQLKEAMKSILPELKKEDIFSIIEFGSVVKVWNIDKSAVQYQSGIDEWGYEPEDPEAIFKNKTQQPIPPPYPASEENIKKAEDVVEKLKAFGGTDINSALTTGLQIILKNKEDKTHQPIIVFLTDGEATVGETNNEKIITTITELNSGKTPIFSLSFGDGADKNFLQKLALKNLGFNRHIYEAADASLQLQEFYKQISSPLLSNVVFKYVNNVTEVTKQVFPILFGGSELVVSGQILDPGFSPSTVEGWGINGPVKLVPVLNQAVGSLERLWAYLTLKQYLKQREAADNKTGPTQEALRIALKYSFVSDVTSLVVVKPNKTDAVDTEDGSDKRYPIIASGIPLSALQSKAPMLGSAGSSYIPLSNFGAPNYFASPVAAESDVDSLSDRIYGGALPAPTFSNKIYPSTTFRPPTTYSTTPFTPICNTQTPKSLLQMLKEKLPWLAAILGDDEVLTLSKGKFKLGLNETESSKPDCPETPLSQPGECTLIHHCSQVYEKLTDIQTYEKYFCDLQGFAGICCPKQS

SEQ ID NO: 20972 - protein, 406 aa, Diabrotica virgifera
  misc_feature: Coding regions on vcDNA: vcDNA=SeqID_669; Strand=+; Position=2-1222
  misc_feature: Homolog annotation: Hit_ID=XP_395067.1; Match level="QueryCoverage =97%, HitCoverage=12%, E-value=8e-78, Identity=35%"; Hit description =similar to hemolectin [Apis mellifera]
  misc_feature: Gene Ontology Annotation: Molecular function=protein binding; Cellular component=extracellular space; Biological process=cell adhesion
  misc_feature: Pfam annotation: Pfam_ID=VWC; Match level="Score=16.8, E-value =0.0042, Copies=2"; Pfam description=von Willebrand factor type C domain
QCCPTYRRVACKYNGKVQEVGDNWFMEGDYCTSIMCVKSDAGYIQKQNQVKHCEVNCDYGFEYVAPTVESKECCGYCKQIACVVEGTIYEIGEEWSSPDACTKYVCTDVEGLIQVRAQLTNCPVISQEDAKNFVIQDEIVKGHCCPKHVKTACKVDGNIVKVGETWPSADDKCKSYKCNEKGEQELVLQESVQFCKTECAKGWEYKPSETKCCGECVQVSCVIEDEVWLEGQTWKSDDNCTTFSCEKLGDQYSITSQQESCPPLDSSCEPKNIYVQGCCQYCNSSGSALTQCMALPVPEKLTIGLLKYSECSNVNPIKNFTECVGSCESATSFNPILGMMQSKCSCCQAIAFNNLQVELQCPDGSVLKKDVEVPSKCNCNITACEGNLKSIEPRSIVHRGRRYGVY

SEQ ID NO: 20973 - protein, 222 aa, Diabrotica virgifera
  misc_feature: Coding regions on vcDNA: vcDNA=SeqID_670; Strand=+; Position=152-820
  misc_feature: Homolog annotation: Hit_ID=XP_394985.1; Match level="QueryCoverage =98%, HitCoverage=82%, E-value=8e-70, Identity=62%"; Hit description =similar to ENSANGP00000011316 [Apis mellifera]
  misc_feature: Gene Ontology Annotation: Molecular function=nuclear localization sequence binding; Cellular component=nuclear pore; Biological process=protein-nucleus import
  misc_feature: Pfam annotation: Pfam_ID=IBN_N; Match level="Score=36.7, E-value=7e -08, Copies=1"; Pfam description=Importin-beta N-terminal domain
MDQKPDLDLVISAVSALYNNPNSSEKERASKWLLELQKSVHAWTVADELLHLKRDLESCYFAAQTMRTKIHQSFHELPLEVHTSLRDSLLEHIGQINEATNTVIVTQLCVALADLALQMPSWQNPTLDLINRFSQTNIWPLLEILTVLPEELESRSVRLGENRRIDVLEEMKISAPTVNEFLKHCSKLYETNWQEHVQFNVKVLRCFTSWISIGAINLNDLF

SEQ ID NO: 20974 - protein, 111 aa, Diabrotica virgifera
  misc_feature: Coding regions on vcDNA: vcDNA=SeqID_671; Strand=+; Position=56-391
  misc_feature: Homolog annotation: Hit_ID=XP_316821.1; Match level="QueryCoverage =96%, HitCoverage=76%, E-value=2e-34, Identity=60%"; Hit description =ENSANGP00000010310 [Anopheles gambiae]
  misc_feature: Gene Ontology Annotation: Cellular component=extracellular space; Biological process=energy pathways
  misc_feature: Pfam annotation: Pfam_ID=COX6A; Match level="Score=125.6, E-value =1.2e-34, Copies=1"; Pfam description=Cytochrome c oxidase subunit VIa
MAYLLNQGVRRFMQTSAKRAAQIEGPSAVSGGHEGGYKIWKNLTIFVAFPSIILCAVNCYLSHQSGHHEPPEFHKYDHMRVRTKRFPWGDGNKSLFHNPHCNALPDGYEHH

SEQ ID NO: 20975 - protein, 215 aa, Diabrotica virgifera
  misc_feature: Coding regions on vcDNA: vcDNA=SeqID_672; Strand=+; Position=112-759
  misc_feature: Homolog annotation: Hit_ID=XP_393761.1; Match level="QueryCoverage =100%, HitCoverage=100%, E-value=1e-120, Identity=94%"; Hit description=similar to GTP-binding nuclear protein RAN1 [Apis mellifera]
  misc_feature: Gene Ontology Annotation: Molecular function=ATP binding; Cellular component=nucleoplasm; Biological process=embryogenesis and morphogenesis
  misc_feature: Pfam annotation: Pfam_ID=Ras; Match level="Score=234.3, E-value=2.2e -67, Copies=1"; Pfam description=Ras family
MAGEQDMPTFKCVLVGDGGTGKTTFVKRHMTGEFEKKYVATLGVEVHPLVFHTNRGQIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAAPALLPPEVQMDPQWQQQIEKDLKEASETALPDDDEDL

SEQ ID NO: 20976 - protein, 243 aa, Diabrotica virgifera
  misc_feature: Coding regions on vcDNA: vcDNA=SeqID_673; Strand=+; Position=214-945
  misc_feature: Homolog annotation: Hit_ID=XP_310095.1; Match level="QueryCoverage =97%, HitCoverage=78%, E-value=3e-49, Identity=44%"; Hit description =ENSANGP00000018853 [Anopheles gambiae]
  misc_feature: Gene Ontology Annotation: Molecular function=lysophosphatidate acyltransferase activity; Cellular component=lipid particle; Biological process=phosphatidic acid biosynthesis
  misc_feature: Pfam annotation: Pfam_ID=Acyltransferase; Match level="Score=147.4, E- value=3.3e-41, Copies=1"; Pfam description=Acyltransferase
MLYYLLILLAVLLVWNIESRFQKWAKYGVYVAYCYLVPFLIPLWLFNPGDSANALLPARGFRIVCRLLGVKYSVEGKENVNPDSGGVVLINHQSILDLLVLSILWPTIPRCSTIAKKSLLYVVPIGFAIGLCGAIFIDREKSSQSHEAVNKTATQINKRQARVLIFPEGTRNGGLKLLPFKKGAFHLAIAAQCPIQPVAVSRFTFLGKNKFTSGEIKIKILPAISTKNLTTEDIPRLLVRLTN

SEQ ID NO: 20977 - protein, 285 aa, Diabrotica virgifera
  misc_feature: Coding regions on vcDNA: vcDNA=SeqID_674; Strand=+; Position=90-947
  misc_feature: Homolog annotation: Hit_ID=EAA01246.3; Match level="QueryCoverage =87%, HitCoverage=83%, E-value=2e-87, Identity=60%"; Hit description =ENSANGP00000024653 [Anopheles gambiae str. PEST] ref|XP_550786.1| ENSANGP00000024653 [Anopheles gambiae st
  misc_feature: Gene Ontology Annotation: Molecular function=prenyltransferase activity; Cellular component=endoplasmic reticulum; Biological process=protein modification
  misc_feature: Pfam annotation: Pfam_ID=Prenyltransf; Match level="Score=290.0, E -value=4e-84, Copies=1"; Pfam description=Putative undecaprenyl diphosphate syn
MSWLGQNNLTSFQKFCIKVLKYGPVPQHIAIIMDGNRRFAKKTNVQKAEGHSKGFEKLAECLNWCRELGIREVTVYAFSIENFKRSQDEVDHLMQLAKEKFQKLFEEKERLMQEGICIRVIGDLSLLSEDLRKLVAEATLLTKDNNRSILNVAFSYVSREEITNSIKTIVKGVEEGYLENNDISEELISSCLYTYLSSSPDILIRTSGEVRLSDFLLWQISQRTEICFTDVLWPEFSIWNLLGIIFKYQRMVRNNVFHDEGNIHSRLYNKPTDGCHPPIEILVEN

SEQ ID NO: 20978 - protein, 428 aa, Diabrotica virgifera
  misc_feature: Coding regions on vcDNA: vcDNA=SeqID_675; Strand=+; Position=2-1288
  misc_feature: Homolog annotation: Hit_ID=AAM90673.1; Match level="QueryCoverage =99%, HitCoverage=51%, E-value=2e-47, Identity=28%"; Hit description =surface protein SdrI [Staphylococcus saprophyticus]
  misc_feature: Gene Ontology Annotation: Molecular function=molecular_function unknown; Cellular component=extracellular space; Biological process =DNA repair
DNEAAAENSGNENGTGAENNANADAQNDAAQANENGAAAENNGNADAAQGTDNEAAAENSGNENGTGAENNANADAQTDAAQGSTNEANAENNANADVQNDAAQANENGAAAENSGNADAAQGTDNGAAAENTGNADPAQGNDNGAAAENSGNENGTAAENNANADVQNDAAQVNNNGAAAENNGNADAAQSNDNGAAAENNTNADAQNDAAQGTANEANAENNANADAQNDAAQANENGAAAENSGNADAAQGTDNEATAENSGNADPAQGNDNGAAAENNGNANAAQSNDSEAAAENNGNADAQNDAAQGTANEANAENNANENAQNDAAQANDNEAAAENNGNADAAQSTDNEAAAEISGNADTQNDAAQGNENGAAAENTVDADPAQGNDNGAAAENSGNAEAAQGSDNGAAAEKNGNADPARR

SEQ ID NO: 20979 - protein, 1017 aa, Diabrotica virgifera
  misc_feature: Coding regions on vcDNA: vcDNA=SeqID_676; Strand=+; Position=35-3086
  misc_feature: Homolog annotation: Hit_ID=CAG88655.1; Match level="QueryCoverage =97%, HitCoverage=71%, E-value=4e-96, Identity=24%"; Hit description =unnamed protein product [Debaryomyces hansenii CBS767] ref|XP _460364.1| unnamed protein product [Debaryomy
  misc_feature: Gene Ontology Annotation: Molecular function=structural molecule activity; Cellular component=extracellular space; Biological process= development
  misc_feature (654)..(654): Xaa can be any naturally occurring amino acid
MRSVTVLFAIICAISLATVIAQNADPAVDVADPASSLALASEPCVNDDDVYPPDEPFPDIPANGTTRNGTEVVNQNTTVPQNSDPEGSGNGEQEINGNADNQTDAPQPNDDNTTAENSTDGQTDAPQGNENGAAAENNAQTDAQTDAAQGNGNEAAADNNGSADAAQGNDNRAAAENNANADAQTDAAQGSANEANAENNANADAQNDAAQANDNGAAAENNGNADAAQGTDNEAAAENSGNENGTGAENNANADAQTDVAQGSTNEANAENNANADVQNDAAQANENGAAAENSGNADAAQGTDNGAAAENTGNADPAQGNDNGAAAENSGNENGTAAENNANADVQNDAAQVNDNGAAAENNGNADAAQSNDNGAAAENNTNADAQNGAAQSTANEANAENNANADAQNDAAQANENGAAAENNGNADAAQGTDNEAAAENSGNENGTGAENNANADAQTDAAQSSTNEANAENNANADVQNDAAQANENGAAAENSGNADAAQGTDNGAAAENTGNADPAQGNDNGAAAENSGNENGTAAGNNANPDVQNDAAQVNDNGTAAENNGNADAAQSNDNGAAAENNTNADAQNGAAQGTANEANAENNANADAQNDDAAQANENGAAAENSGNADAAQGTDNGAAAENTGNFGXAQGNDNGAAAENSGNENGIAAENNANADVQNDAAQVNDNGAAAENNGNADAAQGNDNGAAAENNTNADTQNDAAQSSANDANAESNADAQNGAAQGNDNGAAAENTENADSQNDAAQNTGNEANAENNANVDVQNDAAQGNESQAAAENNSNADGAQNNNNGPAEENNSNADTQNDAAQGNENGSAAENTGNADSQNDAGQGSANAANADNNANTDAQNGADQGNENGSAAENNGGADGQNENGAAAASSGNADNQNNNNSNNDSGNNQNNGSNSVEENSKEDSGNESQENKDNNDTSEDNSEELDSSEREERRKEEEKKQKEEENNNNSVENSNEDSNNESQEEKDSNDTSEDDSDELDSRE

SEQ ID NO: 20980 - protein, 546 aa, Diabrotica virgifera
  misc_feature: Coding regions on vcDNA: vcDNA=SeqID_677; Strand=+; Position=35-1675
  misc_feature: Homolog annotation: Hit_ID=AAM90673.1; Match level="QueryCoverage =97%, HitCoverage=64%, E-value=2e-59, Identity=27%"; Hit description =surface protein SdrI [Staphylococcus saprophyticus]
  misc_feature: Gene Ontology Annotation: Molecular function=ribosome receptor activity; Cellular component=extracellular space; Biological process= signal transduction
CISKPQGNDNEAAAENSGNENGIAAENNANADVQNDAAQVNDNGAAAENNGNADAAQSNDNGAAAENNTNADAQNGAAQSTANEANAENNANADAQNDAAQANENGAAAENNGNADAAQGTDNEAAAENSGNENGTGAENNANADAQTDAAQGSTNEANAENNANADVQNDAAQANENGAAAENSGNADAAQGTDNGAAAENTGNADPAQGNDNGAAAENSGNENGTAAENNANADVQNDAAQVNDNGAAAENNGNADAAQSNDNGAAAENNTNADAQNDAAQGTANEANAENNANADAQNDAAQANENGAAAENNGNADAAQGTDNEAAAENSGNENGTGAENNANADAQTDAAQGSTNEANAENNANADVQNDAAQANENGAAAENSGNADAAQGTDNGAAAENTGNADPAQGNDNGAAAENSGNENGTAAENNANADVQNDAAQVNNNGAAAENNGNADAAQSNDNGAAAENNTNADAQNDAAQGTANEANAENNANADAQNDAAQANENGAAAENSGNADAAQGTDNEASAENSGNADPAQG

SEQ ID NO: 20981 - protein, 640 aa, Diabrotica virgifera
  misc_feature: Coding regions on vcDNA: vcDNA=SeqID_678; Strand=+; Position=297-2216
  misc_feature: Homolog annotation: Hit_ID=CAG88655.1; Match level="QueryCoverage =86%, HitCoverage=71%, E-value=3e-63, Identity=24%"; Hit description =unnamed protein product [Debaryomyces hansenii CBS767] ref|XP _460364.1| unnamed protein product [Debaryomy
  misc_feature: Gene Ontology Annotation: Molecular function=ribosome receptor activity; Cellular component=extracellular space; Biological process= signal transduction
LFPLSLLLLLLFWLSALPLLAAAENSGNENGTAAENNANADVQNDAAQVNNNGAAAENNGNADAAQSNDNGAAAENNTNADAQNDAAQGTANEANAENNANADAQNDAAQANENGAAAENSGNADAAQGTDNEATAENSGNADPAQGNDNGAAAENNGNANAAQSNDSEAAAENNGNADAQNDAAQGTANEANAENNANENAQNDAAQANDNEAAAENNGNADAAQSTDNEAAAEISGNADTQNDAAQGNENGAAAENTVDADPAQGNDNGAAAENSGNAEAAQGSDNGAAAENNGNADPAEGNENGSAAENSGNADAAQGNDNGAAAENNTNADTQNDAAQSSANDANAESNADAQNGAAQGNDNGAAAENTENADSQNDAAQNTGNEANAENNANVDVQNDAAQGNESQAAAENNSNADGAQNNNNGPAEENNSNADTQNDAAQGNENGSAAENTGNADSQNDAGQGSANAANADNNANTDAQNGADQGNENGSAAEINGGADGQNENGAAAASSGNADNQNNNNSNNDSGNNQNNGSNSVEENSKEDSGNESQENKDNNDTSEDNSEELDSSEREEEERRKEEEKKQKEKEKRKQKEEEKRIKEQQKREEERQRREEERLRREEERKQREKKKKRAA

SEQ ID NO: 20982 - protein, 694 aa, Diabrotica virgifera
  misc_feature: Coding regions on vcDNA: vcDNA=SeqID_679; Strand=+; Position=403-2487
  misc_feature: Homolog annotation: Hit_ID=AAO52302.1; Match level="QueryCoverage =92%, HitCoverage=61%, E-value=9e-59, Identity=20%"; Hit description =similar to Homo sapiens (Human). Dentin sialophosphoprotein precursor [Contains: Dentin phosphoprotein
  misc_feature: Gene Ontology Annotation: Molecular function=ribosome receptor activity; Cellular component=extracellular space; Biological process= signal transduction
  misc_feature: Pfam annotation: Pfam_ID=E-MAP-115; Match level="Score=-86.1, E-value= 0.1, Copies=1"; Pfam description=E-MAP-115 family
KFPYVQNDAAQVNDNGAAAENNGNADAAQSNDNGAAAENNTNADAQNGAAQSTANEANAENNANADAQNDAAQANDNGAAAENTGNADPAQGNDNGAAAENSGNENGTAAENNANADVQNDAAQVNDNGAAAENNGNADAAQSNDNGAAAENNTNADAQNHAAQGTANEANAENNANADAQNDAAQANENGAAAENSGNADAAQGTDNEATAENSGNADPAQGNDNGAAAENNGNANAAQSNDSEAAAENNGNADAQNDAAQGTANEANAENNANENAQNDAAQANDNEAAAETMVMPIDAAQNTGNEANAASPPTRPVQNDAAQGNESQAAAENNSNADGAQNNNNGPAEENNSNADTQNDAAQGNENGSAAENTGNADSQNDAGQGSANAANADNNANTDAQNGADQGNENGSAAENNGGADGQNENGAAAASSGNADNQNNNNSNNDSGNNQNNGSNSVEENSKEDSGNESQENKDNNDTSEDNSEELDSSEREEEERRKEEEKKQKEEENNNNSVEENSNEDSNNESQEEKDSNDTSEDDSDELDSREQKKKKEEEKKQQKEEEKRRKQEEKRQKQEEKRQKEKEKRKQKEEEKRIKEQQKREEERQRREEERLRREEETQQREEERRRNQDQWIDALKKTIERKLAYLDYIKNQYGINVQCDSEICRCRCLLNNNHSGYCSRTKECVCV

SEQ ID NO: 20983 - protein, 312 aa, Diabrotica virgifera
  misc_feature: Coding regions on vcDNA: vcDNA=SeqID_680; Strand=+; Position=222-1157
  misc_feature: Homolog annotation: Hit_ID=XP_320774.1; Match level="QueryCoverage =96%, HitCoverage=56%, E-value=7e-99, Identity=56%"; Hit description =ENSANGP00000014036 [Anopheles gambiae]
MTIPDPLKFNNFDNETIQNQGTENKSLTQIQEFYKNTNVFVTGGTGFLGKLLLEKLLRSCNDLNSIYVLIRNKKGKNVTTRVEEIFEDVVFDKMKVECPKFMHKIVAVAGDCSLPDLGLSIQDRKTLMEEINIVFHAAATVRFDEKMKTAVAINVRATEELLNLAHQMPKLKSYIHVSTAYANCPEKVIDEKFYPPALDYKKLLVMTDTLSDKMMDNLTPIMLDKYPNTYAYTKQIAEGVVQEVGEGLPLGVARPAIVVATYREPVRAWINNMYGPTGIVAGAGVGLIRVVHCDEYAHANIVPRDMCVNSII

SEQ ID NO: 20984 - protein, 207 aa, Diabrotica virgifera
  misc_feature: Coding regions on vcDNA: vcDNA=SeqID_681; Strand=+; Position=120-743
  misc_feature: Homolog annotation: Hit_ID=XP_309678.1; Match level="QueryCoverage =92%, HitCoverage=88%, E-value=2e-60, Identity=57%"; Hit description =ENSANGP00000019755 [Anopheles gambiae]
  misc_feature: Pfam annotation: Pfam_ID=4HBT; Match level="Score=7.7, E-value=0.096, Copies=1"; Pfam description=Thioesterase superfamily
MSLDVSCCLLCYSAVVTVIALLYVFLDVNYFIRIAFTIGFSKFFEKKKKLEDGTHIYGVCTSQDMDIFFSHMNNARYIRELDFARFHFYFVTGLYDLIKKNKGHVLQTASNIRYRRTIPWFNTYKVTTKIVYWDEKTMYIEQQFVTLHDNFIRAVILSKQTTIGLNVPELMAKLTGCDESYRPPLPEELQDWLSSIEKSSNKLRKKE

SEQ ID NO: 20985 - protein, 186 aa, Diabrotica virgifera
  misc_feature: Coding regions on vcDNA: vcDNA=SeqID_682; Strand=+; Position=13-573
  misc_feature: Homolog annotation: Hit_ID=NP_727758.1; Match level="QueryCoverage =91%, HitCoverage=79%, E-value=5e-20, Identity=37%"; Hit description =CG32603-PA [Drosophila melanogaster] gb|AAN09580.1| CG32603-PA [Drosophila melanogaster]
  misc_feature: Gene Ontology Annotation: Molecular function=calcium ion binding
MAFKVLIFASVLAFANAGIYGEAPLALPATPVVSAYSSPLLTAPTLSKSVVQTYTSHAAPVAVAAPVVAKAAPLVSAYSAPLALPAHGPVLSAYSSPLAYAAPAPVVSAYSSPVVSAYSSPVVSAYSAPLVAKTVPHVAYAAPGPVVSAYSAPIVAKSLAPAPIAYAGHAAPVVSAYSAGPIAQPW

SEQ ID NO: 20986 - protein, 432 aa, Diabrotica virgifera
  misc_feature: Coding regions on vcDNA: vcDNA=SeqID_683; Strand=+; Position=198-1496
  misc_feature: Homolog annotation: Hit_ID=XP_311257.1; Match level="QueryCoverage =100%, HitCoverage=88%, E-value=0.0, Identity=81%"; Hit description =ENSANGP00000011950 [Anopheles gambiae]
  misc_feature: Gene Ontology Annotation: Molecular function=adenosylhomocysteinase activity; Cellular component=cytoplasm; Biological process=one -carbon compound metabolism
  misc_feature: Pfam annotation: Pfam_ID=AdoHcyase; Match level="Score=505.2, E-value= 6.5e-149, Copies=1"; Pfam description=S-adenosyl-L-homocysteine hydrolase
MAKQSYKVADMSLAEWGRKEITLAENEMPGLMSLRAKYKDNKILKGAKIAGCLHMTVQTAVLIETLADLGAEVQWSSCNIFSTQDHAAAAIAKRGIPVYAWKGETDEEYVWCIEQTLVFPDGKPFNMILDDGGDLTNLVHTKYPQYLTGCKGISEETTTGVHNLYKMYKEGTLKVPAINVNDSVTKSKFDNLYGCRESLIDGIKRATDVMLAGKVCVVAGYGDVGKGCAQSLRAFGGRVLITEIDPINALQAAMEGYEVTTMEEASKEAQIYVTTTGCKDIIRGEHFLNMRDDSIVCNIGHFDCEIDVAWLEKNAKEKVTIKPQVDRYLLSTGNHVIVLAEGRLVNLGCATGHSSFVMSNSFTNQVLAQIELWTKPGAYSLGVHMLPKHLDEEVARLHLKHLGVKLTTLSADQAQYLGISAQGPFKSDHYRY

SEQ ID NO: 20987 - protein, 366 aa, Diabrotica virgifera
  misc_feature: Coding regions on vcDNA: vcDNA=SeqID_684; Strand=+; Position=104-1201
  misc_feature: Homolog annotation: Hit_ID=NP_572441.1; Match level="QueryCoverage =99%, HitCoverage=61%, E-value=1e-105, Identity=49%"; Hit description= CG2260-PA [Drosophila melanogaster] gb|AAF46323.1| CG2260-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=WD40; Match level="Score=25.0, E-value =0.00022, Copies=1"; Pfam description=WD domain, G-beta repeat
MGKPHVRYFSTAGSNDPKVKTEEKQNSKGNKQFKGKVKTGKVKTEAKQNNENKKFKGKAKPPKELIEKYTRGEEVDVKGVRTSTHQKIIQRKEKNIKFAIEESAKTEVLLTEDSGYLEADSGETTTQFTQKHLVREVDIAAASKHFDLRLNFGPYRAKYTKNGRHLLIGGKVGHVAAFDWITKKLHCEINVMESVHDISWLHIETMFAVAQKNWVYIYDNQGIELHCVKRLNKVSRMEFLPYHFLLASCSDEGYLGWLDISIGQIAGLYNTGLGRLSVLSQNPWNATLCTGHAKGVVSFWSPTSRDPLAKMLCHKAPIVGLHVDPTGTYMATSASNRELKIWDVRKLEGPVQEYKLIQAANNLNFS

SEQ ID NO: 20988 - protein, 255 aa, Diabrotica virgifera
  misc_feature: Coding regions on vcDNA: vcDNA=SeqID_685; Strand=+; Position=203-971
  misc_feature: Homolog annotation: Hit_ID=EAL41985.1; Match level="QueryCoverage =88%, HitCoverage=98%, E-value=1e-115, Identity=67%"; Hit description= ENSANGP00000028617 [Anopheles gambiae str. PEST] ref|XP_560335.1| ENSANGP00000028617 [Anopheles gambiae s
  misc_feature: Gene Ontology Annotation: Cellular component=nuclear lamina; Biological process=torso signaling pathway
  misc_feature (241)..(241): Xaa can be any naturally occurring amino acid
MRSVEVLAIIGLVSSIHSGLCAKPIEPYYGRKIGNLVEFAHGIKGTAYAVDESTIFIKGFYYDGTGPDAFFWIGNSPRPSPEGTIIPYPEDYNGRDPPVLRAYNNTDIILRLPMGKRIRDIRWLSVWCRRFTVDFGEVFIPPNLEVPKPRVLPEFKRLAHGLRSDNISILDAKTFYIPNLHYDGAGPDAYFWVGNGSEPTSFGIKVPNEMGSLEPLRGYQGEDIEIQLPGLLTVYDIDWLXIWGVQYRHNFWAPV

SEQ ID NO: 20989 - protein, 307 aa, Diabrotica virgifera
  misc_feature: Coding regions on vcDNA: vcDNA=SeqID_686; Strand=+; Position=72-995
  misc_feature: Homolog annotation: Hit_ID=EAL41847.1; Match level="QueryCoverage =85%, HitCoverage=90%, E-value=4e-59, Identity=44%"; Hit description =ENSANGP00000027068 [Anopheles gambiae str. PEST] ref|XP_565003.1| ENSANGP00000027068 [Anopheles gambiae st
MFPNRLLLSVFKSSQCTISKVPQINNGFRFAVNIQNARPLYSKVTLGIDMFLQQCQTTGKQMENISEKFKEKMFEFSQDEGKHMVFTEDLKNMIHLSKDEKDLDLVVKMIKKFNKQNKELRFGSFVFGPVVLRLFHHYNRPDLALECFKSDELSGFFDQIISYQILLDLLYENQMYQEILDCADFIKDKQMEGMKYPRNVVVLAMAACYKLNSKESLEYALKLWQDLKDIGHFPMRRACTFCAGIAYNQGNPGIALEILTSAKIQNYTTVRNLKVACLASVGRVENGISIMKSVLSENPPGSQTPLL

SEQ ID NO: 20990 - protein, 321 aa, Diabrotica virgifera
  misc_feature: Coding regions on vcDNA: vcDNA=SeqID_687; Strand=+; Position=29-994
  misc_feature: Homolog annotation: Hit_ID=AAL68282.1; Match level="QueryCoverage =90%, HitCoverage=97%, E-value=2e-47, Identity=37%"; Hit description =RE31002p [Drosophila melanogaster]
  misc_feature: Gene Ontology Annotation: Molecular function=acid phosphatase activity; Cellular component=integral to membrane; Biological process=regulation of cell cycle
  misc_feature: Pfam annotation: Pfam_ID=Acid_phosphat_A; Match level="Score=-51.9, E- value=3.7e-05, Copies=1"; Pfam description=Histidine acid phosphatase
MIIVKVAIILTSLYSVIVNSYRIHSDPQNIQPADSTVILTHVLFRHGNRTAELSETYPKDPYRNFTYFPIGRGQLTNAGKLREYQIGKDLRRRYDKFLGPVYYPEVVDAVTTNKNRTKASLELVLASLFRPKYTDVWNWALGWQPVPYNYYPVDHDPVLMGINCPRYQALYKELVNSPKWKATFKKYQKDFDYISKNTGLNVTSFKEVYDMYFGLSTEEEYGQELPPWTHSVWPKVIVDLSIKQYYVETGTTEMAKLAEGFHLKKIIEDTKTKAKKREKNGVKMYLYSAHENNVGEMMVLLDVFKNPHVPSLWGLLDLWKS

SEQ ID NO: 20991 - protein, 147 aa, Diabrotica virgifera
  misc_feature: Coding regions on vcDNA: vcDNA=SeqID_688; Strand=+; Position=17-460
  misc_feature: Homolog annotation: Hit_ID=CAE47499.1; Match level="QueryCoverage =96%, HitCoverage=44%, E-value=3e-59, Identity=75%"; Hit description =cathepsin L-like proteinase [Diabrotica virgifera virgifera]
  misc_feature: Gene Ontology Annotation: Molecular function=cathepsin K activity; Cellular component=lysosome; Biological process=proteolysis and peptidolysis
  misc_feature: Pfam annotation: Pfam_ID=Peptidase_C1; Match level="Score=77.6, E -value=3.4e-20, Copies=1"; Pfam description=Papain family cysteine protease
VLLAQYQYVSTLIGTGNCIASDYKYQGLDGDCKQCNPVIKTINGYASVDQTEEALKEAVGTVGPISVCVNANWDWQLYSGGILDSQSCPGDILNHAVLAVGYGSENGKDFWLIKNSWDTYWGEAGYLRLVRGTNQCGINKVADYPLL

SEQ ID NO: 20992 - protein, 54 aa, Diabrotica virgifera
  misc_feature: Coding regions on vcDNA: vcDNA=SeqID_689; Strand=-; Position=1110-1274
  misc_feature: Homolog annotation: Hit_ID=ZP_00357698.1; Match level="QueryCoverage =88%, HitCoverage=25%, E-value=4e-15, Identity=76%"; Hit description =hypothetical protein Chlo02002738 [Chloroflexus aurantiacus]
RGPPFFFFLFFFFFFFFFFFFFFFFFFFFFFFFFFFFFKVIIFLFMFHYINCKV

SEQ ID NO: 20993 - protein, 237 aa, Diabrotica virgifera
  misc_feature: Coding regions on vcDNA: vcDNA=SeqID_690; Strand=+; Position=277-987
  misc_feature: Homolog annotation: Hit_ID=NP_476772.1; Match level="QueryCoverage =100%, HitCoverage=52%, E-value=1e-136, Identity=99%"; Hit description=CG1913-PA [Drosophila melanogaster] gb|EAL28889.1| GA15128-PA [Drosophila
  misc_feature: Gene Ontology Annotation: Molecular function=GTP binding; Cellular component=microtubule; Biological process=microtubule-based process
  misc_feature: Pfam annotation: Pfam_ID=Tubulin; Match level="Score=325.0, E-value =1.2e-94, Copies=1"; Pfam description=Tubulin/FtsZ family, GTPase domain
MRECISVHVGQAGVQIGNACWELYCLEHGIQPDGQMPSDKTVGGGDDSFNTFFSETGAGKHVPRAVFVDLEPTVVDEVRTGTYRQLFHPEQLITGKEDAANNYARGHYTIGKEIVDLVLDRIRKLADQCTGLQGFLIFHSFGGGTGSGFTSLLMERLSVDYGKKSKLEFAIYPAPQVSTAVVEPYNSILTTHTTLEHSDCAFMVDNEAIYDICRRNLDIERPTYTNLNRLIGQIVSS

SEQ ID NO: 20994 - protein, 260 aa, Diabrotica virgifera
  misc_feature: Coding regions on vcDNA: vcDNA=SeqID_691; Strand=+; Position=160-942
  misc_feature: Homolog annotation: Hit_ID=AAK58683.1; Match level="QueryCoverage =99%, HitCoverage=57%, E-value=1e-150, Identity=100%"; Hit description=alpha tubulin [Chironomus tentans]
  misc_feature: Gene Ontology Annotation: Molecular function=GTP binding; Cellular component=microtubule; Biological process=microtubule-based process
  misc_feature: Pfam annotation: Pfam_ID=Tubulin_C; Match level="Score=276.9, E-value= 3.5e-80, Copies=1"; Pfam description=Tubulin/FtsZ family, C-terminal domai
VSTTLEHSDCAFMVDNEAIYDICRRNLDIERPTYTNLNRLIGQIVSSITASLRFDGALNVDLTEFQTNLVPYPRIHFPLVTYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGMDSGEGEGEGAEEY

SEQ ID NO: 20995 - protein, 447 aa, Diabrotica virgifera
  misc_feature: Coding regions on vcDNA: vcDNA=SeqID_692; Strand=+; Position=226-1569
  misc_feature: Homolog annotation: Hit_ID=NP_476772.1; Match level="QueryCoverage =95%, HitCoverage=94%, E-value=0.0, Identity=99%"; Hit description =CG1913-PA [Drosophila melanogaster] gb|EAL28889.1| GA15128-PA [Drosophila
  misc_feature: Gene Ontology Annotation: Molecular function=GTP binding; Cellular component=microtubule; Biological process=microtubule-based process
  misc_feature: Pfam annotation: Pfam_ID=Tubulin; Match level="Score=369.0, E-value =6.6e-108, Copies=1"; Pfam description=Tubulin/FtsZ family, GTPase domain
MRECISVHVGQAGVQIGNACWELYCLEHGIQPDGQMPSDKTVGGGDDSFNTFFSETGAGKHVPRAVFVDLEPTVVDEVRTGTYRQLFHPEQLITGKEDAANNYARGHYTIGKEIVDLVLDRIRKLADQCTGLQGFLIFHSFGGGTGSGFTSLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLVTYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAAFLIISIFFTILNRITPYLSL

SEQ ID NO: 20996 - protein, 289 aa, Diabrotica virgifera
  misc_feature: Coding regions on vcDNA: vcDNA=SeqID_693; Strand=+; Position=87-951
  misc_feature: Homolog annotation: Hit_ID=NP_956186.1; Match level="QueryCoverage =93%, HitCoverage=60%, E-value=4e-68, Identity=45%"; Hit description =zinc metalloproteinase (STE24 homolog, yeast) [Danio rerio] gb|AAH46884.1| Zinc
  misc_feature: Gene Ontology Annotation: Molecular function=metalloexopeptidase activity; Cellular component=membrane fraction; Biological process =proteolysis and peptidolysis
  misc_feature (269)..(269): Xaa can be any naturally occurring amino acid
MMDLESIQNIFDATCVRYSIVFLLWIEFIWETYLSFRQYQKAQSVTEVPEIIKKVMDADEFEKARQYSLAKLRFGFVRDTYGILYTTVVITYGLLAFFWDHAESINPVKGEITTSCIWLFSVSLISTIIDLPLTIYHTFVLEEKFGFNKQSAGFFIWDKIKAFFVSQLITLIICSVIISIIKSGGQYFFIWLWAVVCVISMVLLTLYPSVIAPLFDKYTPLPEGELRTSIENLASELKFPLTQLYVVEGSKRSSHSNAYFYGLFKSKRXIVLFDTLLPKDDGTGCKNDE

SEQ ID NO: 20997 - protein, 72 aa, Diabrotica virgifera
  misc_feature: Coding regions on vcDNA: vcDNA=SeqID_694; Strand=-; Position=193-411
RQRFGTTLFVNVFLKIPKKSSEGAFPVSLRDISTINRQFRCSLTQLIQWEKYHQLIVYAVTIFMKYHCKFKY

SEQ ID NO: 20998 - protein, 260 aa, Diabrotica virgifera
  misc_feature: Coding regions on vcDNA: vcDNA=SeqID_695; Strand=+; Position=125-905
  misc_feature: Homolog annotation: Hit_ID=XP_396250.1; Match level="QueryCoverage =92%, HitCoverage=51%, E-value=2e-40, Identity=35%"; Hit description =similar to ENSANGP00000009437 [Apis mellifera]
  misc_feature: Gene Ontology Annotation: Molecular function=glucose transporter activity; Cellular component=plasma membrane; Biological process =glucose transport
  misc_feature: Pfam annotation: Pfam_ID=MFS_1; Match level="Score=-15.5, E-value =0.014, Copies=1"; Pfam description=Major Facilitator Superfamily
  misc_feature (241)..(241): Xaa can be any naturally occurring amino acid
MDNEESGLFTGTKTQLLAAVFGTLFAISDGMTYGWTAPIIPYLISPESHIKTTKFEAEWLESCLMIGSFLGLPITIYLVDKIGRKKSLLLAAVLSLISWIIIAFAGNMVLLFVARFIFGVTANTSFVAAPIYVAEIADHKIRGFLSSIIYLNMLFGLILVYSVGPYLPFFVAPLIGVTVLFIELLVFPFMPETPYYLLHTNQKDEGKKSLEFFRPGRNIDRELADITKAVARQTTETRKIXDLFSVKANRKAITIMAILD

SEQ ID NO: 20999 - protein, 222 aa, Diabrotica virgifera
  misc_feature: Coding regions on vcDNA: vcDNA=SeqID_696; Strand=+; Position=77-745
  misc_feature: Homolog annotation: Hit_ID=EAA00776.2; Match level="QueryCoverage =68%, HitCoverage=98%, E-value=3e-34, Identity=48%"; Hit description =ENSANGP00000020034 [Anopheles gambiae str. PEST] ref|XP_551880.1| ENSANGP00000020034 [Anopheles gambiae st
MSVRYLTKAIRSVSCNLGRGNFYTPLCRHNLTTFAPGINSSGTIGVGEKPKKKKTVEIPSITLIQGNHLSVTTLEEAQKLSKRRDLKLVKIVDLDTKTQRPIYKLMTGAEYHAEDIKQRLQKKEEKQGAIKGEKVLILNHKIFEQDLQTQIKKIGKWINKMYEVRVVINGDSSNMEKAEFLYSAIEKSLEKDVRIVQKRQKGSDIKFQILPPKKNKEDSKGL

SEQ ID NO: 21000 - protein, 294 aa, Diabrotica virgifera
  misc_feature: Coding regions on vcDNA: vcDNA=SeqID_697; Strand=+; Position=34-918
  misc_feature: Homolog annotation: Hit_ID=S27163; Match level="QueryCoverage=98%, HitCoverage=51%, E-value=1e-81, Identity=49%"; Hit description =alpha,alpha-trehalase (EC 3.2.1.28) - yellow mealworm dbj|BAA01951.1| trehalase precursor
  misc_feature: Gene Ontology Annotation: Molecular function=alpha,alpha-trehalase activity; Cellular component=extrinsic to plasma membrane, GPI -anchored; Biological process=trehalose catabolism
  misc_feature: Pfam annotation: Pfam_ID=Trehalase; Match level="Score=-48.6, E-value= 1e-15, Copies=1"; Pfam description=Trehalase
  misc_feature (243)..(243): Xaa can be any naturally occurring amino acid
  misc_feature (278)..(278): Xaa can be any naturally occurring amino acid
MKRLVTIATIIFFVSQQAFSIVLTDLCTSNVYCKGNLLDVVQKSGVFNDSKTFVDLVQKYPENVTLDRFNKLMVSTKNRPTKINITRFIKDCFSSEGELVKWTPPDYKDNPSFLTKINDTGVKSFAKKLNNIWPLLARKVNSTVSKHPAQHSLISLPNGFIIPGGRFKEIYYWDSYWIVKGLLICGMKETARGMLENLISLVRKYGFVPNGSRVYYLNRSQPPLLSLIAGLYYDATKNITFIXKNIDMLDREVNWWLENRAVRVRKDSIIHTLLRYSXKSGFPRPESYVEDLHT

SEQ ID NO: 21001 - protein, 279 aa, Diabrotica virgifera
  misc_feature: Coding regions on vcDNA: vcDNA=SeqID_698; Strand=+; Position=30-867
  misc_feature: Homolog annotation: Hit_ID=XP_320585.1; Match level="QueryCoverage =98%, HitCoverage=96%, E-value=1e-111, Identity=68%"; Hit description= ENSANGP00000015285 [Anopheles gambiae] gb|EAA00259.1| ENSANGP00000015285 [Anopheles gambiae
  misc_feature: Gene Ontology Annotation: Molecular function=structural constituent of ribosome; Cellular component=mitochondrial ribosome; Biological process=positive regulation of embryonic development
  misc_feature: Pfam annotation: Pfam_ID=Ribosomal_L15; Match level="Score=-18.5, E -value=0.0021, Copies=1"; Pfam description=Ribosomal protein L15 amino terminal
  misc_feature (255)..(255): Xaa can be any naturally occurring amino acid
  misc_feature (267)..(267): Xaa can be any naturally occurring amino acid
  misc_feature (269)..(269): Xaa can be any naturally occurring amino acid
MSNNTTERALNLLRFLPRVCIANIRDNPGARKCTRRGRAQHGGDYHGHGNKGSKARQNYTRLGYETGNNPFYLRFPWEPYYRGHHLKRQYPPLSMLDLQKLIDTNRIDTTKPIDLVAILNTGLFKIYPDQHHFGVQLTDEGADIFDAKINLEVQWCSEHIIAAIERKGGVITSAYYDPHSLQAMVNSKKFFERGIPIPRRMMPPPDAIEHYSDPAQRGYLADPEKISQERLVLAQKYGYTLPKIEKDPAYEMLMXREDPRQIFYGLXPXWVVNLTDKTI

SEQ ID NO: 21002 - protein, 315 aa, Diabrotica virgifera
  misc_feature: Coding regions on vcDNA: vcDNA=SeqID_699; Strand=+; Position=20-964
  misc_feature: Homolog annotation: Hit_ID=CAE47497.1; Match level="QueryCoverage =99%, HitCoverage=99%, E-value=1e-100, Identity=54%"; Hit description= cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=306.9, E -value=3.3e-89, Copies=1"; Pfam description=Papain family cysteine protease
MKVYVVIACLIVTIAAELNGYDHWVSFKAKHSKQYKITEDKLRFQIFQDNLREIEEHNARYAKGEVGWYKGVTPFADWTKEEFKALLTRQAASRPKLNESLGVHVADPNVKLASSVDWRSKGAVLPVRDQASCGSCWAFSTAAALEGQLAIHKNEKIPLSPQNLVDCSTQNDGCDGGDQVLAFKFIKSSGISSEADYPYVGVDQKCHKNVHKTVSTISGYKHLSANENALISALSSIGPISVSVDASVWSLYAGGLFDERDCGTDINHAVLAAGYTDEYILVKKSWGTDWGEEGYIRLPRGHNIWPINEENSYPI

SEQ ID NO: 21003 - protein, 264 aa, Diabrotica virgifera
  misc_feature: Coding regions on vcDNA: vcDNA=SeqID_700; Strand=+; Position=118-909
  misc_feature: Homolog annotation: Hit_ID=XP_320768.1; Match level="QueryCoverage =90%, HitCoverage=62%, E-value=6e-77, Identity=58%"; Hit description =ENSANGP00000014171 [Anopheles gambiae]
  misc_feature: Gene Ontology Annotation: Molecular function=tryptophan-tRNA ligase activity; Cellular component=soluble fraction; Biological process =protein biosynthesis
  misc_feature: Pfam annotation: Pfam_ID=tRNA-synt_1b; Match level="Score=174.2, E -value=2.7e-49, Copies=1"; Pfam description=tRNA synthetases class I (W and Y)
  misc_feature (213)..(213): Xaa can be any naturally occurring amino acid
  misc_feature (232)..(232): Xaa can be any naturally occurring amino acid
MFARNKLFPKFSKRLFCSKSIKTETKYQKRIFSGIQPTGAIHLGNYLGAIAQWVKLQDQGEHVILAIADLHSMTLPHEPKILLRNIQEIAATLLACGIDPNKTILFQQSKVAVHTQLSWCLGCICTMPRLAHLPQYKEKSKDLKDIPLGLFVYPVLQAADILAYKATHVPVGEDQIQQIQLSQDLARMFNKKFGETFPIPHALTTGSEYARLXKLRDPSKKMSKSDPDPKSXICLTDRPDDIVRNIKKAELIPFRGHLTIPQRK

SEQ ID NO: 21004 - protein, 168 aa, Diabrotica virgifera
  misc_feature: Coding regions on vcDNA: vcDNA=SeqID_701; Strand=+; Position=116-622
  misc_feature: Homolog annotation: Hit_ID=EAL28603.1; Match level="QueryCoverage =95%, HitCoverage=93%, E-value=3e-64, Identity=71%"; Hit description =GA20031-PA [Drosophila pseudoobscura]
  misc_feature: Gene Ontology Annotation: Cellular component=extracellular space
MEFQPLILVFLALVLAANALKPNECEVCIKTLNKFSATLDESTRKDPKKIETEFKKYCKGLKNKEHRLCYYLGGLEESATGILGEMSKPLSWSMPSDKICEKLKKKDAQICELRYDVEIDLKTVDLKKLKVRDLKKILNDWGEDCEGCIEKSEYLKRIEDLKPKHVDL

SEQ ID NO: 21005 - protein, 175 aa, Diabrotica virgifera
  misc_feature: Coding regions on vcDNA: vcDNA=SeqID_702; Strand=+; Position=284-808
  misc_feature: Homolog annotation: Hit_ID=NP_998451.1; Match level="QueryCoverage =100%, HitCoverage=29%, E-value=8e-65, Identity=64%"; Hit description= zgc:85809 [Danio rerio] gb|AAH68394.1| Zgc:85809 [Danio rerio]
  misc_feature: Gene Ontology Annotation: Molecular function=zinc ion binding; Cellular component=cellular_component unknown; Biological process =leukotriene metabolism
  misc_feature: Pfam annotation: Pfam_ID=Peptidase_M1; Match level="Score=-155.0, E -value=0.00093, Copies=1"; Pfam description=Peptidase family M1
IHIEYETAPDASGLQWLQPQTTAGKIHPFLFSQFQPTHARSVIPCQDTPAVKHPYRATISAPKELEVLMSAINEGSKVIGDKKQYSFYQQIPVPSYLIALAVGALESRRLGPRSHVWAEKELIEESAYEFAETEHQLKTAEDICGPYVWGIYDLLVLPPSFPYGGMENPCLTFVT

SEQ ID NO: 21006 - protein, 552 aa, Diabrotica virgifera
  misc_feature: Coding regions on vcDNA: vcDNA=SeqID_703; Strand=+; Position=121-1776
  misc_feature: Homolog annotation: Hit_ID=XP_319027.1; Match level="QueryCoverage =97%, HitCoverage=83%, E-value=1e-146, Identity=50%"; Hit description= ENSANGP00000013312 [Anopheles gambiae]
  misc_feature: Gene Ontology Annotation: Molecular function=zinc ion binding; Cellular component=cellular_component unknown; Biological process =leukotriene metabolism
  misc_feature: Pfam annotation: Pfam_ID=Peptidase_M1; Match level="Score=311.7, E -value=1.1e-90, Copies=1"; Pfam description=Peptidase family M1
  misc_feature (521)..(521): Xaa can be any naturally occurring amino acid
MVKAGLSPCDPSSFSRPDQVIVTELFLNLDVNFESKTLHGHAILSINKIDETATELVLDTFKLNITSIFDADKNCTEKLEYTLSDHLEDFGSKLTIQLPQKEVKKIHIEYETAPDASGLQWLQPQTTAGKIHPFLFSQFQPTHARSVIPCQDTPAVKHPYRATISAPKELEVLMSAINEGSKVIGDKKQYSFYQQIPVPSYLIALAVGALESRRLGPRSHVWAEKELIEESAYEFAETEHQLKTAEDICGPYVWGIYDLLVLPPSFPYGGMENPCLTFVTPTLLAGDRSLANVIAHEISHSWTGNLVTNKTFEHFWLNEGFTMLVERKIISRLVSPQMQDFDAYTGISDLKEAIEVLGADSPLTHLIVDLKGVHPDEAFSTVPYEKGQTFLRYLEKTVGGPDKFEPFLRSYFDTFKYKSIDSTDFKNFFENYFESEPEIKNIDWDKWLHTPGMPLTIPDYDTSLAEACDQLLEKFYNWTGEGSLPISAEEKQQLIPEQLIYFLQKLSEAESQPIPKLVALXELFGFDGVKNSEIKFRWLKTGIKANGKYKSN

SEQ ID NO: 21007 - protein, 213 aa, Diabrotica virgifera
  misc_feature: Coding regions on vcDNA: vcDNA=SeqID_704; Strand=+; Position=103-744
VTMHQLFTVFVTGVCFFNCAGSEEYVSELKDAQHKRNTDTHESYYRTGIESYHNQEGYGPPHHHHNGYPHPDAEPRSYSGSNADSWNDYQTRHRIPLPNPFNTPQDYQPRQRIPGHNSFNPPHEYEPRHRIPVQLSFNPPHNHDTSNCESCDDDRNARNNRKPEVAVTKYANNSAKEIPRDYLEKLDMYDVDDILLNYLDGYEDDDPDAIIFK

SEQ ID NO: 21008 - protein, 114 aa, Diabrotica virgifera
  misc_feature: Coding regions on vcDNA: vcDNA=SeqID_705; Strand=+; Position=55-399
  misc_feature: Homolog annotation: Hit_ID=EAA12431.3; Match level="QueryCoverage =76%, HitCoverage=78%, E-value=5e-35, Identity=72%"; Hit description =ENSANGP00000019940 [Anopheles gambiae str. PEST] ref|XP_555019.1| ENSANGP00000019940 [Anopheles gambiae st
  misc_feature: Pfam annotation: Pfam_ID=DUF1674; Match level="Score=87.0, E-value =4.9e-23, Copies=1"; Pfam description=Protein of unknown function (DUF1674)
MSILMYMLRTMRNSAFSPLHSTWKDSVMNLSSGKDPVSKNPISPRVEEFRKKLQQKTPIGKLDEQMGKHPYEEEQPLPPWPNNTNPHTGEVGGPRGPEPTRYGDWERKGRVSDF

SEQ ID NO: 21009 - protein, 108 aa, Diabrotica virgifera
  misc_feature: Coding regions on vcDNA: vcDNA=SeqID_706; Strand=-; Position=875-1201
NDLGRHQNRINFHILYTHRKEIKHYLGHQHLEQRSLLVLSHSQKRLFIKIAFYFSNEKHGHTKGMTAQSLVTKPLTCLAKLIVKEGAIQTHEKTSYHKECVQVGLDFL

SEQ ID NO: 21010 - protein, 312 aa, Diabrotica virgifera
  misc_feature: Coding regions on vcDNA: vcDNA=SeqID_707; Strand=+; Position=115-1053
  misc_feature: Homolog annotation: Hit_ID=NP_651528.1; Match level="QueryCoverage =44%, HitCoverage=19%, E-value=3e-19, Identity=42%"; Hit description =CG14257-PA [Drosophila melanogaster] gb|AAF56659.1| CG14257-PA [Drosophila melanogaster]
MKVQLWFLLIIHVSCLLGITNAVRSSIYAPLHLISLKDITADERRQIALLEQKLDRAKRSGHPGSGSGSSGSGSGDILNAIKNAIGNSIKKKVGQLAMASASASGAFSKTSSGGGDHHSHHEYYEHHPHPPPHHYESHSSHSSHSSFDFWDLKKSVLNTLLQAVKAIKGGVIAVKGQLIKGGGKLVSASGHLVSSQGDAITNLGKQIATSAILVPWMGSSGKGHPHAEYESDHHYTAPSAPEDIHYHHGPHSDHHEDYHVPEHYPPPHRADAAGLLVLKKVTNRGSHNHREDIHYHHGRTSAPTKHLLVSVL

SEQ ID NO: 21011 - protein, 412 aa, Diabrotica virgifera
  misc_feature: Coding regions on vcDNA: vcDNA=SeqID_708; Strand=+; Position=131-1366
  misc_feature: Homolog annotation: Hit_ID=EAA08143.2; Match level="QueryCoverage =90%, HitCoverage=68%, E-value=4e-82, Identity=43%"; Hit description =ENSANGP00000010831 [Anopheles gambiae str. PEST] ref|XP_563425.1| ENSANGP00000010831 [Anopheles gambiae st
  misc_feature: Pfam annotation: Pfam_ID=AMP-binding; Match level="Score=82.5, E -value=1.1e-21, Copies=1"; Pfam description=AMP-binding enzyme
MSVLRRVLFKRLFLPKFNPKVTTNGFATDSNSSGFITTSDTVEVPKCSLNEYVFQNVHLWENCIATECAVTGRNYTYSQLRTKSKNFGAALRKKFKLEKNDTIAILLPNVPEFPIVTLGAIRAGLICTTVNPIYTADEISRQLLDSSTKVIVTLNELWPLADAATKQAKKNIPIVTIKSQQSQSVPSGAANFAELADCNSDVPSEESWDSVAFLPYSSGTTGLPKGVMLTHHNIVANVAQIGHPKLLISRQTTPDHQDVVPAVLPMFHIYGLTILSMFQIKLGVKIVTLPKFTPELYIGTLKKHKPNVLYLAPPIAIFLGKVPQVQAEDLKSVRAVINGAAPLGQLDGMRLTEKANKDLPILQGYGLTETSPAVITTRLAEYNKESVKGSLGRPVPNTFRTLVNPRGPVRSS

SEQ ID NO: 21012 - protein, 401 aa, Diabrotica virgifera
  misc_feature: Coding regions on vcDNA: vcDNA=SeqID_709; Strand=+; Position=19-1224
  misc_feature: Homolog annotation: Hit_ID=NP_609157.3; Match level="QueryCoverage =39%, HitCoverage=85%, E-value=6e-27, Identity=46%"; Hit description =CG14534-PA [Drosophila melanogaster] gb|AAF52571.2| CG14534-PA [Drosophila melanogaster]
  misc_feature: Gene Ontology Annotation: Molecular function=molecular_function unknown
  misc_feature: Pfam annotation: Pfam_ID=DUF243; Match level="Score=95.6, E-value =1.3e-25, Copies=1"; Pfam description=Domain of unknown function (DUF243)
MKTSLIVLLLAVSQSYSQGPYNYQRPSNPFDHSSSHSNPFSRFNNGPGFHPSTSVSVVPALSYPVNSLLDQGYNYPRPNGGFDSNLGSPSSNSPNFNSGGNGGYNYQSPNPGFLLPSATRNVNFNSGFNDGPSSGSHHSGSFLSSSSNGVNSGLNGGYNYPIPNSGSHNSGSLLPSGSQNSGSFLNNIPSINYGSPSLSGSLFPSASSNLNSGSPFNNVPSSNYGSPNLFSGDSRPSPSFSNNNGLFPGDSHSSPSFGPVPEQKHVYVYVAPPEPEAESKQLHIPAAPVNHKIIFIKAPSQSASRTHVVPLGADQEKTLVYVLVKKPEDPEVHLRTPAPTLASKPEVYFIRYKTEKDGTGAPSNGLPSVEDNRRGANIGGFDPSSSGSSPNGVSPVYGPSR

SEQ ID NO: 21013 - protein, 418 aa, Diabrotica virgifera
  misc_feature: Coding regions on vcDNA: vcDNA=SeqID_710; Strand=+; Position=18-1274
  misc_feature: Homolog annotation: Hit_ID=NP_651999.1; Match level="QueryCoverage =82%, HitCoverage=90%, E-value=2e-27, Identity=32%"; Hit description =CG5812-PA [Drosophila melanogaster] gb|AAF56656.1| CG5812-PA [Drosophila melanogaster]
  misc_feature: Gene Ontology Annotation: Molecular function=molecular_function unknown; Cellular component=nuclear pore; Biological process=NLS -bearing substrate-nucleus import
  misc_feature: Pfam annotation: Pfam_ID=DUF243; Match level="Score=85.6, E-value =1.3e-22, Copies=1"; Pfam description=Domain of unknown function (DUF243)
MKTSLIVLLLAVSQSYSQGPYNYQRPSNSLDHSASNSHPFSGFNNGLDSSSSHNSGSVVGAGFLGNSGLNQGYNYPRPGGSDLGGSSSSNSLNFNSGGNGGYNYQNPNSGFNLPSASRNVNFNSGFNDGSTSSSHNSGSFLSSSSNGVNSGLNGGYNYPSPNSGSQISGNGNFGLGNNGGNLLSSGSQNSGSFLNNIPSSSYGTPGLSGSLFPSASSNLNNFGNNGLNNLGNNGLNSGSLNTGSLFNNVPSSNYGSPSNNNGQFSDSNSSPSFGPVPQQKHVYVYVAPPDPEAESKQLYIPAAPVNHKIIFIKAPSQSASRTHVVPSGAGQEKTLVYVLVKKPEDPEIHLNAPAPTLASKPEVYFIKYKTNKDGTGAPSNGFPSVDSNRNGGNNQGFDPSSSGSNNVNGVSPVYGPAH

SEQ ID NO: 21014 - protein, 247 aa, Diabrotica virgifera
  misc_feature: Coding regions on vcDNA: vcDNA=SeqID_711; Strand=+; Position=66-805
  misc_feature: Homolog annotation: Hit_ID=XP_393451.1; Match level="QueryCoverage =97%, HitCoverage=80%, E-value=1e-106, Identity=77%"; Hit description= similar to ENSANGP00000018356 [Apis mellifera]
  misc_feature: Gene Ontology Annotation: Molecular function=poly(U) binding; Cellular component=cytoplasm; Biological process=negative regulation of translation
  misc_feature: Pfam annotation: Pfam_ID=RRM_1; Match level="Score=166.5, E-value =5.8e-47, Copies=2"; Pfam description=RNA recognition motif. (a.k.a. RRM, R
  misc_feature (163)..(163): Xaa can be any naturally occurring amino acid
  misc_feature (183)..(183): Xaa can be any naturally occurring amino acid
  misc_feature (185)..(185): Xaa can be any naturally occurring amino acid
MEEYEYGKLFVGGLSWETTQDNLQRYFSRYGEVIDCVVMKNAESGRSRGFGFVTFSDPANVNVVLQNGPHTLDGRTIDPKPCNPRTLQKPKKGGGYPKVFLGGLPSNVTETDLRSFFTRFGKVMEVVIMYDQEKKKSRGFGFLSFEDEEAVDRCVQEHFVNLXGKQVEIKKAEPRDGSGGTKXGXRPASAWGPPSAPMGMMQGPHGQMGGPPMNIGAPMGPNMMQSYPGWGHSPQQQSYASYGTPSG

SEQ ID NO: 21015 - protein, 138 aa, Diabrotica virgifera
  misc_feature: Coding regions on vcDNA: vcDNA=SeqID_712; Strand=+; Position=295-711
  misc_feature: Homolog annotation: Hit_ID=EAL26698.1; Match level="QueryCoverage =94%, HitCoverage=94%, E-value=2e-51, Identity=83%"; Hit description =GA14517-PA [Drosophila pseudoobscura]
  misc_feature: Gene Ontology Annotation: Molecular function=transporter activity; Cellular component=proton-transporting ATP synthase complex (sensu Eukarya)
  misc_feature: Pfam annotation: Pfam_ID=ATP-synt_C; Match level="Score=109.8, E -value=6.7e-30, Copies=1"; Pfam description=ATP synthase subunit C
MFACARLIAPATRSALVANTKQYLRPLSSVVNQSQIQVQNVQQHKQPTLLPAIRSFQTTPVSRDIDSAAKFIGAGAATVGVAGSGAGIGTVFGSLIIGYARNPSLKQQLFSYAILGFALSEAMGLFCLMMAFLLLFAF

SEQ ID NO: 21016 - protein, 124 aa, Diabrotica virgifera
  misc_feature: Coding regions on vcDNA: vcDNA=SeqID_713; Strand=+; Position=106-483
  misc_feature: Homolog annotation: Hit_ID=NP_609948.1; Match level="QueryCoverage =92%, HitCoverage=20%, E-value=6e-35, Identity=61%"; Hit description =CG10687-PA [Drosophila melanogaster] gb|AAF53768.1| CG10687-PA [Drosophila melanogaster]
  misc_feature: Gene Ontology Annotation: Molecular function=asparagine-tRNA ligase activity; Cellular component=soluble fraction; Biological process =protein biosynthesis
  misc_feature (67)..(67): Xaa can be any naturally occurring amino acid
  misc_feature (98)..(98): Xaa can be any naturally occurring amino acid
MSGENKEPIYTSDSQGSDENGDGSEQKPFKTILQAMRKAGAEPFPVIYADGKQEGDKYEPAAKITIXKIQKIWIRESYKQADKSKKEEEDAEKRSKNXEDAKKIALSEDKSLPEAKRIKISDGL

SEQ ID NO: 21017 - protein, 551 aa, Diabrotica virgifera
  misc_feature: Coding regions on vcDNA: vcDNA=SeqID_714; Strand=+; Position=139-1794
  misc_feature: Homolog annotation: Hit_ID=NP_609948.1; Match level="QueryCoverage =98%, HitCoverage=97%, E-value=0.0, Identity=77%"; Hit description =CG10687-PA [Drosophila melanogaster] gb|AAF53768.1| CG10687-PA [Drosophila melanogaster]
  misc_feature: Gene Ontology Annotation: Molecular function=asparagine-tRNA ligase activity; Cellular component=soluble fraction; Biological process =protein biosynthesis
  misc_feature: Pfam annotation: Pfam_ID=tRNA-synt_2; Match level="Score=415.8, E -value=5.1e-122, Copies=1"; Pfam description=tRNA synthetases class II (D, K and N
MSGENKEPIYTSDSQGSDENGDGSEQKPFKTILQAMRKAGAEPFPVIYVDGKEEGVKYEPAAKSQLKKIQKIWVRESYKQADKSKKEEEDAEKRSKNLEDAKKIAISEDKSLPEAKRIKISDGSKNRDKRVKIYGWAHRIRRQGKNLMFVTLRDGTGFLQCILNDKLCQTYNALVLQTESSIVLFGTIKEVPEGKIAPGGHELLVDYWELIGLAPPGGADSILNEQALPDVQAENRHIMIRGENTSKVLRMRSVLLQAFRDHYQDRGYCEITPPSIVQTQVEGGSTLFKMDYFGEEAYLTQSSQLYLETCLPSMGDVYCIAESFRAEQSRTRRHLAEYSHVEAECPFITFDDLLNRLEDLICDVVDRVLKSPYGEIVHELNPNFQVPERPFLRMNYSDAIEYLKKNNITKEDGTFYEFGEDIPEMPERKMTDQINKPIMLCRFPANIKSFYMSKCPEDARLTESVDVLLPNVGEIVGGSMRIWDLDELLAGYKREEIDPAPYFWYTDQRKYGTCPHGGYGLGLERFVCWLLNRYHIREVCLYPRYLHHCKP

SEQ ID NO: 21018 - protein, 293 aa, Diabrotica virgifera
  misc_feature: Coding regions on vcDNA: vcDNA=SeqID_715; Strand=+; Position=151-1032
  misc_feature: Homolog annotation: Hit_ID=EAL26412.1; Match level="QueryCoverage =75%, HitCoverage=47%, E-value=3e-18, Identity=34%"; Hit description =GA18427-PA [Drosophila pseudoobscura]
  misc_feature: Gene Ontology Annotation: Molecular function=G-protein coupled receptor activity; Cellular component=integral to membrane; Biological process=G-protein coupled receptor protein signaling pathway
  misc_feature: Pfam annotation: Pfam_ID=LRR_1; Match level="Score=91.1, E-value=2.8e- 24, Copies=9"; Pfam description=Leucine Rich Repeat
MMFVKEVLVLFLFATLDIVSGEICTNSSESGCDCRQFTNPKTHLPTYYADCRSRSLQDVPGNIEHIIHILDLSINNIQTLDPKKYSLSSENLEELSLSYNNITFIDVSFFQNLRKLKRLDLSNNFITSLDNAGVFQNLVHLVKLDLSFNNLKSLPDSIFNPLNKLTHLDLSYNYLNKFLTQSKEVLADKLGVTSNLTHLRLGGLALKELPAGYFDNLTALKGLSLADNEFELIPTVPYTLEHLDLSGNQFTFISAKYLNYHSLKSLKLNRMASLTDIHHYAFYISSLWKIDYQ

SEQ ID NO: 21019 - protein, 240 aa, Diabrotica virgifera
  misc_feature: Coding regions on vcDNA: vcDNA=SeqID_716; Strand=+; Position=2-724
  misc_feature: Homolog annotation: Hit_ID=NP_650287.3; Match level="QueryCoverage =95%, HitCoverage=98%, E-value=3e-32, Identity=32%"; Hit description =CG9796-PA [Drosophila melanogaster] gb|AAF54945.2| CG9796-PA [Drosophila melanogaster]
  misc_feature: Gene Ontology Annotation: Biological process=regulation of protein activity, epigenetic
  misc_feature: Pfam annotation: Pfam_ID=GILT; Match level="Score=108.0, E-value=2.4e- 29, Copies=1"; Pfam description=Gamma interferon inducible lysosomal
ITLPGSSAVINKHKMESVTVLFVLCFAGISVQAADLKVSVYYESLCPDSIKFIKDQFNPAYSTVLKDKINVDFVPFGKATAIKSNGTWSFTCQHKEPECYGNKVQSCAIDIASYNTSIEFVVCAMKSGDASDDELLKQCAEDNQIKWDDIDNCLKSGKGDELLAKYGDRTNAVTPKITFIPTIVFNDVYTDKLQELALKDFLTVSEVLLEKPDCSKCSSSRIALSIAVLLLPLISMLKLR

SEQ ID NO: 21020 - protein, 403 aa, Diabrotica virgifera
  misc_feature: Coding regions on vcDNA: vcDNA=SeqID_717; Strand=+; Position=229-1439
  misc_feature: Homolog annotation: Hit_ID=NP_733011.2; Match level="QueryCoverage =96%, HitCoverage=45%, E-value=1e-150, Identity=63%"; Hit description= CG6643-PB, isoform B [Drosophila melanogaster] gb|AAN14000.2| CG6643 -PB, isoform B [Drosophila
  misc_feature: Gene Ontology Annotation: Molecular function=molecular_function unknown; Cellular component=cellular_component unknown; Biological process=biological_process unknown
  misc_feature: Pfam annotation: Pfam_ID=C2; Match level="Score=100.2, E-value=5.4e -27, Copies=1"; Pfam description=C2 domain
  misc_feature (96)..(96): Xaa can be any naturally occurring amino acid
  misc_feature (386)..(386): Xaa can be any naturally occurring amino acid
MEKKNTENEVIEKKSAESTSIISILFSAVKKASVVGVVYLAGYMQWSVAWFIGPVVLFVIRDQWKKTSDRKRAIAKATALSSEQEVVLARLDDLPXAWVFFPDIERGEWINRIIKQVWPNVNQYVRELVRDAIQPALRESLEKYKLTGFKFERIILGTVPFRIGGVKVYDKNTDRNEIVMDLDIFYAGDCDITFHLKGMKGGIRDFQLHGMLRVVMKPLITSIPLIGGLQVFFLNNPDIDFDLVGIADVLDMPGLSDILRRIVVETVASMMVLPNKFPIKLSEEVEAVELKAPEPEGVLRVHVFEASHLMKKDISVLGKGKSDPYAVVTVGAQEFKTKVIDNTVDPKWDFWCEFQILESNGQQLYVHLWDKDDTGGDENLGRATIXISNIVKKGHDDMGGTFF

SEQ ID NO: 21021 - protein, 54 aa, Diabrotica virgifera
  misc_feature: Coding regions on vcDNA: vcDNA=SeqID_718; Strand=-; Position=10-174
TCLLPMQTATVFIEQNIMAIDGACRAKYVGARLFRNTILPYRQSLREVYGNLKL

SEQ ID NO: 21022 - protein, 88 aa, Diabrotica virgifera
  misc_feature: Coding regions on vcDNA: vcDNA=SeqID_719; Strand=+; Position=211-477
  misc_feature: Homolog annotation: Hit_ID=XP_312266.1; Match level="QueryCoverage =100%, HitCoverage=100%, E-value=7e-38, Identity=78%"; Hit description=ENSANGP00000002801 [Anopheles gambiae] gb|EAA07677.2| ENSANGP00000002801 [Anopheles gambiae
  misc_feature: Pfam annotation: Pfam_ID=LSM; Match level="Score=88.8, E-value=1.4e -23, Copies=1"; Pfam description=LSM domain
MSAAMPINPKPFLNGLTGKAVIVKLKWGHEYKGYLVSADGYMNLQLANTEEYIEGKPTGTLGEVLVRCNNILYIRGAEDDDEEGEMRE

SEQ ID NO: 21023 - protein, 366 aa, Diabrotica virgifera
  misc_feature: Coding regions on vcDNA: vcDNA=SeqID_720; Strand=+; Position=31-1128
  misc_feature: Homolog annotation: Hit_ID=NP_502868.1; Match level="QueryCoverage =75%, HitCoverage=29%, E-value=4e-25, Identity=29%"; Hit description =predicted CDS, C2H2 type zinc finger containing protein family member (4Q281) [Caenorhabditis
MNIRKLKIQGSNKINGYCPARINVKLMDNEKYIVNFCQTHVGHSPEQDLGHLFLSKSDKQNVAAKIAAKIPFQIILDEIRDSVSNSRLERLHLLKKKDLYNIEKCFNLCSSSVRHENDAISVDAWVSEMKSSECVLFYKPQETICQENPELQYEDFFLIIMSDGQKDLLLRFGEDCICIDGTHGLNAYGFELHTILVLDDLREGYPTAFLISNRSDSIGMKIFFQCIKERVGKAIKPKVFMSDMADFYYKSWMQVMQPAEFRLYCTWHVDKAWRKNLEKVLNKEKKVQVYHMLRTLLQETDSTAFNQLLLNFLKYLKEDSDTLEFAMYFEQYYACKAEQWAYCFKLHCGLNTNMHIERMHRTNKHI

SEQ ID NO: 21024 - protein, 304 aa, Diabrotica virgifera
  misc_feature: Coding regions on vcDNA: vcDNA=SeqID_721; Strand=+; Position=28-939
  misc_feature: Homolog annotation: Hit_ID=XP_314922.1; Match level="QueryCoverage =90%, HitCoverage=77%, E-value=6e-58, Identity=42%"; Hit description =ENSANGP00000012375 [Anopheles gambiae]
  misc_feature: Gene Ontology Annotation: Molecular function=protein phosphatase type 2A, intrinsic regulator activity; Cellular component=cytoplasm; Biological process=signal transduction
  misc_feature: Pfam annotation: Pfam_ID=TAP42; Match level="Score=163.4, E-value =4.8e-46, Copies=1"; Pfam description=TAP42-like family
MAQNAKDTGEADIETLCSMFKEGLNNYNSILNSDQPTNSNELQTQIKKTMKTFEQATRLVSLSSIFSTNEGIEEIPTNDLQYLLLPAFLGSLSLKLTSGERKDIVDVAEIYFKDFLKRCNDYGMSNYQFKEKHKNDEKEQRERTDLEKLEYSVNTRANKIQRFKEQKELKSKLEDLKTNMENEHVDDEIKRKYFLTMIKLFIYESIDELNSIDMEKPILEHMANMKKEEKPQPKRPPPPPLRPIVITKDEVQKAVFGAGYPSLPVMTVEEFYQKRVEDGIFPDPNKPRQGPMSFTDAATSGVSL

SEQ ID NO: 21025 - protein, 362 aa, Diabrotica virgifera
  misc_feature: Coding regions on vcDNA: vcDNA=SeqID_722; Strand=+; Position=12-1096
  misc_feature: Homolog annotation: Hit_ID=XP_393173.1; Match level="QueryCoverage =97%, HitCoverage=7%, E-value=2e-87, Identity=52%"; Hit description =similar to Hypothetical protein CBG09037 [Apis mellifera]
  misc_feature: Pfam annotation: Pfam_ID=zf-C2H2; Match level="Score=21.5, E-value =0.0025, Copies=2"; Pfam description=Zinc finger, C2H2 type
  misc_feature (283)..(283): Xaa can be any naturally occurring amino acid
  misc_feature (306)..(306): Xaa can be any naturally occurring amino acid
  misc_feature (327)..(327): Xaa can be any naturally occurring amino acid
  misc_feature (343)..(343): Xaa can be any naturally occurring amino acid
  misc_feature (346)..(346): Xaa can be any naturally occurring amino acid
  misc_feature (350)..(350): Xaa can be any naturally occurring amino acid
MATNNYFGFTHGGTQYGATTGAYQAGQAGYAVATPATAAAAATYGTQRPTSYDTAYQAAAAASQGTYAAVGTTATPAYEYGYGQTAATGYTSGYDQTAAAAAAVAAAAKPASYATTYTQRTTSQQAQQAAAFQSAAVAAAAVVKQPAQYTATYQPTATAYQTTYPQPAAAQTTIAAQPTTQAKRYDAALYSAATMYVAQQSGTAQHKAVGWQNYKKPGIGAKTARPKAPPKPQQLHYCDVCKISCAGPQTYREHLEGQKHKKREAATKMAASVAVTTQNRAGXSLRCQLCDVTCTGYDAYAAHIRXAKHQKVVLLHTKLGKPIPPQXPEVLGGIKKSVSSTPXNHXVASXRLCGCWGMEMHQ

SEQ ID NO: 21026 - protein, 885 aa, Diabrotica virgifera
  misc_feature: Coding regions on vcDNA: vcDNA=SeqID_723; Strand=+; Position=13-2670
  misc_feature: Homolog annotation: Hit_ID=XP_393173.1; Match level="QueryCoverage =96%, HitCoverage=18%, E-value=0.0, Identity=55%"; Hit description =similar to Hypothetical protein CBG09037 [Apis mellifera]
  misc_feature: Gene Ontology Annotation: Molecular function=DNA binding; Cellular component=cellular_component unknown; Biological process=biological _process unknown
  misc_feature: Pfam annotation: Pfam_ID=DZF; Match level="Score=347.6, E-value=1.8e -101, Copies=1"; Pfam description=DZF
MATNNYFGFTHGGTQYGATTGAYQAGQAGYAVATPATAAAAATYGTQRPTSYDTAYQAAAAASQGTYAAVGTTATPAYEYGYGQTAATGYTSGYDQTAAAAAAVAAAAKPASYATTYTQRTTSQQAQQAAASAAVAAAAVVKQPAQYTATYQPTATAYQTTYPQPAAAQTTIAAQPTTQAKQTNSTTTYSGYDAALYSAATMYVAQQSGTAQHKAVGWQNYKKPGIGAKTARPKAPPKPQQLHYCDVCKISCAGPQTYREHLEGQKHKKREAATKMAASVAVTTQNRAGNSLRCQLCDVTCTGNDAYAAHIRGAKHQKVVLLHTKLGKPIPPHEPEVLGGSKKSVSSTPKINFVASGGLGVAAGNGDASKDEDDDIIEPDIQPVGQDYIEEIKSDDGKVISFNCKLCECRFNDPNAKEMHMKGRRHRLQYKKKVNPELVVDVKPSLRQRRIQEEKLRRAQLREEFWARRHYPDVNESLYWEEQRRYEDEYMMGHGNMPFQRGRPFPGGQGPPGVLSRRAESSDDKHVMARHAEIYPKEEELQAIQRIVSHTERALKVVSDQMGDGKNKAPEAKPDEKAEPQQKEDGRDNQLFSFQQGDQNRILKGVMRVGHLAKGLLLRGDTNVELVVLCADKPTLTLLKKVVEILPSALKQVAPESAYTVAINASEAGLIIAGDSLTVLVQFTSPVIREQPEAASGGFDRDVLSRGKCLQALAALRHTKWFQARALGLHSCVIIIRILRDLCQRVPTWSPLSPWAMELLAEKVISSVPGQAQLSPGDALRRVMEAVASGLLLPGGPGLADPCEKDNPDASGALNAQQREDLTCSAQYALRLIAYRQIYKVLGMDPLPAPQKSFRRVGITRKRRLSGSGQDGSESDTGKMVKTQN

SEQ ID NO: 21027 - protein, 332 aa, Diabrotica virgifera
  misc_feature: Coding regions on vcDNA: vcDNA=SeqID_724; Strand=+; Position=34-1032
  misc_feature: Homolog annotation: Hit_ID=AAK16732.1; Match level="QueryCoverage =30%, HitCoverage=100%, E-value=2e-09, Identity=34%"; Hit description= cystatin [Acipenser schrenckii] gb|AAK16731.1| cystatin [Acipenser sinensis]
  misc_feature: Pfam annotation: Pfam_ID=Cystatin; Match level="Score=127.0, E-value =4.4e-35, Copies=2"; Pfam description=Cystatin domain
MIFKQLLLLVFCVLGALGQVVIDSGPPNLYNYGNIDDVQFDNEPEPEPVQTKVGCAGCPTDIDPKAEGVQKLVNAALSHIESERDTKHVAVKVLRVQTQVVAGIKYILSVEVASTSCPKNTENLDCSVQDSRVCDVEYLEQPWLGVSKIISNTCTKSQEFDLKEPIDPPPPKKVHRELEPDFLSDLESQIIPDSPKSEKENSVQFDDVVESKPCLGCLTEVDVNDKVVPFLVNAALSHIESEDKVQQALIQVLRVQSQVVAGIKYKFLVEVAPTVCPAEPGAKPCYVDRRQNSRVCEVEYWEKAWLGFKKIVSNNCTKSQEFELLDPVTVPL

SEQ ID NO: 21028 - protein, 202 aa, Diabrotica virgifera
  misc_feature: Coding regions on vcDNA: vcDNA=SeqID_725; Strand=+; Position=20-628
  misc_feature: Homolog annotation: Hit_ID=XP_395111.1; Match level="QueryCoverage =99%, HitCoverage=98%, E-value=1e-65, Identity=59%"; Hit description =similar to CG1669-PA [Apis mellifera]
  misc_feature: Gene Ontology Annotation: Molecular function=signal transducer activity; Cellular component=plasma membrane; Biological process =small GTPase mediated signal transduction
  misc_feature: Pfam annotation: Pfam_ID=Ras; Match level="Score=2.9, E-value=1.5e -09, Copies=1"; Pfam description=Ras family
MVKISKVVVCGMKGIGKSSILEQVIYGHANTKLDLHPTIEDIYVANIESDKGTREKLRFYDTAGIEFSQISTSNGMTSQQLPRHYLQIADGYILVYDTSKSTSLDILVALKKDIDKNKDKKEVSIVVIGNHFKEEANEEMNLIVSKASQWCMREKVKHFTASALKRASLYEPFVYITSKLMPPPSKSSFTPLSMGRKVIKDS

SEQ ID NO: 21029 - protein, 220 aa, Diabrotica virgifera
  misc_feature: Coding regions on vcDNA: vcDNA=SeqID_726; Strand=+; Position=112-774
  misc_feature: Homolog annotation: Hit_ID=AAD54938.1; Match level="QueryCoverage =96%, HitCoverage=95%, E-value=1e-48, Identity=45%"; Hit description =glutathione s-transferase 6B [Musca domestica]
  misc_feature: Gene Ontology Annotation: Molecular function=glutathione transferase activity; Cellular component=cellular_component unknown; Biological process=glutathione conjugation reaction
  misc_feature: Pfam annotation: Pfam_ID=GST_N; Match level="Score=73.2, E-value=7.3e- 19, Copies=1"; Pfam description=Glutathione S-transferase, N-terminal
MAPKLYGDSRSPCVRAVLLAAEAMKIKLEYVAIDVVKKEHLTDEYLKLNSRHTVPTLEDDGFVMWDSHAIMMYLGEKYGNDNPVYPKDIKKRALINQKLLFDAGDLFSFSRYIAGFFLYKRQPNFPQDLAEALNKAYGFLETFLTESKYVAGDEMTIADFSLWTSTSNSNSFVPIDAAKYPKVTAWSKKMGELPYSHLNFEGYQEFKKLLEILKAQLKAQ

SEQ ID NO: 21030 - protein, 483 aa, Diabrotica virgifera
  misc_feature: Coding regions on vcDNA: vcDNA=SeqID_727; Strand=+; Position=1-1452
  misc_feature: Homolog annotation: Hit_ID=XP_395212.1; Match level="QueryCoverage =97%, HitCoverage=70%, E-value=0.0, Identity=30%"; Hit description =similar to ENSANGP00000012507 [Apis mellifera]
  misc_feature: Gene Ontology Annotation: Molecular function=microtubule binding; Cellular component=plasma membrane; Biological process=neuromuscular synaptic transmission
  misc_feature: Pfam annotation: Pfam_ID=Spectrin; Match level="Score=303.8, E-value =2.8e-88, Copies=4"; Pfam description=Spectrin repeat
LFLLNRDVGDLEQWIADREVVASSHELGQDYDHVTLLWERFKEFAHDTEAIGSERVAAVNDVADQLIAAGHSDSALIAEWKDGLNEAWQDLLELIETRTQMLAASRELHKFFHDCKDVLSRIVEKQVSMSDELGRDAGAVNALQRKHQNFLQDLQTLQSNVQQIQEESAKLQASYAGDRAKEITNREQEVVAAWAALQIACDQRHGKLSDTGDLFKFFNLVRTLMQWMDEWTRQMNTSEKPRDVSGVELLMNNHQTLKAEIEAREDNFTACISLGKELLSRNHYASADIKDKLVALTNQRNAVLQRWEERWENLQLILEVYQFARDAAVAEAWLIAQEPYLMSQELGHTIDDVENLIKKHEAFEKSAAAQEERFSALERLTTFELREIKRKQEAAQAEERARQEKEEAERLAAIAASQPKEIETMVTDRPDAGSPAAEERPVHEERHTRPQTLPLYACANEHPKSGTTSSFTNTPKQRNEMTN

SEQ ID NO: 21031 - protein, 485 aa, Diabrotica virgifera
  misc_feature: Coding regions on vcDNA: vcDNA=SeqID_728; Strand=+; Position=2-1456
  misc_feature: Homolog annotation: Hit_ID=NP_651391.1; Match level="QueryCoverage =94%, HitCoverage=68%, E-value=1e-113, Identity=43%"; Hit description= CG11909-PA [Drosophila melanogaster] gb|AAF56462.1| CG11909-PA [Drosophila melanogaster]
  misc_feature: Pfam annotation: Pfam_ID=Glyco_hydro_31; Match level="Score=-66.8, E -value=3.7e-10, Copies=1"; Pfam description=Glycosyl hydrolases family 31
DVAFRFLPGTSLSVISTTNNTQEVLKDCFFTAFPSASTQWYGGPERRVQTWPLQHMRISQSSPYISRKDDNHAVAERYWLNSLGIYIYLSEENPLFVSQNEDDSKDQVCFISKVQSPYINRDQNILEYVIYFSDDPAAAHLNAVNTYLGKPNGYPNPKMIKEPIWTTWAKYKAPITDDIVIEFAKSIRENGFENGQLEIDDAWEKCYGAQEFSEEKFSKISDTVKQLKDMDFRVTLWVHPFVNEDCKYRSDEGIQGDFFVKGVNGLNNATWWNGNGNGHQIDFTNPKAAEWYTDRLKKLQTNPGIDSFKFDAGEADYAEQPAVFPYVSRAEQNLLPNLLTTEYIKTCANFGDLIEVRSAFRNQNSSNFVRMLDKDSRWDMQNGLPTLVTTLFQLNLNGYPLVLPDMIRGNGYGGNVPTAELIVRWTQANTFMPSMQFTYLPWEFNSDEFTTLEIVKKYVSLHEQYSDVIIKAMVRSVSDSSPVNP

SEQ ID NO: 21032 - protein, 257 aa, Diabrotica virgifera
  misc_feature: Coding regions on vcDNA: vcDNA=SeqID_729; Strand=+; Position=25-798
  misc_feature: Homolog annotation: Hit_ID=XP_308540.1; Match level="QueryCoverage =98%, HitCoverage=81%, E-value=1e-41, Identity=39%"; Hit description =ENSANGP00000016576 [Anopheles gambiae]
  misc_feature: Gene Ontology Annotation: Molecular function=G-protein coupled photoreceptor activity; Cellular component=cellular_component unknown; Biological process=fatty acid biosynthesis
  misc_feature: Pfam annotation: Pfam_ID=ELO; Match level="Score=-38.3, E-value=3.8e -09, Copies=1"; Pfam description=GNS1/SUR4 family
MALVLRKLKDVYLYSEERSDPKNVGIVTNPLFIVSFVVLYVLLVKKIGPSFMKNRQPYNIRSILIVYNIFQILVNVYLLAKALYFYAHSPYYICFQSTKVHILDLGRWEIFLLKAFDCIETIFFVLKKNYRQVSFLHVYHHGGMALLTWVGLKYDWGQLVVILPLLNCFVHALMFTYYLLTSIDPKWKKRVDIKKALTQLQLIQFAMFVVQAIGTMVIPGCDNPSYLGTVAWISQNLFMTLLFGDFYIKTYWRKKSE

SEQ ID NO: 21033 - protein, 189 aa, Diabrotica virgifera
  misc_feature: Coding regions on vcDNA: vcDNA=SeqID_730; Strand=+; Position=32-601
  misc_feature: Homolog annotation: Hit_ID=XP_393701.1; Match level="QueryCoverage =99%, HitCoverage=98%, E-value=1e-58, Identity=58%"; Hit description =similar to KIAA0102 protein [Apis mellifera]
  misc_feature: Gene Ontology Annotation: Cellular component=integral to membrane
  misc_feature: Pfam annotation: Pfam_ID=SPC25; Match level="Score=287.5, E-value =2.1e-83, Copies=1"; Pfam description=Microsomal signal peptidase 25 kDa sub
MAPKEKDDEIVSINKWDGVAVKNALDDAVKEVLTKKYNYAENFALMDGRLVICGIAVGVAMFALIWDYLYPFPQSKPILIFSVTTYFFMMGILTLYTTYKEKGIFAVCIQKDSSKKENTWEASSYIQKYDDKYTLNLAYIDGKTRQRREQSIKRSIARYIDQQGTVVKENVEDEITKMHNSLLSERKEK

SEQ ID NO: 21034 - protein, 346 aa, Diabrotica virgifera
  misc_feature: Coding regions on vcDNA: vcDNA=SeqID_731; Strand=+; Position=70-1110
  misc_feature: Homolog annotation: Hit_ID=XP_317734.1; Match level="QueryCoverage =95%, HitCoverage=66%, E-value=2e-82, Identity=45%"; Hit description =ENSANGP00000010350 [Anopheles gambiae]
  misc_feature: Gene Ontology Annotation: Molecular function=molecular_function unknown; Cellular component=cellular_component unknown; Biological process=biological_process unknown
MVQEDLFEIKKNEKLGRYAVAKKNLKAGYVIFSEKPFAYGPKSDSPCICLGCYTYLESQNLCSKCSWPVCSPECENKPVHKYFECEVFSKAKVKFQLVDDPSETCLQYECITPLRVLLSKEKDPKRWEEEIQHMEPHNDIRKQKPIWEFNQHNVVEYLRSVCKQDRFSEELIHTVCGILDINAFEARTPEGSAVRCLFPKLAIMSHNCISNIHHAVDGKGSGAFDDFSVTVRAAVDVPSGKELHSSYTYSLWPTLVRREFLRESKFFDCTCERCSDKSELGTHSSTLKCQKCDNGIIMSTDPLDDKCEWKCTLCEFKTSAIAVRKVCAAIQADLDTVEYIFGPEGK

SEQ ID NO: 21035 - protein, 98 aa, Diabrotica virgifera
  misc_feature: Coding regions on vcDNA: vcDNA=SeqID_732; Strand=+; Position=228-521
  misc_feature (73)..(73): Xaa can be any naturally occurring amino acid
  misc_feature (76)..(76): Xaa can be any naturally occurring amino acid
  misc_feature (89)..(89): Xaa can be any naturally occurring amino acid
YIASRDSGCNFLCWELRLPRLSCPKVPAAFKFFCRYSVLPLVTPCIDMNTLKHTLISWETPLRLTLTLLAVPXLTXQAFELRLYKRILXNTCKDKVTN

SEQ ID NO: 21036 - protein, 127 aa, Diabrotica virgifera
  misc_feature: Coding regions on vcDNA: vcDNA=SeqID_733; Strand=+; Position=280-659
  misc_feature: Homolog annotation: Hit_ID=EAA01897.2; Match level="QueryCoverage =99%, HitCoverage=39%, E-value=4e-42, Identity=66%"; Hit description =ENSANGP00000000039 [Anopheles gambiae str. PEST] ref|XP_561511.1| ENSANGP00000000039 [Anopheles gambiae st
  misc_feature: Gene Ontology Annotation: Molecular function=molecular_function unknown; Cellular component=nucleus; Biological process=septin assembly and septum formation
  misc_feature (104)..(104): Xaa can be any naturally occurring amino acid
  misc_feature (120)..(120): Xaa can be any naturally occurring amino acid
NMASAVPEHCPGVESENAGRASACAGCPNQNICASSDPKKPDPGIDLVKERLADVDNKILILSGKGGVGKSTVTAILSRTIASSHSEKNVAVLDIDICGPSQPXRVLGVQDESVHQSGSXGWSPIYG

SEQ ID NO: 21037 - protein, 336 aa, Diabrotica virgifera
  misc_feature: Coding regions on vcDNA: vcDNA=SeqID_734; Strand=+; Position=1-1011
GDNKATVTLDEQFAFSNRDDPKSVTLTTDNYQKNFIIKFTDGKWTITVDQNLDADTLNSNDIVMSVIATDSTTKDVGECTLLMTLPKINSKDAPRFDKPYYQSECDDATTSLDVEIAITNKDDLSDINVSILEQDYKDNFNITFDDAAKVWKIAVLSVPKIKTSTNDLLLTLIATEKGNEELGQAALVLNFLAVTAPKFSSIQYRGSYKAAEVSSFEIGDIKITNKDKQDDIQLKLSLDSDSDISKYFKFTLTDNVWKVTLKDPLPDDDIKGKTELVLTLSATEKNNDEIGYATVIIALEDNVGTSDLTFSDVYYSADYIKSSPLPDIELNKEHLF

SEQ ID NO: 21038 - protein, 300 aa, Diabrotica virgifera
  misc_feature: Coding regions on vcDNA: vcDNA=SeqID_735; Strand=+; Position=6-908
  misc_feature: Homolog annotation: Hit_ID=AAH46858.1; Match level="QueryCoverage =96%, HitCoverage=43%, E-value=6e-60, Identity=41%"; Hit description =Loc89944-prov protein [Xenopus laevis]
  misc_feature: Gene Ontology Annotation: Molecular function=beta-galactosidase activity; Cellular component=lysosome
  misc_feature: Pfam annotation: Pfam_ID=Glyco_hydro_35; Match level="Score=212.4, E -value=9e-61, Copies=1"; Pfam description=Glycosyl hydrolases family 35
  misc_feature (295)..(295): Xaa can be any naturally occurring amino acid
MKILKLSPILLTFITFCLAQDLPTNYEYFTESGIKSGITTNETHFFLNGKPFFIYSGSVHYFRIPRTYWRTRLRQLRAAGLNTVETYLPWNLHEPYNGTFDFGSSGSDMQDFLDLESFLKLAQEEDLFVILRPGPFISAEYNFGGFPSWLLRGKPMGFRTDEDNYNHHISRYFNYFLKKLLPYKFLKGGPIIAFQVENEYGYTNYKDFFKPSKRYLGLLQQLYIDNDLADFLVTSDNPIAEGDSGTLPGVLFQTTNFGDSPENYLKRLSELQPNKPLMVMEFWIGWFDHWTDNHXTRDPR

SEQ ID NO: 21039 - protein, 290 aa, Diabrotica virgifera
  misc_feature: Coding regions on vcDNA: vcDNA=SeqID_736; Strand=+; Position=441-1314
  misc_feature: Homolog annotation: Hit_ID=XP_312564.1; Match level="QueryCoverage =93%, HitCoverage=45%, E-value=3e-52, Identity=41%"; Hit description =ENSANGP00000014256 [Anopheles gambiae]
  misc_feature: Gene Ontology Annotation: Molecular function=carboxylesterase activity; Cellular component=synaptic junction
  misc_feature: Pfam annotation: Pfam_ID=COesterase; Match level="Score=34.2, E-value= 1.5e-12, Copies=1"; Pfam description=Carboxylesterase
  misc_feature (267)..(267): Xaa can be any naturally occurring amino acid
MIMNAIKLLQLFLLVATIEKSATRSFKDDGTIVHLDEGKIRGHILKSENGNDYYAFQEIPYAEPPVGENRFQLPKLPKPWTNVLDATRNTKICYQDIPLYKNLEISEDCLYINVYTPEQPGSNNRLPVLLWIHGGAFALGGGTFEYVGPKYVMDAGIVVVSFNYRLGPFGFVGTNDGVIPLNLGLKDQRLAMQWVNKNIHLFGGSPDHVTIAGQSAGSISVGYHLTGPGENGKQLFHAAIMQSGSPVSGWLTQEDETSSALALGRRXILTLLVKDTKELLKVLKKGEIKK

SEQ ID NO: 21040 - protein, 259 aa, Diabrotica virgifera
  misc_feature: Coding regions on vcDNA: vcDNA=SeqID_737; Strand=+; Position=291-1070
  misc_feature: Homolog annotation: Hit_ID=AAV90740.1; Match level="QueryCoverage =100%, HitCoverage=100%, E-value=1e-129, Identity=88%"; Hit description=hairy cell leukemia protein 1 [Aedes albopictus]
  misc_feature: Gene Ontology Annotation: Molecular function=molecular_function unknown; Cellular component=nucleus; Biological process=protein biosynthesis
  misc_feature: Pfam annotation: Pfam_ID=Ribosomal_S8e; Match level="Score=335.2, E -value=9.9e-98, Copies=1"; Pfam description=Ribosomal protein S8e
MPQNEYIERHRKLYGRRLDYEERKRKKEAREPHKRAQVARSLRGIKAKIFNKERRNEKIQMKKKIKAHEEKKIKKTTEKVSEGALPVYLLDRDVQSRAKVLSNMIKQKRKEKAGKWDVPIPKVRAQADAEVLKVVKSGKTKRKAWKRMVTKVTFVGEGFTRKPPKFERFIRPMALRFKKAHVTHPELKATFCLPIIDVKKNPSSPMFTSLGVITKGTVIEVNISELGLVTQAGKVVWGKYAQVTNNPENDGCINAVLLV

SEQ ID NO: 21041 - protein, 323 aa, Diabrotica virgifera
  misc_feature: Coding regions on vcDNA: vcDNA=SeqID_738; Strand=+; Position=24-993
  misc_feature: Homolog annotation: Hit_ID=NP_651926.1; Match level="QueryCoverage =92%, HitCoverage=64%, E-value=1e-132, Identity=76%"; Hit description= CG1970-PA [Drosophila melanogaster] gb|AAF59336.2| CG1970-PA [Drosophila melanogaster]
  misc_feature: Gene Ontology Annotation: Molecular function=iron-sulfur electron transfer carrier; Cellular component=membrane fraction; Biological process=mitochondrial electron transport, NADH to ubiquinone
  misc_feature: Pfam annotation: Pfam_ID=Complex1_49kDa; Match level="Score=3.0, E -value=5.6e-13, Copies=1"; Pfam description=Respiratory-chain NADH dehydrogenase,
  misc_feature (271)..(271): Xaa can be any naturally occurring amino acid
MATAIMNTILKKTVELLPSKLFLKNGAALIHTSQKVNAGKWYPDTEWIKQFDGPVMYPDEITKNWALQPWNATKAPVEKEVKNVTLNFGPQHPAAHGVLRLVLELDGETVKRSDPHIGLLHRGTEKLIEYKTYTQALPYFDRLDYVSMMCNEQCYSLAIEKLLNIDVPLRAKYIRVLFGELTRILNHIMGIGTHALDVGALTPFFWLFEEREKIMEFYERVSGARMHAAYVRPGGVSLDLPLGLMDDIYEFACKYNERIDEVEDVLTHNRXIWVQEPKDIGVISAEDALNYGFSGVMVRGFRYQNGIFAVKQKALNESIMIHL

SEQ ID NO: 21042 - protein, 280 aa, Diabrotica virgifera
  misc_feature: Coding regions on vcDNA: vcDNA=SeqID_739; Strand=+; Position=44-886
  misc_feature: Homolog annotation: Hit_ID=AAC15830.1; Match level="QueryCoverage =68%, HitCoverage=64%, E-value=6e-33, Identity=40%"; Hit description =articulin 1 [Pseudomicrothorax dubius]
  misc_feature: Gene Ontology Annotation: Molecular function=structural constituent of muscle; Cellular component=sarcomere; Biological process=striated muscle contraction
MKILVSLLIVVASTYAGESKATEKRGVLEGNVHSLGSPLVLSSPVGLQTGLNNAHSLGGLQSHSLFASPFLNIRSVPSDLPLIDLGQSSHTTITKKVAVPVRQPYAVPVDRPIPVPVPHAVQVPVDRPVPVHVAQPYPVPVERQVPVPVEKVVPVPVQVPVRVEVPVPYKVAVPQPYPVEVARPVPVHVPTPVLVKQQVHVPQPYIVKQQVHVPQPYLVKQQVAVPQPVLVRQQVAVPQPVLVKEQVAVQQPVLLKQHVPVAAPVLLKEHDLHRYSSLLV

SEQ ID NO: 21043 - protein, 304 aa, Diabrotica virgifera
  misc_feature: Coding regions on vcDNA: vcDNA=SeqID_740; Strand=+; Position=86-1000
  misc_feature: Homolog annotation: Hit_ID=AAO66431.1; Match level="QueryCoverage =97%, HitCoverage=97%, E-value=1e-53, Identity=40%"; Hit description =luciferin-regenerating enzyme [Photinus pyralis]
  misc_feature: Gene Ontology Annotation: Cellular component=nucleus
  misc_feature: Pfam annotation: Pfam_ID=SMP-30; Match level="Score=174.8, E-value =1.9e-49, Copies=1"; Pfam description=Senescence marker protein-30 (SMP-30)
MAPVIEKVVDGLTFAESPYWDANNHCLYFVDLMESTVYRYAPRSKRKLRQVKIENHKISMIIPVMERKNRFIIGLNNSIAVMDWNRKDSEVKSINKLYEVDIDYVNFFTGGKFDLTGRLWAGTTTDYGVSGNFRGKLYSFDEEGVVKCHRIGIGISNGIAFDYNNKKMYFTDSLSQRIDQYDIDFNTGSLSNRQVIFSLYNHAEFDEDAICGGMTIDKEGNLWVAVFESSRVYKINPRIPDTVLQILQFPNSQITSITFGGKHLDELYVTSAGIQGNMEEIHGCVYRVTGLDVKGVPADKGVVL

SEQ ID NO: 21044 - protein, 392 aa, Diabrotica virgifera
  misc_feature: Coding regions on vcDNA: vcDNA=SeqID_741; Strand=+; Position=23-1201
  misc_feature: Homolog annotation: Hit_ID=EAL40799.1; Match level="QueryCoverage =68%, HitCoverage=93%, E-value=2e-15, Identity=25%"; Hit description =ENSANGP00000025886 [Anopheles gambiae str. PEST] ref|XP_563151.1| ENSANGP00000025886 [Anopheles gambiae st
  misc_feature: Gene Ontology Annotation: Molecular function=molecular_function unknown
  misc_feature: Pfam annotation: Pfam_ID=DUF227; Match level="Score=27.6, E-value =1.3e-06, Copies=1"; Pfam description=Domain of unknown function (DUF227)
MAENGMSIDLNQVVQTALSDFENVQLVSEKNDKEDDRQVLADVKTSGENLNLVIKLGKGVNVAEGFQREAYVLNRVTPLFKDIQKYLRIQNPVQEFQKCYKAFNQEGTEIIVLDDIEKRGFEAVSGDLSEHNFKLILNTIAKFHALSFALRHIHKEKFDEVLSNCQVVTKTMLEEVAQFFDARLEKLKFSLKLRMRLDLLKNFEDALENFNGRSIIDILNQSVEHSVLVHGDYHQNNTLLKFAGQDKTHAIDVALTGFQASGLHSPVIDLSYYFFSSLGCGFFPNVSEFLKYYYEQLTSFLKELGCDVAQIYTFEKLQQHWQQYSFYGFCLSIAYLELGSINFEKHFRKENEESSEVEKPAVGAPNVASANAYRQKLEKIVEFFLEAQQEFY

SEQ ID NO: 21045 - protein, 216 aa, Diabrotica virgifera
  misc_feature: Coding regions on vcDNA: vcDNA=SeqID_742; Strand=+; Position=274-921
  misc_feature: Homolog annotation: Hit_ID=XP_395179.1; Match level="QueryCoverage =82%, HitCoverage=12%, E-value=8e-41, Identity=48%"; Hit description =similar to DEAD/H (Asp-Glu-Ala-Asp/His) box polypeptide 26; RNA helicase HDB;
  misc_feature: Pfam annotation: Pfam_ID=dsrm; Match level="Score=75.4, E-value=1.5e -19, Copies=1"; Pfam description=Double-stranded RNA binding motif
MLQDHHHMSQNGMQRNARMGMQQMGPPPNQRTPMLMSMPATGVLVSMPPGPGPTLITTTSIPQQPQPKANIQQPVYHYENAGQPTEPDQHSTEHQNCSNTNTLSTPNATLANIKEKTPMCLVNELARYNKIQHQYRLTGEQGPAHKKIFTVTLKLGNEEYEAEGPSIKKAQHSAAAQALAKTEFKHPPPKTNYVTQPGYYPTHNLYNAQTQPQRYT

SEQ ID NO: 21046 - protein, 70 aa, Diabrotica virgifera
  misc_feature: Coding regions on vcDNA: vcDNA=SeqID_743; Strand=-; Position=137-349
ATAEPSIDIEASSKHGLTDSNTFFLIKGTLISQPLSRAAIQCVRENCPNVRPNERTSHTSYGKYNVTQIQ

SEQ ID NO: 21047 - protein, 286 aa, Diabrotica virgifera
  misc_feature: Coding regions on vcDNA: vcDNA=SeqID_744; Strand=+; Position=112-969
  misc_feature: Homolog annotation: Hit_ID=EAL33059.1; Match level="QueryCoverage =80%, HitCoverage=95%, E-value=6e-78, Identity=63%"; Hit description =GA15487-PA [Drosophila pseudoobscura]
  misc_feature: Gene Ontology Annotation: Biological process=locomotory behavior
  misc_feature: Pfam annotation: Pfam_ID=Aph-1; Match level="Score=362.6, E-value =5.3e-106, Copies=1"; Pfam description=Aph-1 protein
MTVAEFFGCTFMAFGPPFAMFIFTIAHDPIRIIILIAAAFFWLVSLLLSSIIWSAIPLKTHLEFAIFYTVLFQEGFRFAIYKILRKAENGLKKITDNSTTLIENKQILAYVSGLGFGIMSGAFSLVNVLADAVGPGTMGLKAGKETFFITSSLIGLCFILLHTFWSVIFFHACDNRNYLHLGYVVISHLVASYLTLLNSHYEYWGSITTLYVILMFTGCAAFKVAGWDSCFISKRGLILRLLLKKYVINKYFKLLMYLLHFIFPLTGIIFIYIWINIEIKKITTPT

SEQ ID NO: 21048 - protein, 413 aa, Diabrotica virgifera
  misc_feature: Coding regions on vcDNA: vcDNA=SeqID_745; Strand=+; Position=67-1305
  misc_feature: Homolog annotation: Hit_ID=EAL30314.1; Match level="QueryCoverage =21%, HitCoverage=25%, E-value=2e-09, Identity=31%"; Hit description =GA11985-PA [Drosophila pseudoobscura]
  misc_feature: Pfam annotation: Pfam_ID=Sina; Match level="Score=-43.2, E-value =0.00045, Copies=1"; Pfam description=Seven in absentia protein family
  misc_feature (334)..(334): Xaa can be any naturally occurring amino acid
  misc_feature (337)..(337): Xaa can be any naturally occurring amino acid
MEPICAVPDNVLSLLKCSLCESYLSVLPITLISEDGSQYKCGRCSTVKTIINTRALIYEHLAKLMTFSCNYSGCGKKVPFTDVKDHEKVCDQKTVVCPKDKCNEVVKVSKFGAHFKEKHADAHHVNSFLIKNIYINSNVDVLEKNGKTYLAIFDFDEVNFGLSVCALDPADNIQYEVKLRNEKSNYTINIASQNVIAFNEREHCIKCVGGTCKAKSHMYRENRRDILKRMTTRINRDCIKRMIGTGNLSYTINVYEEGEKPKDDSKIEVKDAIIRKAKKIFLQLLECPCCKEYMSPPIYQCLAGHTVCNVCKPTYEKCPSCEELIQKTRNFTLXELXKKVELPADDKKQSDTSLKRAAEENGHAENQAKVCKNYFSLTSRQGEFFLLFSVMAGINVFVYMTTRNVYNIWQIVL

SEQ ID NO: 21049 - protein, 542 aa, Diabrotica virgifera
  misc_feature: Coding regions on vcDNA: vcDNA=SeqID_746; Strand=+; Position=219-1847
  misc_feature: Homolog annotation: Hit_ID=S11485; Match level="QueryCoverage=94%, HitCoverage=88%, E-value=0.0, Identity=66%"; Hit description=RNA helicase - fruit fly (Drosophila melanogaster) emb|CAA37037.1| unnamed protein product
  misc_feature: Gene Ontology Annotation: Molecular function=RNA helicase activity; Cellular component=nucleus; Biological process=cell growth
  misc_feature: Pfam annotation: Pfam_ID=DEAD; Match level="Score=245.1, E-value=1.2e- 70, Copies=1"; Pfam description=DEAD/DEAH box helicase
MSFNRQGGGGSTFRSRENLSNGGGNDRFGGGRSGGGGGGGFKGGSGGGYRGNDSGGGGGGFRSGGGGRGGGGGFRSGGGGGGGFRSGGGGGGGRFGGRGGGGGRSGPQGGRLYRPQWDSITLRPFKKDFYVPHPAVANRSHYEVEQFRRAKEITIEGKVPNPIQHFEEASFPDYVMKEISKQGYEYPTPIQAQGWPIALSGLDLVGIAQTGSGKTLAYILPAIVHINNQPAIANGDGPIALVLAPTRELAQQIQQVASDFGNSTYVRNTCIFGGAPKGPQARDLERGVEICIATPGRLIDFLEKGTTNLERCTYLVLDEADRMLDMGFEPQIRKILEQIRPDRQTLMWSATWPKEVKKLAADFLKDYVQINIGSLQLSANHNILQIIDVCQEYEKEFKLNQLLQEIANNSDPDSKILIFVETKKKAEAVSRTVRRTGLQAVCMHGDKSQQERDFVLNEFRNGKSTILVATDVAARGLDVEGIKYVVNYDYPNSSEDYIHRIGRTGRSDASGTSYAFFTPSNSRQARDLLSGLKEANQVIIPN

SEQ ID NO: 21050 - protein, 155 aa, Diabrotica virgifera
  misc_feature: Coding regions on vcDNA: vcDNA=SeqID_747; Strand=+; Position=3-470
  misc_feature: Homolog annotation: Hit_ID=XP_392081.1; Match level="QueryCoverage =98%, HitCoverage=13%, E-value=3e-80, Identity=92%"; Hit description =similar to ENSANGP00000021966 [Apis mellifera]
  misc_feature: Gene Ontology Annotation: Molecular function=ATPase activity; Cellular component=spliceosome complex; Biological process=lariat formation, 5'-splice site cleavage
  misc_feature: Pfam annotation: Pfam_ID=DUF1605; Match level="Score=111.0, E-value =3e-30, Copies=1"; Pfam description=Domain of unknown function (DUF1605)
  misc_feature (113)..(113): Xaa can be any naturally occurring amino acid
QWCYDNFVNYRSLKSADNVRQQLSRIMDRFNLKRTSTEFTSKDYYINIRKALVNGFFMQVAHLERTGHYLTIKDNQIVQLHPSTCLDHKPEWVIYNEFVLTTKNYIRTVTDIXPDWLLKIAPQYYDLNNFPQCEAKRQLEIIQNRLESKQFQQGF

SEQ ID NO: 21051 - protein, 182 aa, Diabrotica virgifera
  misc_feature: Coding regions on vcDNA: vcDNA=SeqID_748; Strand=+; Position=1-549
HTRPPTRPIVSLPRITSKMKYIYFLFIYFLVALAKAEETVSLEGKLPKCECRDIIDEILCKLTENSEKVLKIQAKLAKVVKETNEILTEAKENSAQVKEIVSVSTLLKSQVNSTVTVVTANTAAIIQIKNQVHDHVLDNGGDLEQTLIGSSCKLNQIKRVLIGLGNCQCRKPDTDEANTEGY

SEQ ID NO: 21052 - protein, 273 aa, Diabrotica virgifera
  misc_feature: Coding regions on vcDNA: vcDNA=SeqID_749; Strand=+; Position=168-989
  misc_feature: Homolog annotation: Hit_ID=EAL33808.1; Match level="QueryCoverage =91%, HitCoverage=80%, E-value=2e-44, Identity=40%"; Hit description =GA17596-PA [Drosophila pseudoobscura]
  misc_feature: Gene Ontology Annotation: Molecular function=ATP binding; Cellular component=integral to membrane; Biological process=biological _process unknown
  misc_feature: Pfam annotation: Pfam_ID=BRICHOS; Match level="Score=92.7, E-value =9.8e-25, Copies=1"; Pfam description=BRICHOS domain
MPRILIFPAVARPHRGTTVSTLCLLLTALTVGGIGIVRGKILYDQYIIVAHKRFEGWAQIPIENELKSAYDGTEVDDTDAFLDKILPTENYNEMWNDDDTDFKHIFKDYFQENFEISNDEKYEKIDVPDFRDGRSGRFIHDFNTNTTGIIDITGRRCFVMPLNRDNVLPPKSLFDLIHKMWEGYYKVNTDLVRKNMRVIIPPITDTKTIGGYIASECDGLPIYKLEKYVGGVVKRSADKQSERFAQFAGQGVTQIEITNMDEVYAYEKSLISH

SEQ ID NO: 21053 - protein, 291 aa, Diabrotica virgifera
  misc_feature: Coding regions on vcDNA: vcDNA=SeqID_750; Strand=-; Position=248-1122
  misc_feature: Homolog annotation: Hit_ID=AAT79489.1; Match level="QueryCoverage =99%, HitCoverage=86%, E-value=1e-33, Identity=30%"; Hit description =mariner transposase C9 mutant [Mutagenesis vector pCAM45]
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=18.0, E -value=6.4e-06, Copies=1"; Pfam description=Transposase
  misc_feature (49)..(49): Xaa can be any naturally occurring amino acid
  misc_feature (134)..(134): Xaa can be any naturally occurring amino acid
  misc_feature (161)..(161): Xaa can be any naturally occurring amino acid
  misc_feature (233)..(233): Xaa can be any naturally occurring amino acid
MDLNREHFRAIIFYNFCRGLSQQQCLAEMVSVFGNEASHRSTIYCWYCXFQRGCFSLGDESRSGLFEKVVTQKNVDGVRRLIKDDRRVIYREIEASLSISKTSIQKILQLGVTKLVFSWIPHLLTEEQKAVRVXDVKKKWNESTKEAQKTFLVWLVAINLXVYSYEPENKRQFAVWLFRDGEKPTKVTRSRNVLKKMVATFVSKSGHVATIALEDRRTVISDWYITVCLPEVXRRRIILHQDNASAHTAQKTIEFLELQNIELLNHPPYILDLSLNDLLTFPKIKDSMRRK

SEQ ID NO: 21054 - protein, 192 aa, Diabrotica virgifera
  misc_feature: Coding regions on vcDNA: vcDNA=SeqID_751; Strand=-; Position=33-643
  misc_feature: Homolog annotation: Hit_ID=AAC28150.1; Match level="QueryCoverage =65%, HitCoverage=84%, E-value=2e-29, Identity=48%"; Hit description =mariner transposase [Tribolium madens]
  misc_feature: Pfam annotation: Pfam_ID=Transposase_1; Match level="Score=1.0, E -value=0.0003, Copies=1"; Pfam description=Transposase
  misc_feature (37)..(37): Xaa can be any naturally occurring amino acid
  misc_feature (133)..(133): Xaa can be any naturally occurring amino acid
MKNWVLLSWFPVGSLICSEEQKAVRVNWRQKTLERLXKGSSKNVYNIVSHDESWIYSKEPENKRQSAVWMFHDEEKATKCSRNVSKKMVSTCVSKSGHVATIALEDRITVTSDWYITVCLPEVIAKFRQSNTXWRIILHQDNVSAILPKRLAWSFKTSNCSTIVGDWINCFSIWFERMQKCIDLVGTYFGKQ

SEQ ID NO: 21055 - protein, 249 aa, Diabrotica virgifera
  misc_feature: Coding regions on vcDNA: vcDNA=SeqID_752; Strand=-; Position=497-1246
  misc_feature: Homolog annotation: Hit_ID=AAC28150.1; Match level="QueryCoverage =54%, HitCoverage=90%, E-value=6e-35, Identity=50%"; Hit description =mariner transposase [Tribolium madens]
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=18.3, E -value=6.1e-06, Copies=1"; Pfam description=Transposase
MVSVFGNKASHQSAISRWYCEFQRAGSSLIDESRPDSPKTSVTQQNTDAVCQLIKDGRRVTNREIEASFSISKTLIQKILHKKLGVRKLVCRWILHLLREEQKAVGVNWCPKTLERFNKGSSKNVYSIVSGDESWIYSYQPENKRQSTVWVFHDEEKLTKVIRSRSVSKKMVATFMSKSSHVATIALDDRRTVTSDWKITVCLPEVIAKLRKSNTQRRIIPHDNASAQTAQKTIVFGASKDIIVKPSTV

SEQ ID NO: 21056 - protein, 181 aa, Diabrotica virgifera
  misc_feature: Coding regions on vcDNA: vcDNA=SeqID_753; Strand=-; Position=417-962
  misc_feature: Homolog annotation: Hit_ID=AAC28150.1; Match level="QueryCoverage =75%, HitCoverage=90%, E-value=1e-33, Identity=49%"; Hit description =mariner transposase [Tribolium madens]
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=24.2, E -value=1.6e-06, Copies=1"; Pfam description=Transposase
  misc_feature (81)..(81): Xaa can be any naturally occurring amino acid
  misc_feature (107)..(107): Xaa can be any naturally occurring amino acid
MDDRRVTYREIEASLGISKTSIQKIPHEELGVRKLVCRWIHHLLTEEQKTLRVNWCRKSLERFNKGSLKNVYGIVSGHESXIYSYQPENKRQSAVWVFHDEENKQKXSCSRSVSKKMVATFVSKSGPVVKIALEGRKTVTSYWYITVCLPEVIAKFQQSNTQRRIILHQDNASADTAQKTI

SEQ ID NO: 21057 - protein, 281 aa, Diabrotica virgifera
  misc_feature: Coding regions on vcDNA: vcDNA=SeqID_754; Strand=+; Position=1334-2179
  misc_feature: Homolog annotation: Hit_ID=EAL33808.1; Match level="QueryCoverage =98%, HitCoverage=98%, E-value=2e-45, Identity=36%"; Hit description =GA17596-PA [Drosophila pseudoobscura]
  misc_feature: Gene Ontology Annotation: Molecular function=ATP binding; Cellular component=integral to membrane; Biological process=biological _process unknown
  misc_feature: Pfam annotation: Pfam_ID=BRICHOS; Match level="Score=92.7, E-value =9.8e-25, Copies=1"; Pfam description=BRICHOS domain
MTILTKPFSEKKGEKDVAPLVFNEQTAPANAPEDVESQQRRMPRILIFPAGARPHRVTTVTTLCLLLTALTVVGIGIVGGKILYDQYIRVAHKRFEGWAQIPMNDDDTDFKHIFKDYFQENFEISNDEKYEKIDVPDFRDGRSGRFIHDFNTNTTGIIDITGRRCFVMPLNRDNVLPPKSLFDLIHKMWEGYYKVNTDLVRKNMRVIIPPITDTKTIGGYIASECDGLPIYKLEKYVGGVVKRSADKQSERFAQFAGQGVTQIEITNMDEVYAYEKSLISH

SEQ ID NO: 21058 - protein, 314 aa, Diabrotica virgifera
  misc_feature: Coding regions on vcDNA: vcDNA=SeqID_755; Strand=+; Position=240-1184
  misc_feature: Homolog annotation: Hit_ID=EAL33808.1; Match level="QueryCoverage =98%, HitCoverage=98%, E-value=6e-47, Identity=37%"; Hit description =GA17596-PA [Drosophila pseudoobscura]
  misc_feature: Gene Ontology Annotation: Molecular function=ATP binding; Cellular component=integral to membrane; Biological process=biological _process unknown
  misc_feature: Pfam annotation: Pfam_ID=BRICHOS; Match level="Score=92.7, E-value =9.8e-25, Copies=1"; Pfam description=BRICHOS domain
MTILTKPFSEKKGEKDVAPLVFNEQTAPANAPEDVESQQRRMPRILIFPAGARPHRVTTVTTLCLLLTALTVVGIGIVGGKILYDQYIRVAHKRFEGWAQIPIKNELKSAYDGTEVDDTDAFLDKILPTENYNEMWNDDDTDFKHIFKDYFQENFEISNDEKYEKIDVPDFRDGRSGRFIHDFNTNTTGIIDITGRRCFVMPLNRDNVLPPKSLFDLIHKMWEGYYKVNTDLVRKNMRVIIPPITDTKTIGGYIASECDGLPIYKLEKYVGGVVKRSADKQSERFAQFAGQGVTQIEITNMDEVYAYEKSLISH

SEQ ID NO: 21059 - protein, 248 aa, Diabrotica virgifera
  misc_feature: Coding regions on vcDNA: vcDNA=SeqID_756; Strand=+; Position=240-983
  misc_feature: Homolog annotation: Hit_ID=EAA01922.3; Match level="QueryCoverage =75%, HitCoverage=87%, E-value=2e-21, Identity=34%"; Hit description =ENSANGP00000013813 [Anopheles gambiae str. PEST] ref|XP_561495.1| ENSANGP00000013813 [Anopheles gambiae st
QNLANVNNFDKNDKPTIQEKLQNWAVTNNVSHSAVTDLLHILHEDYPTLPLDARTLLKTPRSLPKIQLDKGELVHFNLKNTLLQILASNESFRNEDTLLLSFNVDGLPIFHSSNTNFWTILCLIKNFNIPPFVVSIYCGSAKPNPLNIYLKNFIIDLKDLLDNGLTYESLTYSIQIHSFVCDSPAKAYIKCIKSHGGYSSCDKCIEEGTYVNKRVILQNRKATKRNDTTFRLLQDENHHHGIFTLAEL

SEQ ID NO: 21060 - protein, 398 aa, Diabrotica virgifera
  misc_feature: Coding regions on vcDNA: vcDNA=SeqID_757; Strand=+; Position=108-1301
  misc_feature: Homolog annotation: Hit_ID=XP_321977.1; Match level="QueryCoverage =99%, HitCoverage=63%, E-value=9e-55, Identity=31%"; Hit description =ENSANGP00000004122 [Anopheles gambiae]
  misc_feature: Gene Ontology Annotation: Molecular function=transporter activity; Cellular component=nuclear membrane; Biological process=protein -nucleus import
MSSTDYLRLNEFKIFKELRESLPKTCNKTQNLITVHDNVLFTWDFQNHCVLSLNLKAARGKEGDNVIHQKLLPLHPPLFTPECVTVNQSGSLLAISGSSGILVLELPSRWPPFGSFQNNKEVVYCKAHSLDERLLSCSELVQLRKLQFHPGSPNHSHIVALTSDNSLRLYQVENGEVCNLAVYSVGEKPSTLFPGTTTTFLDIYGEVAIDFDFGLPEIQEIKQIKSVKFDETKSFIKSQTRLVDTETQTSNKIVATMKTEKKKDKEENDTVVWPVFILRSDMSIYKVSFDLKLRWKPIIGAPLAMSYTAEEQIDACSIICLNTVPQIICISLCDGSLLHAVCLEVESSKSGSKNYSGAVSEQELFVFEKVQLELGLTTCEEDQGKQSKCAVQLRKDEV

SEQ ID NO: 21061 - protein, 413 aa, Diabrotica virgifera
  misc_feature: Coding regions on vcDNA: vcDNA=SeqID_758; Strand=+; Position=2-1243
  misc_feature: Homolog annotation: Hit_ID=ZP_00110172.1; Match level="QueryCoverage =92%, HitCoverage=41%, E-value=5e-29, Identity=26%"; Hit description =COG4886: Leucine-rich repeat (LRR) protein [Nostoc punctiforme PCC 73102]
  misc_feature: Gene Ontology Annotation: Molecular function=insulin-like growth factor binding; Cellular component=soluble fraction; Biological process=signal transduction
  misc_feature: Pfam annotation: Pfam_ID=LRR_1; Match level="Score=84.8, E-value=2.3e- 22, Copies=10"; Pfam description=Leucine Rich Repeat
PPVPWSRKVLIVISTFFVCLKCSDISVKVFKNGDVVNLNINSISELKQNVVHRGELDDIEIEDQNVPVVPNNLLNGITATELHIIRSQVRDVEPGAFDGASMVNLMLYENQIARIRKGIFNKNSFNILALQNNVISNIEDEAFDGTTIAILDFGFNKMEKLTSKMFAGSNITNLNLQSNLISNIEDGTFQKIDNLNKLDLSGNQLEVIGHVFRNLTNLNELHLDGNRIKTLEPGCFGGSGIYWLYFAGNQLTHIVKGVFYKVPVSLLDFTNNKISKIDKGALAGLSTLTFVQLSNNNIGDLKLSTLGDLNTALNGLSLSDNGISNIDIGVFKNTKIDMLDLSKNHIKSIKKGLFQNVKMYTINLSENEITEIEEDAFGDIEDLSHIDVSLNKLTEVKKRMFSLPLDEVNWKIM

SEQ ID NO: 21062 - protein, 457 aa, Diabrotica virgifera
  misc_feature: Coding regions on vcDNA: vcDNA=SeqID_759; Strand=+; Position=61-1431
  misc_feature: Homolog annotation: Hit_ID=EAL25534.1; Match level="QueryCoverage =99%, HitCoverage=95%, E-value=0.0, Identity=73%"; Hit description =GA19322-PA [Drosophila pseudoobscura]
  misc_feature: Gene Ontology Annotation: Molecular function=translation elongation factor activity; Cellular component=mitochondrion; Biological process=translational elongation
  misc_feature: Pfam annotation: Pfam_ID=GTP_EFTU; Match level="Score=302.4, E-value =7.3e-88, Copies=1"; Pfam description=Elongation factor Tu GTP binding doma
  misc_feature (418)..(418): Xaa can be any naturally occurring amino acid
  misc_feature (434)..(434): Xaa can be any naturally occurring amino acid
  misc_feature (441)..(441): Xaa can be any naturally occurring amino acid
ELPLSIQISTSIIVARTLAPVVHRSLKQLFSKGTGTKVRNYCKTLQLATVQYNQKRLYAEKKVFERTKPHCNVGTIGHVDHGKTTLTAAITKVLAEQKLAQARGYADIDNAPEEKARGITINVAHIEYQTENRHYGHTDCPGHADYIKNMITGAAQMDGATMVVAATDGVMPQTREHLLLAKQIGVHHIVVFINKVDAADKEMVELVEMEIRELLTEMGFDGENIPIIAGSALCALEGKSPEIGSEAILKLLKEVDAYIPTPVRDLDKPFLLPVEHTYSIPGRGTVVTGRLERGILKKGAECEFVGYNKVLKSTVTGVEMFHQILDEAHAGDQLGALVRGLKRDDVKRGMIMAKPGTVKSHDNVETQVYVLSKEEGGRTKPFTSFIQLQMFCRTWDCPVQVVVPDKEMVMPGEDSKLXLKMLRPMVLEQGQRFXTLRDGSXPLGTGVVTKTLPRLSD

SEQ ID NO: 21063 - protein, 269 aa, Diabrotica virgifera
  misc_feature: Coding regions on vcDNA: vcDNA=SeqID_760; Strand=+; Position=140-949
  misc_feature: Homolog annotation: Hit_ID=EAA15064.2; Match level="QueryCoverage =69%, HitCoverage=50%, E-value=2e-25, Identity=36%"; Hit description =ENSANGP00000019373 [Anopheles gambiae str. PEST] ref|XP_552883.1| ENSANGP00000019373 [Anopheles gambiae st
  misc_feature: Gene Ontology Annotation: Molecular function=molecular_function unknown
  misc_feature: Pfam annotation: Pfam_ID=DUF227; Match level="Score=61.2, E-value =2.9e-15, Copies=1"; Pfam description=Domain of unknown function (DUF227)
MSCTQIKQLETLLSKQLVKKTIKNVNISRLTAPGENFGSIMYKLDIVLNNNDNDTEEILRAVAKTLPETEFWRQIFNIQVTYTSEMAFYEVVLPTFQEFQRSLGIDNVIDCFAECLAVRKNLLENSDVIDDDAVIVLENLISKGYNNIDRLKGFDLNTSKIVLKDIAHLHAVALALKLIDPKMFEERVKKYCHVYDPPKENSENNVLVAVVGENEECRQYLSRIHGWGKIPKSAPREPFATVVHEDLWTITLCRSRNGQPWEQLVDYNL

SEQ ID NO: 21064 - protein, 267 aa, Diabrotica virgifera
  misc_feature: Coding regions on vcDNA: vcDNA=SeqID_761; Strand=+; Position=90-893
  misc_feature: Homolog annotation: Hit_ID=EAA15064.2; Match level="QueryCoverage =92%, HitCoverage=69%, E-value=8e-23, Identity=28%"; Hit description =ENSANGP00000019373 [Anopheles gambiae str. PEST] ref|XP_552883.1| ENSANGP00000019373 [Anopheles gambiae st
  misc_feature: Gene Ontology Annotation: Molecular function=molecular_function unknown
  misc_feature: Pfam annotation: Pfam_ID=DUF227; Match level="Score=57.0, E-value =5.5e-14, Copies=1"; Pfam description=Domain of unknown function (DUF227)
MSCTQIKQLETLLRKQLTKKTIKNVNISRLTEPGENFGSIMYKLDIVLSNNDNGTEEILQAVAKTLPDTELWRKIFNIQVTYTNEMAFYEIVLPTFLEFQRSLGINDVINCFAECLAVRKNLLENSDIIDDDAVIVLENLIPKGYNNIDRFKGFDLNTTKIILKDIAHLHAVALSLKLKDPKTFDEKVKKYCHVYEVPKEHNTNNGFLKALIAENEECRQYVSRIHGWGEIAKSPPREPFATVVHEDLWTNILCRSLKMDSPLETTS

SEQ ID NO: 21065 - protein, 335 aa, Diabrotica virgifera
  misc_feature: Coding regions on vcDNA: vcDNA=SeqID_762; Strand=+; Position=56-1059
  misc_feature: Homolog annotation: Hit_ID=AAA70222.2; Match level="QueryCoverage =95%, HitCoverage=25%, E-value=5e-27, Identity=28%"; Hit description =putative ORF2 [Drosophila melanogaster]
  misc_feature (247)..(247): Xaa can be any naturally occurring amino acid
  misc_feature (284)..(284): Xaa can be any naturally occurring amino acid
MIFSKTPKKQVNPPKLFLKNLPIKYSESINFLGVKLDSRLSWQDHIHSLRLSVQNGLNLMKSISHKQWGADFQTLMTVYKTLIRSKLDYAAVAYNSAKGSLLKVLDTVHNSAIRIALGAHYTSSVECMYVESGEPSLQLRREYLSLMYALRVSTNPHVPVYKNTFTDRFPSTFNCGKRLDPPFYHRVRATLQSLDTIIPHTYNTFKVSQHILPWTIALPACNTNLSAFKKGDTPAKIFNQRLLEILXGFNDHIHIYTDASRSANGVGAAFTTDNYNSSYQLPPXTSIFSAELFAILQSLKFVNTHDLQFLIIISDSLSALTGLEAGIPQTSYPPL

SEQ ID NO: 21066 - protein, 393 aa, Diabrotica virgifera
  misc_feature: Coding regions on vcDNA: vcDNA=SeqID_763; Strand=+; Position=114-1295
  misc_feature: Homolog annotation: Hit_ID=AAH83195.1; Match level="QueryCoverage =98%, HitCoverage=97%, E-value=1e-118, Identity=55%"; Hit description= Zgc:101541 [Danio rerio] ref|NP_001006002.1| zgc:101541 [Danio rerio]
  misc_feature: Gene Ontology Annotation: Molecular function=protein binding; Cellular component=cytoplasm; Biological process=carbohydrate metabolism
  misc_feature: Pfam annotation: Pfam_ID=GHMP_kinases; Match level="Score=150.4, E -value=4e-42, Copies=1"; Pfam description=GHMP kinases putative ATP -binding pro
MATKFVTVEQLVVEAKKIFKEQFGEEADIAVFAPGRVNLIGEHTDYNDGFVMPMALPLVTVMVGKKVEGSVVTVYTTSKFCDQKTSFDLPSPCAPIRAITPVGPKWVMYIKGVIVNYIGDIPPAFNAVVHTNVPIGGGLSSSASLEVATYVFLDQLTGTKAIGLTDKALACQKAEHDYAGMPCGIMDQFISFMGKQDHALLIDCRHLTSHLIPLTEQNVVVLITNSNVKHELTGSEYPTRRKQCEEAALLLKKVSLRDANLDDIKYLESINTNKEIVARARHVITEIKRTSDAAEMLKQKNFLVFGELMNQSHVSLRDDYQVSCPELDSLVELALEVDGVIGSRMTGGGFGGCTVTLVYSHAVDKVIENIQKKYKGNATFYVCKPSAGASVIS

SEQ ID NO: 21067 - protein, 496 aa, Diabrotica virgifera
  misc_feature: Coding regions on vcDNA: vcDNA=SeqID_764; Strand=+; Position=57-1547
  misc_feature: Homolog annotation: Hit_ID=XP_392750.1; Match level="QueryCoverage =76%, HitCoverage=56%, E-value=2e-65, Identity=36%"; Hit description =similar to FAS-associated factor 1 (FAF1 protein) (hFAF1) (CGI-03) [Apis mellifera]
  misc_feature: Pfam annotation: Pfam_ID=ubiquitin; Match level="Score=7.5, E-value =0.026, Copies=1"; Pfam description=Ubiquitin family
MSENREEILADFQACTGIEDVAEAIYHLDEANWDLLRAVSRVMPPDTQSFRPPAVEPVDPDVMIVEDDADIPSAATADAASDMVVVGNSLGHSSTVTKKANTPDDSFPSTSAGKSGSRMLKFNVQYCDRVVKVELPESATVNDLKLKLHREVKVNPCRQLLSSWARLAQYEDTPFSKLMLPGDNSLHLTVKPSDGAFTSDEENAVSEKLRGTYTLNVKYENKTFNLKYQGTKTILEVKGDVYTLTNIHVRNQVWSGWPPNIDDNTVLALSGINYPEHDLSVRRSTQSVREKKSMPVVQIDSDDDEFEDASESFTVDDEYFVDNEGANAKRTDPLKDVEDEIVGCITFAEQFTTRYGPVHPAFYQGTLDDAIKEACSKPAKDDLNQSHGIIGSTMPSILKSAVEIGKFYNGEISQTIEKLDDIAKNADVDKPYDLFGNYVASELHQLPKRAAILLQQDIQNCITRQLNLLNAASPTDSNHRFCDWVFQRRRDIVQQR

SEQ ID NO: 21068 - protein, 86 aa, Diabrotica virgifera
  misc_feature: Coding regions on vcDNA: vcDNA=SeqID_765; Strand=+; Position=147-407
NEKMASRSNVQRSKHNYGILANVSTTELESIRVGIKRKTFTGTQSSAPIERGLGDPKSIIPLVHFGKGRRLMEFNFVSISSKITML

SEQ ID NO: 21069 - protein, 315 aa, Diabrotica virgifera
  misc_feature: Coding regions on vcDNA: vcDNA=SeqID_766; Strand=+; Position=241-1185
  misc_feature: Homolog annotation: Hit_ID=NP_728007.1; Match level="QueryCoverage =97%, HitCoverage=72%, E-value=1e-151, Identity=81%"; Hit description= CG9699-PF, isoform F [Drosophila melanogaster] ref|NP_728006.1| CG9699-PE, isoform E [Drosophila
  misc_feature: Gene Ontology Annotation: Molecular function=ATP binding; Cellular component=contractile ring; Biological process=cytokinesis
  misc_feature: Pfam annotation: Pfam_ID=GTP_CDC; Match level="Score=580.9, E-value =1e-171, Copies=1"; Pfam description=Cell division protein
  misc_feature (309)..(309): Xaa can be any naturally occurring amino acid
MSDKDRDYIGFATLPDQVHRKSVKKGFEFTLMVVGESGLGKSTLLNSLFLEDLYRNRKIPDVSERISKTTSIEKKTMEIEERGVKLRLTVVDTPGFGDAINCEESWKTCVNYIDEQFRQYFTDESGLNRRNMQDNRVHCCLYFVPPWGHSLRQMDLEVMKRLHRKVNIVVVIAKADTLTSSEVAKLKANILNDIRDNDIQMYEFPECDSDEDEEFKQQDKELKASVPFAVVGSNTTLEIAGKKIRGRQYPWGVVDVENPKHSDFIKLRTMLISTHMQDLKDVTEDVHYENFRAACISQISQHARERGNXKETLHM

SEQ ID NO: 21070 - protein, 181 aa, Diabrotica virgifera
  misc_feature: Coding regions on vcDNA: vcDNA=SeqID_767; Strand=+; Position=74-619
MCKFLVVAVCFMVAETKTVRRLSEVLEEDLQSVQNAKDRSLDGSKRYLEPDVSKHSADHNIVGRSLDDDLIERVAPYPLFERISKRAAMEPDTAYNTYPHQRFRRGSVVRLRTLILPVNERLSKRSIPLSYEEADESGKIVPSHNLLLRRERNIPKQRIYRRFAQDRYTGGIVFDPWMGRL

SEQ ID NO: 21071 - protein, 189 aa, Diabrotica virgifera
  misc_feature: Coding regions on vcDNA: vcDNA=SeqID_768; Strand=+; Position=73-642
  misc_feature: Homolog annotation: Hit_ID=NP_572883.1; Match level="QueryCoverage =92%, HitCoverage=71%, E-value=1e-52, Identity=54%"; Hit description =CG1662-PA [Drosophila melanogaster] gb|AAF48267.1| CG1662-PA [Drosophila melanogaster]
  misc_feature: Gene Ontology Annotation: Molecular function=molecular_function unknown; Cellular component=integral to membrane; Biological process= oxygen and reactive oxygen species metabolism
  misc_feature: Pfam annotation: Pfam_ID=Mpv17_PMP22; Match level="Score=48.5, E -value=2e-11, Copies=1"; Pfam description=Mpv17 / PMP22 family
MASILAMTTIKTKLGNILSKAFSSKYLLLTNLGLSVSLSAAGDIIEQKYEIMAKEIEEMSIERTKNLSVAGLTVGFVCHYWYKHLEKFLPGYTFRIVCKKVILDQIIASPVCIATFFATMGYLEGKSKTEFLEETKEKSVKLYVADWMIWPPAQFVNFYLLPYQYRILFDNAISLGFDVYTSRVKNMTL

SEQ ID NO: 21072 - protein, 328 aa, Diabrotica virgifera
  misc_feature: Coding regions on vcDNA: vcDNA=SeqID_769; Strand=+; Position=112-1098
  misc_feature: Homolog annotation: Hit_ID=EAA04703.2; Match level="QueryCoverage =92%, HitCoverage=43%, E-value=2e-83, Identity=51%"; Hit description =ENSANGP00000020780 [Anopheles gambiae str. PEST] ref|XP_564490.1| ENSANGP00000020780 [Anopheles gambiae st
  misc_feature: Gene Ontology Annotation: Molecular function=metalloendopeptidase activity; Cellular component=mitochondrion; Biological process =mitochondrial processing
MNSLLWRNYITKSFTFVRSHQRRRVSIWSPLAEAFNSRPTYKFQYHRNNGGLFGVSELTTANGFNIIEDMCIRKTDRLIEEAVNPHRQKKMVEIFDEMSDSLCQVADLAEFIRLAHPDESYRLAAENACCAVSGVVEKLNTNIELYKALKQAVKSDIVKNTPLDKHVGELFLIDFEQCGIHLPDNERNKVVNLTNNIFSLGQHFVTNSSTPRVIKKSVLPKNVRNILDSDGDSILVSGLYTDSTDPLAREMAYRIFLHPDRDQDQILNALLESRNELAHICGFQTYAHRALRGSISEHPEHISTVLKILSEDIYLLSQGDFTLMGYDS

SEQ ID NO: 21073 - protein, 376 aa, Diabrotica virgifera
  misc_feature: Coding regions on vcDNA: vcDNA=SeqID_770; Strand=+; Position=3-1133
  misc_feature: Homolog annotation: Hit_ID=Q90631; Match level="QueryCoverage=85%, HitCoverage=22%, E-value=6e-24, Identity=25%"; Hit description =Kinectin gb|AAA85818.1| kinectin ref|NP_990707.1| kinectin [Gallus gallus]
  misc_feature: Gene Ontology Annotation: Molecular function=ribosome receptor activity; Cellular component=endoplasmic reticulum; Biological process=signal transduction
HNANSEKAEATKIIAQLKADLQKTKEELNGLGDIPDSKNKHEVEILNLSNELSSTRNELSSKIEELQQNERKYKTELETSNKKYQLIQKELEEQKTKNNELRTKNWKVMEALNAAENKNKEPSKKPDIDVKQLSSEIISKEQDSQKQFMQRLFPDIEALKTLNSSDWQDQCAKLIEKYVRSLKEDQQHSSQHSSPQKSSEVIKLQAQIEHYKNTIDDTEGLLNELQKRVEQEEMTWRGQLAAKEAELENLKASHLSQLQSKLVNLENLLSKEVEEKKKLLEECQLLKSQKTQRSTQADSTATIEKLSEEVNHLREQLRLEQTKNGDVGVCIKAQNCNNSSNGPSFLDVSNVRNANICSNMGCQFLYCDGNSCGNNL

SEQ ID NO: 21074 - protein, 63 aa, Diabrotica virgifera
  misc_feature: Coding regions on vcDNA: vcDNA=SeqID_771; Strand=+; Position=2-193
RNNRFDMQRANLPRLKIPLWNTTPGQKKHSGSVYRPLSEDLSGPKTPKLSRYEFNTTPVVHTA

SEQ ID NO: 21075 - protein, 57 aa, Diabrotica virgifera
  misc_feature: Coding regions on vcDNA: vcDNA=SeqID_772; Strand=-; Position=624-797
EELNAADIRYIWQTIPALICGLTIFFLYYKRNNIYRQLNYVELRHDNIVLQSNYESH

SEQ ID NO: 21076 - protein, 701 aa, Diabrotica virgifera
  misc_feature: Coding regions on vcDNA: vcDNA=SeqID_773; Strand=+; Position=75-2180
  misc_feature: Homolog annotation: Hit_ID=XP_316674.1; Match level="QueryCoverage =98%, HitCoverage=75%, E-value=3e-44, Identity=24%"; Hit description =ENSANGP00000011311 [Anopheles gambiae]
  misc_feature: Gene Ontology Annotation: Molecular function=cell adhesion molecule activity; Cellular component=plasma membrane; Biological process =transmembrane receptor protein tyrosine phosphatase signaling pathway
  misc_feature: Pfam annotation: Pfam_ID=LRR_1; Match level="Score=132.1, E-value =1.3e-36, Copies=15"; Pfam description=Leucine Rich Repeat
MKLVLMLVAVQAAAVLTSPPSTPSTPSAPPSLPTNSKTCIDHCTCSFGMLTNRLQVTKCDRPLVLNDATFKYISKTSTNVITLDNLIINQIQVSAFAGFKNLDDVIITNTRIATIDVKAFENVTRLKFSKCAFEDSPDLFSTKLEEVHFGECKLEEIPNLNGLINLTFLNLSGNYIKNIEVEAFAELFDLGELHLSDNNIHKLPPTAFINNQELITLNLDNNPLKHFNINTSDSLEILSLKNCQLETFDEESTKKLTSLNELNLSHNNLTDIFSKALSHMQDLSVIDLSYNKLTKLQDNIFSGNGKLIKVILDGNNFDTLPSFYRQNHESFSTYTFSCKSCNLRILSANVFQNMDGLINLELSHNKLMNVDNVFDKITSLKQLDISYNEISYLSPAAFVHNGNLEILNIAGNPLLVLNPEVFAANHLLRDIDARNATLTKLWSNYNKPVKSLHKLLLSGNFLGTLTNDDFNIMPKLEAIELEDNPLVFDEKLCMLLYFLDLQGITPIDYSKNIYTGADKAFREDIDDFVTIEWKDVHKGKCPEHITESALPELTRIDNKTTYKTIDKIEKEDYEEDDDDDDSDSDEYDDEYYDEETTTKFQDTSLARATYILSVTSVFVLSALVVLTIAVTLTLCILRRNNRFDMQRANLPRLKIPLWNTTPGQKKHSGSVYRPLSEDLSGPKTPKLSRYEFNTTPVVHTA

SEQ ID NO: 21077 - protein, 67 aa, Diabrotica virgifera
  misc_feature: Coding regions on vcDNA: vcDNA=SeqID_774; Strand=+; Position=192-395
TSYLCTAAFVANGYSCLFSRFFLIRTSDCFLVCYFLPSTIQRQSLGLIIRPSVGMLVGFDIYVPTTY

SEQ ID NO: 21078 - protein, 70 aa, Diabrotica virgifera
  misc_feature: Coding regions on vcDNA: vcDNA=SeqID_775; Strand=-; Position=561-773
ILLFNYLLVRYIIYLFIRNLLNAVNLLYTLGRKLDIRIILMIPLSDTVDNHTQGDLEIFVGTDHSFFTNT

SEQ ID NO: 21079 - protein, 290 aa, Diabrotica virgifera
  misc_feature: Coding regions on vcDNA: vcDNA=SeqID_776; Strand=+; Position=270-1142
  misc_feature: Homolog annotation: Hit_ID=XP_313833.1; Match level="QueryCoverage =93%, HitCoverage=88%, E-value=1e-78, Identity=53%"; Hit description =ENSANGP00000024327 [Anopheles gambiae]
  misc_feature: Gene Ontology Annotation: Molecular function=ketoreductase activity; Cellular component=integral to membrane; Biological process=fatty acid elongation
  misc_feature: Pfam annotation: Pfam_ID=adh_short; Match level="Score=152.6, E-value= 9.2e-43, Copies=1"; Pfam description=short chain dehydrogenase
MEKETPTNFCLLNKIALVCAFIVGIQVTRMVFKFLYDNFLSTFLQINAVNLSETGKWAVITGATDGIGKAFAEVLAKKGLNIVLISRTQSKLEDVAKELGQKYKVEFMILVADFTDTDQIYSDIEKKLTGLDIGVLINNVGMSYNHPEYFLDVKEKDKFFVNLINCNIFSVTNMCKIVMPGMVERRRGVVVNISSTAAQIPNPLLTVYAASKAYVVKFSEDLASEYAKFGITVQCLLPGYVATNMSKIRSSTWMAPSPIGYVTEAVKTIGVKEKTTGYFPHTLLVSFLNT

SEQ ID NO: 21080 - protein, 212 aa, Diabrotica virgifera
  misc_feature: Coding regions on vcDNA: vcDNA=SeqID_777; Strand=+; Position=68-706
  misc_feature: Homolog annotation: Hit_ID=XP_392314.1; Match level="QueryCoverage =99%, HitCoverage=25%, E-value=7e-97, Identity=81%"; Hit description =similar to ENSANGP00000021631 [Apis mellifera]
  misc_feature: Gene Ontology Annotation: Molecular function=molecular_function unknown; Cellular component=endosome; Biological process=protein -vacuolar targeting
  misc_feature: Pfam annotation: Pfam_ID=VPS28; Match level="Score=407.5, E-value =1.7e-119, Copies=1"; Pfam description=VPS28 protein
MSAENRPELYEEVKLYHNAREREKYDNLADLYAVINTLQQLEKAYIRDCVVAKEYTGACSKLLVQYKAAFRQVKSDEFPTPDAFVKKYRLDCPAALERIKEDRPITIKDDKGNTSRCIADIVSLFITIMDKLRLDIRSMDNLHPDVRDLVDTMNRLSILPSDFDGKVKVAEWLNTLNEMQASDELSEAQVRQLLFDLESAYASFNKVLHNSA
